United States Patent 8,781,750 (CELL-TYPE-SPECIFIC PATTERNS OF GENE EXPRESSION) - sequence listing, part 26

SEQ ID NO: 36816 - DNA, 18503 bp, Homo sapiens
cgcgcagcccctccggccgcgggcgcagcgggggcgctggtggagctgcgaagggccaggtccggcgggcggggcggcggctggcactggctccggactctgcccggccagggcggcggctccagccgggagggcgacgtggagcggccacgtggagcggcccgggggaggctggcggcgggaggcgaggcgcgggcggcgcagcagccaggagcgcccacggagctggacccccagagccgcgcggcgccgcagcaggtgggtgacaccccgccccggccggccggagacccgagcccatcgccgtcagccagccagggccgcgcggggtaggtggcctccagcctctggtccagatcccgagagcgcagtccctctgcatcccctgcggctcagacgcggcgggagcagtggcccttgcccctgtgtaccctgagggcaggtggaggaagggactggagagcgagcctgaggctccttggtgtgaatttggggcttcgcagttccccaggcgcttcccccagccccgcattccgtgttccagcagtcctgggggaggggcagctggcgggagctttccccctcatccgacggggaagaaatggagcgctggggagggcccgaggctgtcgtccgcttgcaggtggccgagggaccagctcccgggtgtgggctcctctagccctgtagccgctgtctcctttcttgggggatgggtgctgggaggcacaagggcaccagagggataaattaagaattaagggagaggattctactcaaaattttagcttcccaacagttcgactctacaggagatggaactgccggcctgtgaggtgctaggttcctgtcctggaatgattcaagcagaggccatttgacagggttgctgaggaagaaatttttgctttggatgggaagttacccaggataaccctgcaaggcccctgccacagcccagaggctctgaaatacccaagcagcacctgcttggtgccaggcacctaccctaagttttctcattgcagcctccccaaacctttaggagacagataccgttatcctcatttttaaaatgcagatcccgaccaggagcagtggctcacgcctgtaatcccagcactttgggaggccgagacgggcggaacacgaagtcaggaaatcgataccatcctggttaacacggtgaaaccccgtctctgctaaaaatacaaaaaaaatttagccaggcgtggtggcaggcgcctgtagtcccagatactcgggaggctgaggcaggagaatggagaatggcgtgaacccgggaggcggagcttgctgtgagccgagatcgtgccattgcactccagcctgggcgacagagcgagactccgcctcaaaaaaaaaaaaaaaaaaaaattcagatcccagggctcagagaggttaagacacctgcctaggtcccacagtgagtagtatcagaggcaggatttgatcagaagtctaacctgtagagcgtgctctcctcccatgcactggtgcaaaggcttgaagaacactggggccggagggtcattgtgaatgtgtgagtgcacgtgtgtgacataactttattaaattacatggcaactgttaacagttatggtggctttcatgtgtttattagggtaattatgttcatgcacattatagttatagaaaatggttagggacatttttattggacaggcagtggttcaataactattttatttctctcacaaaagcttttgttaatgtttagaaatgtctaagtgtcaacacatcgcactaacctcattacacattacatgaggtgtcttagcctttccttaaaccactgaggtgggttacttgcactaaaatgtcacagttggaagcattacttagaatattggccaggtgcagtggctcatgcctgtaatcccagcactttgggaggccaaggtgggtagatcacttgatcaggggttcgagaacagcctgtccaacgtggtgaaaccccgtctctactaaaaatacaaaaattagccaggtgtagtggtgcacacctgtaatcccagctacttgggaggctgaggcaggagaatcgcttgagcctgggaagtggagactatggtgagtagattttgcgccactgcactccagcctgggtgacagagcgagactctgtctcaaaaaaagagagagagagagagagagagagagagagagagagagagagagagagagagaataggcctggcctggtggctcatccctgtaatcccagcactttgggaggccaaggtgggcagatcacctgaggtcaggagttcaagaccagcctggccaagatgccgaaaccccatctctactaaaaatacaaaattagcaggtcatggtggcacatgcctgtaatcccagctactcgggaggctgaggcaggagaatcgcttgaactcgggaggtggaggttgtggtgagctgagatcgcgccattgcactccagcctgggcagcagagtgagactctatctcaaaaaaaaaaaaattatactgaaagtccacatcatttacttttttttttctctctctttttttgagacagtcttgctctgtgaccccagctggagtgcaatggcacaatcttggctcattgcaacctctgcctcctgggttcaagcaattctcgtgtctcagcctccgaagtagctgggattacaggcacgtgccactgtgcctggctaatttttatatttttagtagagatggggtttcaccatgttggccaggctggtctcaaactcctgacctcaggtgatccttccaccttggcctcctaaagtgctgggattacaggtgtaagccaccatgcccggcctttgtttttttttttttttttggtggcatcttgctgtcatccaggctggagtgcagtggtgtaattatagctcactgcagccttcaactcctgggctgaagtgatcctcctgcatcagcctctcaagtagctgggaccatagatttgagccaccatgctgtctaattaaaaacaatttttgtttgttttttttagagatggggggggtctcattttgctgcccaggctggtctcgaactcctggcttcaagcaatccttttgccttggcctgcgaagtactgggattacaggcgtgagccattgtactcagcccaatcacttgcatttttgaggtgggctataaccgaatgctaaggttgtcaggagggcccaggacattccagattgaggatggaacaggttgggcaaaagcactgaaaagtgaaagtggaaagtattttaggagactccaataactccttggtttgaagcagtgtgctatcataatacagcactggaagatgagtcaacagtaacttgatatctgattgtagaaggccttgaatgcccaggtgaagattctggactgtaatcgaaatagggagccactgaaggttctagagcagtggaattctagcaaaggatgatttatctgatgtgggtgtggagggttctttaagtggagaaaataccagagacagggataacactaaaaggcttgtatattagtttgtgccagaagtaattcattattcatttaatgttcactgtaaccctgtgaggtaaatattatctccagtatgtggataaggtaactgaagtttagtgagaaaaattaatttacccaaggtcacagggacactcagtggtggagcttgggtttaaaagtaggtctggctgtttccaaagctctgttttctgtccattaaacatactgaagagttaaatatatgaggggtacataggaccaagaagaggagagtgatagtcattcacggggtaggactcaggaccaggtgcataatttgcagggctcggtgcaaaaatgattgagagtttcaagatagtgacaacagagcattagcctaagcacagggcccctctgagagcggggaacttgtgacttcacaggacgcacacccatgaagccagcccttacatggttggttttccaattactatggcagtgtaacaaaccacctcaaaatgtaatggcttaaaaggataatgggcccagcatggtagctcatgcctataatcccagcactttggaaagccgaggcaggaggattgcttgagcctgggggtttccaatcagcctgggcaacatgtgagaccctgtcacacacacacacacacaaaaagataacgttgatgttgactttgcacatgagtgcaggctgtggagacaagcacatttctactgcattcagtgttggctggggcagctcagaggctgggggttagaattatccggagcttggctctctcccctgtctggttgttgggctgggaagatttgagctggaggcttctcaggcatctgtttctaggtgggttctccacactctctcttccgtagggtggtttcggggagaccaggctccttccatggtggctcaaggttccagaggtgcacatctgtgtgtcaagtgaaggggagaaccagaaccaggcataagctaggtcacttttattacttggacttggaagtcatgtaagcaccatttcagcaactcattagaagccagtcactaagtccagatcatatacaaggggaggcgagttagactccaagttttgtgggaaggaatgtcaaagaatgtgtagacaggtttttaaagctaccacagtggcctaatgagtgagaggatgagtggatctgaggggtgcttcccctttatgcctgaacggctccccccagagtcatcctttggagttcacagacatcctcctttaaaaggcatctgagggccgggtgtggtggctcacacctataatcccagcactttgggaggctgaggcaggcggatcacgaggtcaagagatcgagaccatcctggccaacatggtgaaaccccgtctctactaaaaatacaaaaattagctgggtgtggtggcgtgcacctgtagtcccagctacttgggaggctgaggcaggagaattggttgaacctgggagacggaggttgcagtgagccgagatcacgccactgcactccagcctggtgacagagcgagactctgtctcaaaaaaaaaaaaaaaaaaaaaaaggcacctgctagtatgtaagaacacgtgaaggctggatgatgagttttgacagctctgagggatttaaatgactccagtgcctcctgtcggcctgggtcctagcagtaaacagatagggtggagaaagcaatttgagaggagccaggtgggaagggggtgtgtgaagccactgtggggccgtgcagatgaactcttggaaggaaaaaggccttattgtagatcaggcactgcactttacacatcttgtctcattaattaaaccctcaccacagccctgccagaggtgctctcgtcagccccgcattacagatggagaacctgaagcacagaaaagccgcacagctagtgggctgcggagcccagatttgaacacaggcagcctgaggtcagggcccataccccccaactttgggccgtaccacctattccatagcaattctgtgtttttcttgcgttaacatttgtatcttttcctacttacatatttgcaagctttagggggaaaaagaaaaagtaattcgaccttaagagatcagcttagtgataagagagtgcctcacatatggcaggtgttcaataaatattaaagaaatgaatatttatccttattgtacaaacttatatctaacttgccttccctacggatgcttgccctctggtctttgtcatgtggcagctgttggtgctttccatggtattctctgtggcacccaggccagggagccagaacttctggcattctcctggtcaactggctctctcagccattaggcacccctccttccaccttagagactggaaccctcagctgacctcagcccccttcttcaaaccagcagcactctagatacaaagaactgggagaggcagccctctctctgcccattcacccagaccctccttcagctgctgcttcctgacctcccaggcaccctgtaggcagggccttctctctaaccttcctggaaacaaggcactcatctctgcggctcctggaccccattcagtacccatagggtttctagggagatttctgtcttctacttcctgctgaggcccaggtggtggaaccccacccttctggggacccgggaagcctccacacactagcggcaattccttcagttctctgtcacttgtctcctcgaacgtgatttgtggtatatttcatgacacagaagtttaaacttttgatatactcaaatctgctcattttttccttttaaactttctgagttgatgtattatatttaatggttctatcacataatatggtttgttcagccattgcctaaatgttagacattcaggttgcttacatttgtttgactaatattaatagcacagctatacatatctttgtaatttcttttccatttatattcttttatgtaatccccaagacgatattgttgggtcagagttttaggaaattaatacacatttccagactgctctctaaaaacatttcaggtttatagttccagaagcagtaaaggttaatactcactgattcagtttccttagtgattgtaagactatcaaagcttatttctttttgcatcagttttgctattaagtttttctaggaaattggccatatcctctaagttttcaaatctctgctgtttctttagttatgtccctattttccttcttaatattgtttgtgccttttctatttgttcttttagtctttggtttatttttttctgaaatggggtctcactctgtcacccaggctggagtacagcagcacaatcacagctcactgcagtctcaacctcctgggctcaagtcatccttcacctcagcttcccaagtagctaggactacaggcgtgcaccaccacacccagctaattttttaaaattaattttttgtagagatgggggtctcactatgttgcccaagctggcctccaacttctgggctcaagcaatccttctgcctcagcctcccaaagtgctggtgagaggtgacagtgtgtgccctcgctcgttctcggcgcctcctcggccttggcgcccactctggccgcgcttgaggagcccttcagcccaccgttgcactgtgggagcccctttctgtactggccaaggccggagccggctccttcagcttgcagggaggtgtgtagggagaggcgcgagcgcgaaccggggctgcgcgcggcgcttgccggccagcgcgagttccgggtgggcgtgggctcgggggcccagcactcggagctgccggccggccccgccggccccgggcagtgaggggcttagcacctgggccagcagctgctgtgctctacttctcgccgggcctcagctgcctccccgcggggcagggctcgagacctgcagcccgccatgcctgagcctccccactgccgtgggctcctgcacggcccaagcctcccaacgagcgccaccccctgctccacggcgccctgtcccatcgaccacccaagggctgaggagtgcgggcgcagggtgtgggactgacaggcagctccacctgcggccccggtgcaggatccactgggtgaagccagctgagctcttgagtctggtggggacttggagaacctttatgtctagctaagggattgtaaatacgccagttggcactctgtatctagctcaaggtttgtaaacacaccaatcagcaccctgtgtctagctctgggtttgggaatgcaccaattgacactctgtatctagctaacctagtggggacgtggagaacctttgtgtctagctcagggattgtaaacgcaccaatcagcaccctgtcaaaacagaccactccgctctctgtaaaatggaccaatcagcaggatgtgggtgggggccggataagagaataaaagcaggctgccagagccagtagtggcaatctgttcaggtcgttttccatagtgtggaagctttgttctttcgctctttgcaataaatcttgctgctgctcactctttgggttcacactgcctttatgagctgtaacactcaccacgaaggtctacagctttactcctgaagccagcgagatcacgaacccactgggagaaacgaacaactccagacgcactaccttaagagctgtaacactcactgcgaaggtccgcagctgcattcctgagccagcgagaccacaaacccaccagaaggaagaaacttcgaacgcatccgaacatcagaaggaacaaactccagacacgccgcctttaggaactgtaacactcaaccgcgagggtccgcggcttcattcttgaagtcagtgagaccaagaacccaccaattccggacacactgggattacaggtgtgaaccacaacacctggctctctttgttcctaattgaaattgccaaaggtttgtctgttttactaggcttttgtttctttgtatatatatattttttattttactagtctttttaaagaaaccacccttgtttggctctgttgcttctctttattgtgtttttaatttctgctattatttcatttattttaatttctttaagtgtagtctcttttattagtgctgtttttgttatttttgggtttgtgtgtgtgtgtgtgtgtatttttttggagatagtctgactgtcaccgaggctggagtgtagtggtataattgcagcttactactgcctcaatgtcccacgttcaaatgttcttcccacctcagcctccctagtagctggatctacagatgtatgtcaccacacccagctaatttttttaaaaattattttctgtagagacagggtgttgcccaggctggtctcaaactcctgggctcaaacagagactatgttgcccaggctggtctcaaactcctgggctcaagtgatcctcccacctcggcctcccaaagtgctggaattacaggcattagccacacacccagcctttactttttatttcttctttttcatcttttcctgcttttatttcttctttttctgcctttcttttagttcagtttttaaaattccattaatttttttctactggtttgaggctatacattccagttctaattttttaatggttatccttaaaattttaacatgcttttttttttttttttttttttttttgagacggagtcttcctcttgttgcccaggctggagtgcaatggtgtgatctcggctcaccacaacctccgcctcccaggttcaagcgattatcctgcctcagccacccaagtagctgggattacaggcatgcaccaccttgcccagctaattttgtatttttagtagagacagggtttctccatgttggtcaggcagatcttgaactcccaacctcaggtgatccgcccacctcggcctcccagagtgctgggattacaggcgtgagccaccgcgcccagccttaacatgcatatttaacaaagttcatcaatatgtccactctcttcccaaacagccatctttgctttacatgtcattgtccaatattgtagttcagaccagcttttttgcctcatatattaacataattagcattgtttaacagtctatgtctgtttagatttagccacatactttgtgatttctttgctccacatgttttcttgcatttcaaaccctttttttttttttttaagacagggtcttgctctgttgcccaggctagattacagtggtgtgatcagagctcactgcctccttcacctcttgggctcaagcgatcctaccacctcagcttcctgagtagctgggactacaggcacaccccaccatgcccggctaattttttcctattttttgtagaaatggagtctcactatattgcccaggctggtcttgaactcctgggctcaggagatccttccacctcagcttcccaaagtgctgggattacaggcacgaactcatatccagctgaatttcctttaatgaaggaatgttagtggcaaattctctaagttatttgcctaaaattgtttttacaaggtaggaggattgcttgcacccaagaccagcctgggcaacaaagttgagaccctgtctctaccaaaaaaaaaaagctgggcatggtggcacattcatgtcgtcccagctacttgtgaggcaggagtgggagaattgctatgatcatgccaggagttccagcctgggcaacagagtgagaccctgtctctaaataaataaataaataaatttgcttcacctcattctgcaagataattttgctgagaatagaattctagaatatcaattttctcccctctctgaacacattaaaatactatattactgtatttgggcatcattgatgtcaagaaatcagctatcagtctaattacttttcctatgagatgatttgtcttttctttctgactgcttttacaattttttttttcttgagtgttctattttagaaaaataggtctaggtgagaatttctgtttatttaatctgcattgaattgttgggcttcctggattggcatattccagtgttttgcaacctactggaaaaatgtcagctattatttcttcaaatactgcttttttccagttgtatctcttatcttctccatccaccttgccacttaacctctgttttatattttctatgtctttgactcaatgaactgcactctggataatttattcagatctattttccagttcattaactctcatatcagttgtgtctaatcaatttaactcacccgttgcatttttatttttattttttattttatttatttttttaagacagtctcactctgtcgctcaggctggagcgcagtggggtgatcttggctcactgcaacctccgcctcctgggttcaagcgattctcctgcctcagcctcccgagtagctgggattacaggcgtgtgccaccaagcccagctaacttgtgtatttttagtagagacggggtttcaccatgttggccaggctggtcacccattgcatttttaaaatcaatcttttatttctaaaagttatgtttgtttcctcttcaaatctacttggtcatttttatgctcttatttctttctttctttctttttttttttttttttgagacagagtctcgctctgtggcccaggctggagtgcagtggcatgatctcagctcactgcaacctctgcctcccaggttcaagtgattcttctgcctcagcctcccgagtagctgggattacaggtgcccaccaccacgcctggctaattttttgtatttttagtagagacggggtttcaccatgttggccaggatggtctcaatcacctgacctcgtgatccaccagcctcagcctcctaaagtgcggggactacaggcatgagccaccacacccggcctcttttttttttttttaaaacatactgttgctggccggaaaactcttatttcttcctcatagtttcaagcttccctttaatttcttaaaacatgtgaactggccgggtgcggtgactcatgcctgtaatcccagcactttgggaggccaaggtgggcagatcatgaggtcaggagtttgagaccagcctgatcaacatggtgaaaccccatctctactaaaaatacaaaaattagcagggcgtggtggcacatgcctgtaatcccagctacttaggagggtgaggcaggggaattgctggaactcgggaggcagagattgcagtgagctgagattgcaccacggcactccagcctgggcaacagagcgagaccctctctcaaacaaaacaaaacaaaaaaaatgtgaactgtatctgctgtatattctgtgtgtaacaattccaacacagcttttccaagtctacttttccctgctattgttttgctggctcttactcagtgtcttatttctttgtatgtttataacgttttggctatgagttcatattcctggaaactttacctatggaaattctttgaggcctggattagagttgctccagagatgtgtgttttcctctgccagtcatctgggggtgccatcaaccaggttgcacttcaaaatacattacctactttagatgttctgaccatacaggtagcattaataattcaggcttcaaacccacattagagggcaggcgcagtggttcatgcctgtaatcccagcagtttgggaggctgaggcgggaggatcacctgagatcaggagttcgagaccagcttggccaacacagcgaaactctgtctctagtaaaaatacaaaaaattagctgggcatggtggcacatgcctgtagtcccagatactcaggaggctgaggcaggagaatcgcttgagcccgggaggtggaggttgcagtgagctgatatcatgccacagcaactccagcctgggcgacagagtgagagagactccatcccagaaaaaacaaaaacaaaaaatccacattagatcaggcttgttatagagtctcagggagagttttttttctcccttctacacagcaccaaaatcaagaaaggcaaaattctttgctgcccttcttcatgacaaatttactttttgttcatgttcagagtgtagctgtttggaatcccagctttacgtagggaatctcctgttagtctcttcatatcaggtgggcccaggtatcatctctggtctcctttacagcacaagcacactgacaggcagctcaagttcacctgggtttggtttggcagatactcctaaggcaaaagctaatgtcaagctcactttcccccagattactgttttcactgcacatttgtactgttgaggatttcttgccaacccagtgcttttgaaaagatactttctatttttatccagctttgtggttactttcattgggacatttactattacactcccagaagtggaagtctgaatgtttttctagtccatcctttttctgggctgtgaccctttgacggtttcatgttgatacagagatctcagttccaatggcctaccttgaacgggcccaggaccttgtcttctcttccaggtgcaacgactaaaaccctaggatttatgttgccagctgatgttggtgaatacctttagggcagctgtggcttcagcatctatttttggctactggggcttatagacaccaacaaattatgtatactcactttatctgttgggccagttgtatgcatagaaaaatgaagacgggccaagtgcagtgcctcacgcctgtaatcccagcactttgggaggcccaggcgggcagatcacctgaggtcaggtgttcaagaccagcctgaccaacatggtgaaaccccgtctctactaaaaatacaaaaattagccaggtgtggcggcagttgcctgtaatcccagctactcgggaggctgaggcaggagaatcacttgaaccagggaggtggaggttgcagtgagctgagatcatgccactgcactccagcttgggtgacagagcaggactccttctcaaaaaaaaagaaaaaaaagaaaaatgacaggttctgtgactctaggtagcttcatcttcttgtggacttccatgtttagctagttttcccttaaggtagctttaaaaggcagaattttgtttatcttcccattagccaggtgcttacctgctctacccctcatctcttaggaaatggaagtccatcctggcagtggttctgaaccttattagggtcatgggttgcttggagaatctgctgaaagctatgaaccttcctctaggaaaacccagtgtcagccagatggggatgttcctgatctctgctagaccatcaagcatctgacggtttttctttctagagatgggcttggggtctcatgccttggctttggtgggcttctgcttcctcaggaactcacactacctgtacataccctgggactcaccagaaagctttaggctctgtttgattggtccattctatccttgactgttttcatatactcaagtggttgattttgccaatgggcctaagccatgtcagtcttaggggaagtttttgttttttcctttatagtgggtctaattttcctaactgcatttagcaaatagcaattcctggggccactgttggtctgaccctgatttattgtgtttgcagtttgtacttgagtttagacctatttcaagaagtctgcgcctcttttgatttgttcttcagtgggtttttaataaacacaaacagtccatttctctttttgcctgtgtttaagtcttggtctttttgtgactccctgcgtttcttacctggcctttttcttaaactttctgcgctcctttccatctgtaagatgaatgggctgaaggaggtcagatatgcttgcgctgtacttctctgggcaccttggcacctagtggggagcaagggaatggggcgtggggtggggatgcgcccccagctctgcttccgccacagcaggcctgcctttatgtgctttatatacaagagctggagtgacatttattttgagcatagttccatgggatccctgctgtctgtctgtgagtcctccctgagcaggagtcctgtctttggggctgcaggtagaagcaggcagaaaatgcgcttgtgtctaacccagcccatctgtgacacggtggcagacgcctctttcccccgacccctgattctcttccttgttccagttccaggaaggatgttacctttgacgatgacagtgttaatcctgctgctgctccccacgggtcaggctgccccaaaggatggagtcacaaggtaacagggttatgagggcagggccaagggctgggaggagggaaagtctctagagaatccaagggtgtggtgggccctctgggaggcaggagactggggtgtaggttccccgatctctgtatctccctgccatcagcctcccatcttgtgcctgtcagagtgccacaaagtgggcattcagtacatgcttgctggacccatttggaatcagagaactcagctccagtgcatcgtgaagaacagggaagaagctgtggcgccagagaagtgggggctgcaattgtttgtttgtttgtttgttcttgagacagagtcttactctgtcgcccaggctggagtgcagtggcatgatctcagctcactgcgagctccgcctcccgggttcaagcaattcttctgcctcagcctcccgagtagctgggactacaggcgcccgccaccatgctgggctaatttttgtatttttagtagaggtggggtttcaccatgttggccaggctggtctcgaactcttgaccttgtgatccgcccacatcggcctctcaaagtgctgggattacaggcatgagccaccgtgcctggcctgcagttttgttatcaagaccttgaggtgggctgggtgtggtggctcacacctgtaatcccagcactttgggaggccgaggcggacagatcacctgaggtcaggagttcgagaccagcctggccaacatggtgaaaccccatctctacagaaataaaaaacaattagccgggcatggtggtgcatgcctgtaatcccagctactcaggaggctgaggcaagagaatcgcttgaacccgggaggtggaagttgcagtgagccgagatcaagccactgcactcagcctgggtgacagagcgagactctatctcagaaaaaaaaagaccttatggtggcaacaccaaagaagtagagatcattagcatgtcatttctatgttatctgaatacctttctgaaggttttatttataaatactgtgcaatgggtatgctgggtagaaggggaaacagccacaggaacagccacaggggctggtagctgtgacaaaagtcgctgcaactcctgccagctctctggcatcacaggtctggattgacttgggcaaacagttaacccagtccagaagtgggagcacatttggagcttgaaagactgacaacgagatcctgagcagcttgaaaccccagaaccaacagatacaccctgtcctggaaaaagtataggtcaattttatgtcatggagcaaactgggtctatataaaactgggcagtgccaccaggctcagccagagacctgtcccttggctcccagcatggaaggagaggggtctgtgacccatgttgtcctgccactcactgggctgttttcttggatctctaacttgtgtctactaggtgtggcctcatctggcctctacctaaccagttgttttatttgggttttcatttaaagtctaaggtagccagctgcaaaaacagagtctgagggagttaaggatttggttccaaggagaccagaagagcctccccactacagggtttttggaattttgggggcaactccctttgggtctggggagaaaactgccaggagattggaggcagaaggttggcaggctgggccctgagggaggctctctgcaaggctggtcctccccttcctcctccaggccagactctgaagtgcagcatcagctcctgcccaaccccttccagccaggccaggagcagctcgggtgagtagggtgggccgggggtgctttcagggagaagaccaggcccagggctgcagactcacctctcccgggctgattctccacttttctgacagacttctgcagagctacctaaagggactaggaaggacagaagtgcaactggagcatctgagccgggagcagggtgaggggctgggctgatggggccagggacgggaggctctgggcagccagatctgggactgacctcggctgccccattgactcctgccttctccacctcccccggcacctcttctaatccagcttctcttctctttagttctcctctacctctttgccctccatgactatgaccagagtggacagctggatggcctggagctgctgtccatgttgacagctgctctggcccctggagctgccaactctcctaccaccaacccggtaagctctgctggatggagatccccgcataaaggagacccagcactttggggctttggtctttctcatcataactcttttggtgagtcctctgtaaaaggagggctcagagcttgcacggcagggatgcaagggtgtgttagggagggtcagaactcctgggaacatctctgtccctggagaccccacagtgactctgcttccacaggtgatcttgatagtggacaaagtgctcgagacccaggacctgaatggggatgggctcatgacccctgctgagctcatcaacttcccgggagtagccctcaggcacgtggagcccggagagccccttgctccatctcctcaggagccacaagctgttggaaggcagtccctattagctaaaagcccattaagacaagaaacacaggaagcccctggtcccagagaagaagcaaagggccaggtagaggccagaagggagtctttggatcctgtccaggagcctgggggccaggcagaggctgatggagatgttccagggcccagaggggaagctgagggccaggcagaggctaaaggagatgcccctgggcccagaggggaagctgggggccaggcagaggctgaaggagatgcccccgggcccagaggggaagctgggggccaggcagaggctgaaggagatgcccccgggcccagaggggaagctgggggccaggcagaggccagggagaatggagaggaggccaaggaacttccaggggaaacactggagtctaagaacacccaaaatgactttgaggtgcacattgttcaagtggagaatgatgagatctagatcttgaagatacaggtaccccacgaagtctcagtgccagaacataagccctgaagtgggcaggggaaatgtacgctgggacaaggaccatctctgtgccccctgcctggtcccagtaggtatcaggtctttctgtgcagctcagggagaccctaagttaaggggcagattaccaataaagaactgaatgaattcatccccccggccacctctctacccgtccagcctgcccagaccctctcagaggaacggggttggggaccgaaaggacagggatgccgcctgcccagtgtttctgggcctcacggtgctccggcagcagagcgcatggtgctagccatggccggctgcagaggacccagtgaggaaagctcagtctatccctgggccccaaaccctcaccggttccccctcacctggtgttcagacaccccatgctctcctgcagctcagggcaggtgaccccatccccagtaatattaatcatcactagaactttttgagagccttgtacacatcaggcatcatgctgggcattttatatatgattttatcctcacaataattctgtagccaagcagaattggttccatttgacagatgaagaaattgaggcagattgcgttaagtgctgtaccctaaggtgatatgcagctaattaaatggcagattt

SEQ ID NO: 36817 - DNA, 33167 bp, Homo sapiens
cggattgtcagactgctcctccctcttctttagactgccacgaggaaaaagcagatgtgagaactcaaggttcagggctgctcttctaagaaacaagtctgccataatctccatctgtgttggaatctgttaactagtgagtacctcatctcccctcctgtgtaagatttcctgaactggcacatctgttttttgagcaaagataacaaacagatgaacaaaaccaacaatcaaaaatgctgtcattaaagtcttgggcagccaaagtttctctcagaatttctcagttgtgtgatactatctattaagtgatgaggagtatgcacacacaaaaggctataaatgtagcagctgagttttcatgttgagccttttggtgctatttgattttttgaaaaactatgtacatgtattaagttgataaattttttttttaattttaattgaaccagatgcggtggctcaagcctgtaatcccaccactttaggaggctatggtgggcagatgcagatcacttgaggccaggagttcgagaccagcttggccaacatggtgaaaccctatctctactgaaaataaaaaattagccaggtgtggtggcaggtgcctgtaaccccagctacttgggagcctgaggcagtagagtcacttgaacctgggaggtggagtttgcagtaagctgagattgcatcactgcactccagcctgggtgacagaacaagactccatctcaaaaaaaagaccaggtagtggctgagattttcattgtactgtctgcttagctccccaccttgctcagtgacagatgggaatccatcttctgcatcatccagaaagtatgtaaattacttccaggaaactttgggaaacacagatgcaaacctaagagcagccagttttctcctttaggtggtcaagggcagctgcaaaagttctgtataggaggggcttcaggcagggtctggttgggtttggagacaacagcagtgaatttaccttgcgttgaggctgtatatgttaaactactgttattacttggatacttagagggagggatgtttagggagctgtggggaggctaaagcccccttggctgtagggacaaagagcttgcatttcagatgagaccttaaatactttcagaagcctatctgaccaggggtggtactgtctttcttagaagagttttccttaccaatgtttctgtggctcagtataaaaatctggagtcaccctgggaaagttatctcagcaattttacctacaaataattttataaacctgggaaatagaagttgtaaaatgctaagatcgatgaaaagggaggaaaagaactttgttgaggagaaggtaatcttatggttttgatgaagaggatgtcgatatttgctttttggtagaacagaatggttaggttcattttaagctccaaatgactgatcaattttcttttcaacatacgtttgaaggattctgaatgtggtgtagagtattgtatgggagctagggaacaaatcatactaaactctgattctattcagaatcagcaagctaagtatgatatatttatctccaatcatattaatatttacataattatttaatgtcttccttaatagtctataagcttcatgggagcaagaccagccgtgtcttgttcacagctatattttcagcatttagtacaggtctggcatataccaagtgttcaataaatacacgggtaatgaataaatgcgttgtccaatttaaatatgtgtgtctgtttgtgtatacttccttgtctgtaaaatgaaaatactaataaataactgcaaaatgcttaacagtacaaccacttgccagatctcagcaaaaatgttacgtccctagagagacctcctaaaaggtcccttttctcccattactctctttgttttcttgcgtaacatcacatttatttattcccttgtttactatatgtgtctttctatgagagcaaggaggaccttgtctcttgcattccctcctgtatcctctatgtctgaaataattcatggcaagtgattaataattgttgaataaataaatgaatcatgccaacctaccaagaatgaagctcaagaccttaagatatttgtccaaattcctgccttttatttaatagaatcagaaattgtttctaatacttcacaaccacttaaaaatactattcatttttacatccaagtaatgaaagaatcaggacgttccttttggaagacatagtttcaacattttatctaaattgcaaaattatacaaaaactcaagtgaccattgataggggaccggtttaagaaatgacagtgcagttcttcactagaatgtcatacaactgttaaaagaaaaaaatcagaacagggctgagtgtggtggctcccacctgtaatcctagtgctttgggaggccgtgtgcgtgtttgtgtatatttccttgtctgtaaaatggaaataataataaataactgcaaagtgcttagcacaggaggattgcttgaggtcaggagtttgagaccagcctgggcaacatagtgagacccccatctctaaaaaattttttaaaacacttagctgggtgtggtggcacacacctgtaattccaggtactctggaggctgaggcaggaggatcgcttcatcccagaagttcaagctgcagtgaggggtggtcgtgccactacactccagtctgggtgacagagtgagatccatcctgtctttaggcagggaaaaaaaggaaagaataaatgaataaatacttcatttaaaaaaatagaatgaagatctctgcgcactggtatggaaagcccttaaaaggtacattgttaaaaatgtttttagtgggcagaatagtgtgtattctgtgctacctgttgtgtaaaattggtggagaaataagaatctatactcataatttgcttgaatgcacataaagaaaccctgaaaagataagtagaaataataatagtggtttcctgggagtgagagcaaagtgggcagctttgagactagaggtgggaggcagatatttttttttccctctgtaccttttacagtttttttgagccatttgaagatattatgcgaaaaaaaattaaaaacagagagagacaagtagtgttgattacttaacttctttcagttgaaggaaacctgatgctaattctgttaagaggagagcagccaaaagcataggttgtgacttgccagcaaaaaacagggaccggggccgggcgcggtggctcacgcctgtaatcccagcactttgggaggccgaggcgggcggatcacgaggtcaggagatcgagaccatcctggctaacacggtgaaaccccgtctctactaaaaatacaaaaaattagccgggcgtagtggcgggcgcctgtagtcccagctactcgggaggctgaggcaggagaatggcgtgaacccgggaggcggagcttgcagtgagccgagatcgcgccactgcactccagcctgggcgacagagcgagactccgtctcaaaaaaaaaaaaaaaaaaaaaaaaaaaaacagggaccggtagttccctctgtacccaatccccaatgccaaacagaatgacattgttagacttaaggtcttaacctgcagggcaactgggattcagagtgattttagttctgttcttaagagcagccttttctcctaaagcctgccaagaaatttttgttaattcttcccaggaacataacagacaaggcccctgctctggtagaacttacatcacagtgcaaagatcagcaaactgtagcccatgggtcaaatccagccctctgcctgtttttgtatagcctttgaaccaagaatggtttttaaattttttaatggttgaaaaaataactaaaagaggaacactaattcatgacacatgaaaattaaatgaaattctagtgtcagtaccataaataaggttttattagaacacagccatgccaaaatttatttatgtattgtcaatggctgctctctcaatggcagagttaaatacctgcagcagagaccatatggcccacaaagcctcaaatatttagtgtctggcccttcacagaaaaagtttgctgacccctattctagtagagagtaatatgcttggcaccatgataagcattttgcatacagtatcccattcagtcttcaggacaaatctctgatggaggttctattagtcgctccattggtaaaatgtgaaactgaggttcagagtgattaataattcaaataaggtcatgcagttcataagaggcaaaactgggagaccatatcacatgaccatatgactcagtagccagtgtatttaaccatcatgccatagactggtgcttttcacacttgaatgtacataccagtcacctgggatcttgttaaaatgtcaacatctaccaattcagtagatctagagtggggcctgagaatgtgcatttctaacaagcttctaggtgataaagatgatgatggtggttcacaaatcacagcctctaaatcagtgattctcaaccatggctgctgcacattaaaatctgaggacattttaaaaaatataaatgggcccagagcccactctgaaatattctgatttaattgatccaagacctaggcatcagagtatttttttttaatgctttcttggtgattcaaatgtacagctggactgcaaaccactgctctattgaaatcctgtcgaatgacagtaaaaacatttaatccaaagaccagagttctagttctaactctggtatgacagaatgaagcaggctgtttcccctctctgggtctccagttttctttgcaggtgaaaaaggaaaaagctgaaaccagatggtgtcagagggctcaagatcactgacttgtcaggtcttcacacacataaatgggaaggacagaagtacccaggtttcctgatgcatcggttatatcaacatgatgcccaaacaccaggtctgcttagggtaaaactgcaataactgtagatgtcagctaaactgtccatttagctgacatctgcaattatgtattgttttggcaatgtatcaatacagaaatgcttccacatagccagactgccttacatggcacacagctagaattgtagttagaatgatgatttaatgattatgagagtaatatatattgcattgtaggaaatttggaaaattacaggaagtataatgaggagaatctcaaacactcataatccctagaactgtatttttaacagcctcaaccaagtaaatgacattgtgatcaaatgatttcccacagaagcaggcgatggcccagaggggcctccccgacaaaagtcctaaatgttaaagccccattattacatctctattaaatgcagctccaagcctggacttaaaagtagtatgggcccctattgagagcatgggaactgcaacctatcaactagacagttcataaactgtgacagtgctttcatgtctaattgttattgggctactctcgatttcttcatctacagattatccactgtgaaaaatgctccttaacatttctaccctactttgaaatctgcaggtgaaagatattagacaagaagccttagccctttgctttcagtgagattaagtgggtgacccagatctttacttctttagaaatgcatatgggtgtcaatagtgcacagtattctggagaatgggctaggacctgatagttctgggttcaaatccagccaatgcctcttactagtcattttctcaatctgtaaacagagatgataatagtacccacttcacagggtttctctgaggatttaataagaaagtgtctataaaacactgagcactgtgtttggaacacagagtgtacgcagcaaatggtactatcatgatgattatcaatactaataacaaaacttagccactttggggtatggctaccttcaggacagaaacaaatatatgtcctttttgcttgtcttttagatgaactggtctctgtgcaaatcctgagtgctaaagcttccaacaagactgatgctagctcgtgtcaccaggaagatgctacgtcatgccaagtgttttcagcgcctagcaatttttggttctgtgagggcactgcataaagataatagaacagcaacccctcagaatttctccaactatgaatccatgaaacaggacttcaaactggggattccagagtatttcaactttgctaaagatgtcctggaccaatggactgataaggaaaaggtatggggggagggccagtcagaccacaatttctcaactgggagtgattttacccctaggtaacatctctaatgtctagaaatatttttgttgccatgataggggcagaggcagttgctactggcatctaacaggtaaaagccagggattctgctaaatatcccataatgcacagggcagcctccagaacaaagaattatttgacccgaaatgtcaatagttccatggttagttgagagaccctgtattacataaatgtagaattctaggttgacttaaaaaaaaaaaaggagaagagtgaaaagtaattccaagagtcagaaatggtagaaaaggaggcacagataaatctttggggaaaatgtaaaggatgcaagaattctcacttattggaaagaaaaatgatcaggctaaatgggaaatgatttgggccaaaagaaatgacatggcttccaacgtctagaaataaggaccccaaagttattatttttcctgttatgtttagttatgtaataactatacatagttatggggtacaaagatatttttgatacatgtataaaatgtgtagtgatcaaatgagggtaattaggctacccatcatcccaaacatgcatcatttctttgtgctgggagcattcaaaatcctctctcctagctttttgaacatactcaatatattattcttaactgttttcactctacagtgctatagaacactagaacttattccatccatctagctataattttgcatccattaaccaacctctttctatgctcctctccccactaccgttcctagcctctaatagccacaattccactccctacttctatgagctcttttcaggctggagtgcggtggtgtgatctcagcccactgcaacctccgcctcatgagttcaagcaattcttgtgcctcagcctcccgagtagccgggactacaggcacctgccaccatgccggctaatttttgtatttttagtagagacagggttttgccatgttggccaggctgaccttgaactcctggtctcaagtgatccgcccaccttggcctcccaaagcactgggattacaggcgtgagccacccaccacgccaggccgagctccttttttttttttttttttttttttttaagagacagggtcttactttgttgcccaggctgaagttcagtgaagctcatttttttaagctcccacatatgagtaagaacatgtggcatttatctttccgtgtctgacttatttcacttaacataatgtcctccaagttcatacatgttgccacaaataacagaatttcattcttttttatggctgaatagtattgcactgtgtatatataccacattttctttatccattcatctcttgatagacatttaggttgattccatatcttggctattatgtacagtgctgcaataaacatggcagtgcagatatctcttcaatagactgatttcctttcctttgaaaaaatacccagtggtgagactgctaaatcatatggtagttttatttttagttttttgagaggcccttatattgttttctgcaatggctgtactaatttatattctcaccaatagtgtttcagagttcccttttctccacatcctctcaagcatttgttatcttttgtctttttgacaatagccattctaactggggtaagatcatatctcatcatggttttgatttgaattatcctgatgattaatgatgttgagcattttttcatatacttgctgccaattagtatgtcttttgagaaatgtctattcagattctatgtccattttttaattgaattatttgttttgttttgttttgttttgctgttgggttatttgcattccctgtatattctggatattaattccttgtcaggtgaatagttcacaaatattttctcccattctacatcttgtctcttctctctgttgattgcttcctttactgtccagaagctttttagctttgtatagtcccatttgtctgtttttggttttgttgcctgtgttttcatatccttatccctaaaatatttgcctaggggagtctcagagcctactctggctcaggatctgcccaattttattaaatttattataaaatttaaaaaattttaaaaattaaaattaaaataaaaaataaaacatttgccttgatcaatgacttgaagcatttacactatattttcttcggttgttttatagttttgagtcttacatttaagtctataatccagttcgagttgatttttgtatatggtgagagagagggctctagtcttagtctaccacatatgattaccacttttcctcggaccatgtactgaagaggatatcctttcctcagtgtatgttcttggcacctttgttgaaaatctgttgaatgtaaatgtgtgggtttagttctgggttatctattctgtttcattggtctatgcatctgtttttatgccaataccatgctgttttggttactatagctctgtagtatgatttgaagttaggaagtgtggtgtctctactaaaaatacaaaaattagccgggcatggtggtgcatgcctgtaatcccagctactagggaggctaagggaggagaatcactttaatctgggaggtggaggttgcagtgaactgagatcacaccattgcactccagcctaggtgacaagagtgagactccctctcaaaaaaaaaaaaaaaagatttagtgttagttcttatggtagaattcagcagtaaaaccatccaattctgggctttttttattactgattcaatctcattacatattattggtctattcaggttttctatcttggtaggttatgtgtgtccaggaatttatccatttcctctatgttttccaatttgttggcatatagttgttcataagagtctttaatgatcttttgtatttctgtggtacagttgtaatgtctcctttttcatttctgattttatttatttgggtcttctctttttttcttaatctagctaaagatttgtctattttgtttttcctcaaaaaattttgttttgttgatcttttataattttgcctcaatttcatttatttctgctctgatctttattatttctttctttctactaattttggatttagtttgttcttgcttttctggttccttgaggtgcattcttagattgtttatttgaaatctttctgcttgtttgatataggtgtttatggctataaacttcccttcttaacactgtgtttgctttatttcattgattttgatatattatgcttccattttcattattttcaagacattttttgctttccttctcaatttcatcattgactcactggtcattcaggagcatgttgtttaatttccatgtatttgtacagttttccaaagttcctcttgttactgatttctagttttattccattgtggtctaagaacatacctggtatgatttcaatttttaagaatttgttgaaatttgttttgtgccctaacatatggtctattctggagaatgtgccatgtgctgatgagaagaagaatgtgtattctgtagctgttggataaaatgttgtgtaaatatctgcgaggtccatttggtccaaagtgcagtataaatccaatgtttctttgttaattttctgtctagatgatccgtctaatgctgagggtagagtgttaaagtcctgaacattgttgtattggagtctatctgtttacatctaatgatatttgctttatatatccaggtgcactgatgttgggtgcgtatatatttacaattgttatatcctcttgctgaattgatctatttatcattatataatgaccttctttgcctctttttatgttttctgacttaaagtctatttcatgtgatataagcatagctattcctgcacacttttggtttctatttgtttgaaatattattttccatctcttcattttctgtgtctttttttttttttttttttttgagacagcgtctcactctgtcaccaggctggagtgcagtggcacgatctcagctcactgcaacctccgcctcccgggttcaagcgattctcctgcctcagcctcccaagtagctgggactacaaggtgcacgctatcatgcccagctaatgtttgtattttttatagagacggggtttccccatgttggccaggatggtctcgatttcttgacttcgtgatccgcccgccttggcctcccaaagtgctgggattacaggcatgagccactgcgcctggccctatctatgtgtatctttacaggtgaagtgagtttcttgtaggcagcctatagttgggtcttgttttttatccatttagtcagtccatacagtccatatcttttaactggggaatttaaactgtttacattcaagattgttattgataggtgttattttgttcatcataagggtgccagcagtggctccagtgggtcccaggcaggctgatcctcaggctcccaggaagtgtgcatgggcactggcagtagcagtggtaagcctcaagtgagtcagacctcaggtcctttggcagtgcacatgggtacttgtagtagtggcagcctgaatgggccagtccttgggtccgcagatggcaatgcaggcacaaagcggctctgccactagagggggcaagatcatgttcatggcagcaggctcaggaaggcagctctcaggctctggggagtgtgctttagtgccttatgtcctggggcagcctctcttgatgtgctggactccctgttacctggggtgtagagtgctgtgtgtaggctcgggtgccagtggcctggctctatcactggatccacctggtgttggaatgctgcagccctctacgggaacgtgtggggatgtcagcaaggccccagggatgtggagatgcaggggcaattggccccagggcaagatgtagtatggtagtagctctgttcctaaaatgatgccatgctatagcagctcgggtcctggggtttgttgcaggaggacctagtatgaacttcctctctggaacaatgttatactatactagtatactatactatacagcgtttactaggctcagggcatgtgagggctgaggggctctcctgtaggtgggacttcaggcatctgtgatgggaatgtgtactgctgaggatcttccacttacattttcctcaaaatagggagtccctctgggctctgtgctgatcctggccagctgctcttcttccctctctatgctttcatctctagttttcaggtctcagagagttttgtcacttccttgctaaattccagtgttctccctttgacactctatttgtcatgttatctgcttactgtcttggtacttctggtaggaggtgagtactgggcatctctagtcatccatcttgatgatgtctcccccagagttatttccaaattctccatccatgttctaactaatgacttgcgaactttcttcagctaatctattccattgagtcagttggcccagaatttagctgtataacaacctttaaatcaatgactggtttttctttcctcaggctggaaagaaaccttcaaatccagccttctggtggatcaacagaaatggagaagagatgcgatggagttttgaggaactgggatctctgtccagaaaatttgccaatatactttcagaagcctgttccctacaaagaggagatcgggtaattctgattctgcccagggtcccagagtggtggcttgcaaatgtggcctgtctgcgaacaggttagtaatgtttgctttccgatcatatttattactaagctggaggggagattttccagaacacctaagtaatcatgatacatttattttgttgtgggcttattgtcaaagagtgcctttaaattatataaaagttaggccgtggtaggctaattccttatccctaggtggaacatctttaaaagataatcttagagttacagcctcacaaaaattgttgtgttgccctgattagaaagaaaagatattctaaagaacctgtgttctggtcctggttgttggtttcttgaagaaccctgatggagaggcctggtccttcccaaagtgaaaggatgagccagtgtcaagagtccaggaatgccagacatgtgttccccaatcttcttgcctactgtgtcgcctgggaagagtaaaacctattgtgaagtgaatgctttccatccctgtcttaagggtctgggacttaagggtggtggggcccaggaggaagatctatatatttttgagagtccatttatcctttgagaaaataatacccaaagcttactgagcactgttctaagttctttacatattttaactcatttaatcccctaattatcctataaaagaagtagtattattacaatatcactttacagatgcagaacctgaagctcacagaggtgaagtggcttgtcccaagtcccagctataagagtgtctggctccaggacactcttaatcattatacttcatcttacagtgtaatatataaccagcaggaatagaaccacagaaaagatgaatgcctccacacttccttttggaaataaatcataaagcaatcatgtacattttaagaggcactcagctgatgtggtgaagtgtacagttctggagtcaggctacagggttcaatccctgcactgtcacttactacttaagtgataccttgggcaagttattcatagcttttatgttttggggtttttttggtggggactgaataagttaaaacatataatcaaatactcaataaatattggttaatattacttttcaatcaaaaccttcttcaagctcaatgttagggatggtcttcaaataaagaataattatccagtatttaacatgctttcatgttaagccaaaagggtcatagactctgaaatcccttgaaaggcaaaagcagataagtgaaagcaagataaatagatatcttcctggtaaactgactaactcactctgagaaatacagaatgtatagatggtatctacactactctaacataatgaagaataacatttcttctaaacactgtttcttttctgcccctttagggacagttttaattccaggaaccactcagctgacccagaaagacattctctacagactacaatcttcaaaagcaaactgcattatcaccaatgatgttttagccccagcagtagacgctgttgcatccaaatgtgaaaatctgcactccaagctgattgtatcagagaactccagagaggggtgggggaacctcaaggagttgatgaagtgagtagccacacttgttgtaaaacagcttcccaaaaggaaaggcaacaataaaaagatattaaacccagcagtgattagaaaaatgcaaattaaaacaacaggcaaagggaacagttggtagttattgctgcactaatagtgctaaactctgaagtaggaaggagcttggagtgctttttgtaggttgggatcccctgagattggagattggtgtataggaagtttattaaggagttcttttgggattaacacctgtgaggaatgagtaagaatgtcggactgggcagagaaagaaatttatttgcgatgtattccctacaaagctttcagtcaacccactgggacctctgaaggacctcctcaaagctgttcccagctaaagcaagaggtcctggcctttatatacccacattgatcagtaattggatggggttgtccctaggagtcaagacctttaacaaagccactgtcttcagtcaaggcaatctctagagagtgctcccagcacctgtcactgaaggatcacagtcagtccttcagtgttggctatcccattcccttgctgacagcaacactggtatcaggttaaaagaaaaaatgcttaatgttaatggatgcaattataaaagtgaatttcactgatgttgaagcctagcatggggtgtttccatgggttacttggaactcttgccaggtactggttatgccttagaattgggctggcagcaaagtccttctctagaatgagcttcctacctttactcaaggatttgggagcatgcttgcaactatggacttttcctaccacatttaaaattcctaatattgagttcttgccaaaggccaagtacggttctaataaaaataatgttataattgcaatcatagcttatattgatacggttatgtgccagaaactattctaaggacttcagatatattacctcatttaaacctcacagcaacctaggtactataattacacagctgaataaggtcaaatgctagtatctggcagagctaagtttcaaacccaggcagtatgggtgctgagcctacactcctcacttctgtatgtactgcctctagtaagagatcagtacaacaacccttcctcaggttttgagggcaaccgtattggtgatggaagtgataggaacacagctatagatacttttttttttttagacggagtctcactctgtcacccaggctggagtgtagtggcgcaatctcggctcactgcaacctccacctcccgagttcaagcgattctcctgcctcagccttccaagtagttgggattacaggcacatgccactatgcccacctaatctttttgtatttttagcagatatggggtttcgtcatgttagccaggatggtctcaatctcctgacttcatgatctgcccgtctcagcctcccaaagtgctgggattacaggcgtgagccactgcgcccggcctatagatagtatttttaattaattaagataattatgaaatcatagactgaacacttggtgtagctttgtcagattttgaaaacagctttttagccaggcgcagtggctgatgcctataaatcatcactttaggaggctgaggtgggatgatggtttgagtccaggagttcaagaccagcttgggaaacacagtgaaacctcttctctatataaataaaaataattagccaggcatggtgatgcatacctgtagtcccagcctactcgggaggctgaggtaggaagatcgcttgaacccaggaggtcatggctgcaatgagccatgactgagccactgcactccagcctgggtgagagagagagaaaccctgtctcaaaaaaaaaaaaaagaaaagaaaagaaaagaaagaaaagaaaatagcttttctatatttctcatgaatggcctggttgtttctactcattctcaaccccacatgcctggataagtctgtgtgcatcttagacacttgatatgtatgtgtgcagctgccctaatgtgtgacttgtatagaagtctgattatcctttggaactaaaaggttttctttctctttaactggaactctttcttccctggatggatgcttagatcctgttcaatcttattgtctgctatatccagaactatgtagactctcttgtgggaaacagaaaagccaacctttcacggtcagcaaacttttttttttttttttttgagacagagtctttctctgtcacccaggctggagtacggtggctcgatcttggctcactgcaacctccacctccctggttcaagcgattctcagcctcctgagtagctgggattacaggtatgtgccactgtgcctggctaatttttgtattttcagtagagacagagtttcgccatgttggccaggctggtctcgaactcctgacctcaggtgattcacccgcttcagcttcccaaagtgctgggattacaggcgtgagccaccatgcccagcctcagcaaacattttctgtaaaagggacagagaataaatacttaaggcttgcaggccgtatagtcagtctcatcacaactactcaactctgccactgtagtgtgaaagcaaccacaggtactacctcaatgaatgggcaataacattttatttacagaaacaagaggcaagtcagattttgccagtaggctgtagtgtgttggcccatcagtacccatggcttttactaacatgtattgtattaacatactcatttttaaaaaatcacattttaaagcatccataggggagggaaggggaaaattcttccttatccatgattgcaagatcacacagactccttactctgctggaggtatgataaaaatctcaagttttaaaaatgcttcaatccttctttatcatagaataaaaagctaggaaagcagctattataaatgggcctttgatgacaaagtttagttttgattctagaaagcacctaaaaggatagagaaagtgatggcttttaccctgtaattcaagctaagccactggcacctgattcatgacatgaagaggttcaagtggagagcttctcaaaatttttcagtggtaacagtctgtgatgctgtgtttaacatgcagtcattgtagtttttcctttgcagacatgccagtgacagccacacctgtgtgaagacaaaacacaatgagatcatggccatattctttaccagtggaacaagtggatatccgaaaatgactgcacacacccacagcagttttggtttaggattatctgtaaatggaaggtatactttcacaaaagtgcagcttgaagtgtcaaaactgcaaagatgatgacttatgtactggtcttttatatttattttcctatgtacatcagggctactctttgttttcccaggttctggctagatttgacaccctcagatgtgatgtggaatacctcagatacgggctgggcaaagtctgcatggagtagtgttttttctccgtggatccagggagcatgtgtattcacacaccatttaccccgttttgagccgacttctatcttgcaagtaagccaaagcacaaagaggtcaatatttagaaatgcattaagcagtatggctgacagaactggtgaataaagcaacttgcagagatcagagtagacaatatgatttaagatatgtcacatccagaaagtcaataagcctgaaaagatacactcggccccctctgtatccacaggttctgcagcctctgattctgccaggcacatattgaaaatatttggggagaaaaaccaaaaacaaaatacaacaattaaaaaaatgcaaataaaaaataccatgtaacaaatatatacatagcatttacattgttttaggcagtataaataatctagagatgatttaaagtatacgggaggatatgcataggttatatgcaaataccatacaattttatataagggacttaagcattcctggaaccaatcctgcagacactgagggatgattctacaagaaaaggtaagaatgtatttacattaacataaacaatgtttaaattgtgctgcgtcaaccaaagacatttaagcacttatttaagttgtagtaagaccaagagtttgctttttctaaattgcagacactctccaagtaccccatcacagtcttctgttcagcaccaactgtataccgaatgcttgtacagaatgatataaccaggtaagaaatgttagtaaataggcatctagtggggagaggggagaagaggaagctataaaataaaagatctttctgcctgaaacatagctccaagccagtagacacaggatttagcaatctctcctcttcctctttctccttcttgcctgcattctgtaaatgataattactgtgaccagggcaagatcccccaaacaagaagaaagtgagggttcagctatgtttatagctctaagcccagtggttatgggtaagaagatggtaaatcttttggatgatggctttctctgagctgagaaagtagagaacttgtttctatttggaaccttatcccagcagatagaaaagaggatgcatatcttttattctattgctgattccatttgaaagggttcattggtaatccaaaaagaaaaacaacccccgtttctctttgttttgtttttgtttttgttttgttttgttttgtttcaatagggttttgggaaacaggtggtgtttggttacatgaataagttctttagtggtgacttctgagattttggtgctcccatcacccaagcagtatacactgtactcaatgtatagtcttttatccctcacccacctcccaccctttccccagagtccccaaagtccattatatcattcttacgctattgcatcctcataactcaactcccagcaaccactattttactatattcacaacactcaatactctgggtctccagatgtaagggatcttttcccccacattgaccaattctccaacatcagttgagtatcctatgatttaattcagtctgacattatctccgtggaggcagcatcatatcccacaggttaatgactcagtcccacaagactctttcccatctcaaatgctaatcacaagtccaggctgtcacctgcgcatatgaccaaatggctacaaatcagaggttcccatgacccttccttgggtttagtaatttgctatgatggctcacagagtgcaagaaaacacttacttacatttcccagcttattataaaagatatgataaaagttacagatgaatagctagccagatgaagaggtacatagggtgaggtccacaaggtcccaagtgcagcagcttctatccctgtggagtgggggtgcactacctttccggcacgtggtgctctccaaacctcatacttcagggatttttttggaggctccattatgtaggcatgattgattattaagtcaatctccagctcctctcctttccctgaaggatggaggtgaggctgaaagtgccaagcttctgttcctggcttagtctttcttgtgaccaacccctatacgggagccccattgagagtcgcctcatgagaacaaaagacaattctattacccaggaaattccatggaatttagaagctctgtatcagaaactagagtcaaaggcaaaatattagaacaaaagatactcctagcacacccatcacttgggaaattacaaaggttttagaagctctgggccaggaacccaggatgaagactcagtacaggttgagtatcccttatccaaaatgcttgagaccagaagtcttttggatttcagattgttttggattttggaatatttgcattatactggttgggctgccctaatccaaaaacatgaaacctgaaatcctccaatgagcatttcctttgagcatcatgttggtactaaaaaagtttcagattttggagcactttggattttgaattttcagattaaggatactcaacatctatgtatttcttgttatagctcatatcacaggtaaatatatttaaactgatgttatttaattatcgaataggaaataattcacctgccataaaattcaaaaggtatataaaaatacatagtgaaaagtcttgcttcaaaccttgtccccagtgacccagtcctcttccatggaggcaaactgagtttccagtttcttgtctattctccctgaaaatacacaaactgatacacatgtgttctccccgtctcaatttttttttttttgagacggagtcttgctctgttgcccaggctggagtgcagtggcacaatctcggctcactgcaacctccgcctcctgttcaagcaattctcctgcctcagcctcctgagcatgtaggattacaggtgtgcaccaccatgcctggctactttttgtatttttagtggagatggggttctgccacgttggccaggcaggtctcgaactcctgatgtcaggtgatccgcccacctctaactcccaaagtgctgggattacaggtgtaagccaccacacctggcctttccttctctattataaacataaatggtatcacaagattcacacagttctgcaccttgcttttttcctctaacaatacattctggcactgtgttgtgcaatatggtagccactaaccacagctagttatttcaatataaatattaagtaaaattaaaaattcaattcctcagttatactagtcctgtttctagtgttcaatatccatatagggctagcatatactgtagtgggtacagcagattacagagtacttccatataacagaaagttctactgggcagcactgtccaagagcttcctcatttttcatagctgtatagtattccattgtataaatatcccaccatcagttttaccaaacaattggtacttttcattgctgatttaaagtgttattatggtgctcacttcagcagtacatacactaaaattggaatgatacagagcagattagcatggcccctgcacaaggatgacatgcaaatttttgaagcattccatgaaaacataaaaataaaaacaaaataaaataaaatgttattatggggtaccttccctaagaacagaatgaccttctttgtaataaattatacctccaccacaaaaaggggggtaaagaaaaactagtatttggggtattctagtatcattctatgatattagaatgatttatctttttaatatctttatttttaatttgtgtaggtacttagtagttgtatatgtttatggggtaaaatggtttgttttgtgctagggagaggaattaaaaagcgactaaaacattttatattgaagttcataagaaataatccttaatcttcacttctctccatttttcctcctaaatctaacttatctggttttctgagaagctataagtttaaaagcttaaagcactgtgtgagtgctggggaaccaattacccctgacgtgactgaaaaatggagaaacaagacgggcctggatatctacgaaggatatggacagactgaaacggtacctgacctcactgaaaagacatagctggattccatttagtcagatgaataaaaaccaaagtgtccacagtctccttatgattatttgagggataggagttgagtggttagaaaatgtttaaaaaaacaatgcttgcaagaacctaattgcaaaaaagctctgttaacagatagttgtttaaatagccattcattgacaaacaccactgttaatggatcagagtaagggcattacaatatttttttaaatgaaataatactggatctactgaaagaaagaattcctcccagtgtgatagggaagtatcttatttagggctgcctcaaaatggaaaatgctgagatccttgctgcctgaaatattaagagtttgctggacaactccttagcaaccatactctaaaaaggattttttaaagagctcatagagataaggaataagaaattctagaggaaatgaatgaaataagaacaaaaaatgaaataagaacaaaaaatgaaataagaaaaaagaacaacagtggttattttgtagaagagggaggagtaagatgaaatagataagggaaaagttgaaaaaacttttcacaatgtgtctttataatgcttcaatttatgaaccatgagaatgtatcacctggtaaaaaatgaaaatatcaaaaataaaaatcaaaaattgaaaaattcattaactagaaatagcataacaagtatgctaatataaatgcaaatgttaatatactcatgttttgataaatacggatatatgagtaattattgttataactatattttatacatatgcatgtatttatatgttatcactacattccatgagagtatagcattcattttgagcctagttcatagtaagttttcaataaataatttgttgaatgaatgcatgatagatgaataaattttaagtgacttgtaatgttatcttactttttcttcttcttaactaggtgctaatctgtggaaattttaagggaatgaaaattaaacctggctcaatgggaaaaccttctcctgctttcgatgttaaggtttgcacatccccttccaggagaatgtttaacaacccaatctgtacactacctacctaccgcttacccccatataaactttctttgttatgatggtgattccattttacttccatgatactttaatttttataaatatgtgaaaatgattagaaatgttagcttcttggtctccattattttgcaaatacccatattgtaccatacagttctaagcatttaataaacgttaacccattaggctggatgcagtggctcacgcctgtaatcccaacactttgggaggccaaggcgggagcatcacttgagcccaggagttcaagaccagcctgggcaacaacgtgagactttgtctctacaaaaaaatataaaaaactagccaggcatggtggtacgtgcctgtggtcccagctactcagaaggctgagatgggaggattgcttgagcctgggagcttggggctgcagtgagccatgatcacaccactgcactctaacctgggccacagagcaagaccctgtctctaaataaataaatattaacccattgaatttccagaagaaaccctatgagaagcatactaatattagaaccattttacaaacaaggcacaaagaggtaaaagaactcaccagaagtcacacagctaatagctgctagagttgggattcaatcccaagcagtctggctccaatatctgcactcttaaccacaacacaacactggtcctctcaggcaagggaggtcaagaccttctgagcgggtcaactaggcccgaagaggcttcagtttacagtggctgcagcactttccctctctgctcccaagcctgcctggccatttccagcctctctgtatccactgccactactaccacctgatgcctagggggaattccagttccccatcagcaagctttatatagggttaaaattgttctcagatcaaccgagcttcaaagctgggtgtagccaaaggaacttaacactaatttggacactcctcaacttatgatagggttatgtcccaaaataataagtcatcataagttgaaaacatcctaagtcacaaatgcatggctgactgggagctgtgacttactgttgctgcccagcatctagagagaaagatggtttcaactgaatggttatctttttcacccattgtaaagttgggaaatagtaagttcgaaccattttaattcagagacccatctgtacgttaagagacagcaaaagcagcaaaaatatggatgaattaacagagtacagctcttagataaatgtttcccaagcttgtttgatcataaacatcatatggatatctgttaaaaatactaattctcaggcccctggagagaccaattcaatagatttggagtggaactctgaaatttgaaatcttgtgattttaacaagcaccccccaagtagtttttaggatcaaataagtttgagagagtttagatgagcttgattgctgctgtaactctttatagaataaaccagatcctgggtcctttctctcactttaaccttgctgtggaaacctggtctcaagataggatagcctagtggttcaactatatctctgctattcactgtctgagtgtctgtgggtacactgttaaagctctgtaagttccagtttcctaatttgtaaagttgggactagagtgaccaacctgtctgtttgcctgggacttatctggttttagcacttaaggcaatacatcctgaagaaccaccccccgacaacccctcaccacttcagtctcagatggttggtaaaccaaataataacagaactgatttcataggtttcttgtggtgattaaaggagacaatatgtttaaagagcatatcagaatgcttagtacataataaaggtccaaaagatgggtactgttatttacttctccctcacattcctctttttatttatttatttatttttttattttttcacattcctctttgaaaagcttatctaagaaaaaatggtaggagagcccaaacaggcttaacaatagtttgttggttaacaggctaccttaggttgaagaaagaaatattgataattaagcacactcatgtctgcattacagggaagttgatatgtaacacagctatgttctttttcttccttccttaatagcaattcccaacatgcatggctatcagggtcttacaggcacagctgtattcacagtgatcccaactgcaaggtacccccacctgctccccattaatttgagcccagtggttttctagagcagctatctttgaatgcaaatatgatgaggctgagaggaaaacagtactttttctgcatccccagtcatttttaactcttttccacgggccgttattatggggcttcttgttccttagctaagggcatctgcagtaacattctggcatctggggatgtgttccaaccaggtgaatatcagattcctacaacttcaaagcccaacctttataatcttctttgtttgcttttaaatactcataattttcatgtttaaacattttaagaccctatgaacaatgaggaacatgattctccccagacacagaagattttatctatattcccatctattaaaatctgtaagtaactggaacttttaaaatacttcctttccatcaataattccttcatacctggaaccacatatttctttagataactgggtgggaatttatatttttttatttgcaagagcttaaagagaagtttttacgcttagaattcctttgccatttaagtttctcattcagcacataagcccctttccttttggaaagtgctagataagtattatacttattctccatgcaggccacacctcaggtttgaaggtatctggagaatatatataaaagcagaattttgatacttagaaacagctaaaagtcatttagagcaaaatctgatgtataaaatcagcaatcaacttgagaaatgctaatctgatttttttaattggattaaactctctagaggcattgcacagaggagtgtaatgattaaaagcatatgatctggagtgtaagtggtgagatttggattccagctcaatcatgcacagtgttaaactctctacacctcagtttcctcatgtgtcaaatgggcataaaaattctaaccacatagggctacagtgaggaataggtacatgtcaagtacttaaaggtttagcattaattacttagcatgtattaagtacttaataaatgctagctactggtagacacttcagggaatgatgaggattggagagagggtaagagagcaaggctgtggcttacttaccattgtcaaccagagaatattccccttttcctgtttactcatattgggcttctgaagtaaggttctgtaggttccacagctaaacaaagtttgaaaaccagtaatgaagatatttatttatcaagaggaaaagataatcaagacctattgctaaatgataaaagcaggttggcaaaactgtatattataaagcaactctatttttctttttttttttttttttttgagatggagtttcactcattgcccaggctggagtgatctcggctcactgcaacctccccatcccgggttcaagcaattctcctgctcaacctcccaagtggctgggattacaggtgcccaccaccatgcctggctaatttttctatttttagtagagatggggtttcaccatgttgctcaggctggtcttgaactcctgacctcaggcgatccacccgcctcggcctcccaaagtgctaggattacaggcatgagccactgcgcccagccagcaatcctatttttcgatttatctatattgtctcaaaggatattaccaaaatgtgattattgctggatggtaaaatttttaaaaaattttatcctgcgttcacatgttggtaacctgtatttaatattttatgcaataagaatttaagtaaatatatttctcttaggaatttaaagtatatttaaaatatttttgggccaggtgcagtggctcatgcctataatcccagcactttgggaggccaaggctggaatatcactggaagccaggaaccagcctgggcaacataatgagtccctcatccctacaaaaaataaaaataaacattagctgagcataatgacatgtgcttgtagccccagatacttgggaagctgaggtgtgaggactgtttgagaccagaagtttgacgctgcagtgagctatgagctatgattgcaccactgcactccagcctgggtgacaaagtgagaccttgtctcacacacacaaaattttttttaagtcttcatttttaaatggcaaaagccaaaataaaacttgcaaagttaatatttaagctgcgacattaaacaaaaatttccttaaataaattgttctattttatcctagattgtagatgtaaatggcaatgttctacctcctggacaagaaggagatattggcattcaagttctacccaaccgaccatttggcctttttactcattacgtagtaagtgacttactaaataatctcattttctatttatttctcaagtgcttggtaacaatccctgtttgccacaaaacatacctaggataggtacttgaccctttcttgagagattggttgtcctgaatagtaatccaaaagacaagaaattgaagaaatacccaaattcttgctgaagaaaagcatgctggtcccctgaggccagatcactgttccaggtccacgaaggcaagaggaagggaccctagaaagaggacagcctcttaacatcccctgatcctctcaattatcaaacaaaacccactcattttcctgaaatccagttagtgctctttcttttcgggaagagtgagagggacaggggatgcgggggtggtgggattaagcaaatgtctttcacaagaggctttctaagctccttactgtttacaacaatattttcatctctaatcacagtatacaaattagagcaaagtctctatcatataataaaagatccagatgctacttgccagtgtatttgatataatgtaacagtatcttgttttttcttatgtcagacttgcagaaccaattctattattgtgtaaaacaaaacaaagcacaaaaacaaaacaaacctgtctgctctttattaggtgtcagtgctttcttttgactcttgagtatttacttctctcttttcctaccagcattatctattaatcaattagcaaaagacttaatttagtttactcctctgagctactgcaatatttattttgtaatctatctaagaaaaatctcaagatggaaacatgactaatctttgtaactgtagtttacctttcttctgtcgggctagctccatgctggaatttcatctttattttcacaatctatctcttcctaactctaatgcttctcaaaggagccaaacttttctgcttccttgaacatttaaaaatccaattgagggccaggagcggtggcttatgcctgtaatctcagcactttgggaggccaaggtgggcggatcacttgaggtaaggagctcgacaccagcctggccaacatggggaaactccatctcaaccaaaaaatacaaaaattagccgggtgtggtggtgcacgtctatagtcccagctatttggaaggctgaggcaggagaatcgcttgaacctgggaggcagaggttgcagtaagccaagatcgtactactgcactccagcctgggtaacagagtgagactgtctcggaaaaaaaaaaaaaaattccaattgaccagaagagttggattcaccataacaacaaaatgctatttgttttgcaggataatccttcaaaaacagcttcaactctacgaggcaatttctatatcactggggacagaggatatatggataaagatgggtatttctggtttgttgcaagagcagatgatgtcatattatcctctgggtaactttcttttccatatgtgcatatgtctgtgttaactgatcatcagtgttctagagtgaacctgccactcacctgtatgtattcctgccatatgtgtttctagctatcgaattggaccatttgaggtagaaaatgccctgaatgaacacccttcagttgcagagtcagctgttgtcagcagcccagaccccatcagaggagaggtaaaagaactgattcatgtcaactttataatttgttggcaatttaacacatacttacaaacagtagctcagtgaaacagaattaaccaaatgattcatttactaaatatgcaagtcagatagaaatatgctagtcagaaagaactgctacaaaataagattgaattatgagttgcagctctgatcctaacagacaaacaaaataaggctgaaaatacgtactagaaagaatttgaattccttccgtggtggactagggcaaagatggtgtgaatgccagtaacccaggctcacgtcaggatggggtgacagaagtcagctggatgggatcaaattgttacccagaaggtctggaaaccaacgaggtccctggtgtagtgaaggagaatgggctggcatcagatgtcagaagtgggaaccagaggctggaactgaggtaaccataagcagtcttggtaggtaaataagtagagatttcaggaaataaactctgaataacacaggtgtcctgaaagcccattcctattggggctgaccacacagtattttggcttaaaagtaccatgccaggcagcctcctgcgttttgcctgtgtgtctacaacatgcccctagggtttctctagctgagttacaagttctcacaagtatttcttcaagccatatcccttctaacactgaatccaagttttgaagatgacactgatgtcaatacaaatccagaactttctgtaccatgtattcaagctccttatctcaaatcctaggtatagggcttcaagcacagggcacagggcagagttagaaggtatccaatctcaggggatgaaataggtcctgaagtttaaggcaggccaggcacagtggctcacacctgtaatcctagcactttgggaggctgaggtgggtggatcacctgaggtcaggagtttgagacaagcctggtcaacatggtgaaaccctgtctccactaaaaatacaaaaattagccaggcatggtggcacacgcctgtaatccctgctacttgggaatctgaggcagaagaatcacttggacccgggacggggaggttacagtgagccaagatcgtgccactgtgctccagcctggctaacagaacaagactccgcctcaaaaaaataaaaataaaaataaaaaagtttaaggtaaaaataggagatgtgcatgttacagtggagggtggatctccccccaggactgattcccctaactgatctttgatgccagaagataccctgttaagtcctcctggatggcccaaagttgttccagatatagcccagtggctgggaattggtagtttgtcaagttgctaggatgacaatcgctatttactgtgaaagggtatattccaggcagctgagggcagggaaaacagtcagtgattattggcttgtctctttgctctgaacatcatcggcaaggtttcacgagtcttagctcttcctgtacttctcccctaccattagtcatcatcagttttacccacctagacaggtgcttactagggacaggatggtagctgagcctttcggaacagggttagcttggcagccacctgatatcctagcgtacaatataggaaaggtctataagtgggttgtggtcccctcacagctccgggggcttggcatagggcttggattagtcagagtgagggggaaagtgtggccagttttccaacagtggtaggctgcagcatttcctagtagaagatgtgagtgggtatctcaaacgaggtatccatgaacaaaacggccatgtgctccatgcctccctttctgctgccaggcctattctacctgggttaggtccttctctaggctgggtcctgccaggcagggtaattgggtagcaagttccagaattgattaaaaagaatatttggatttgaaataccattttaacattggaatgtgaaagacttgtggaatatgtgtctagatcactaggttcttaaatttttgggatcacatatctctttgagaatgtgaagaaaaccataggccactgttaagacttatgcagtgatggaaatgttctatatttgcaccatccaatgcgatagccatgcatggctatcaatcacttgaaatgtggctagtgtgactgagagtatttaatcttatttaattttaattgatttaaattgaaatagacacacgtggctagcagctatcatattgaatggcacagccatagacttttctcagaaaaatacaagattttgcatagaatttcatagagatttgaagcccacttatggattctgggttaaaaaataagacccaaacttcttgtaattctaagactacaactaagagctaatgtttttgatgacttactatgtgccaggcattatacatctatgctaattcatttaatcatcataatctcttttacagagaaggaaactgaggcacaaagagattacctaacttgtccaacattacacaacaaactgtgacttgaacccagctgttctgacttcagagttcatactcttacccatgttaggttgttccttgttaatttaacattttctgcagtagtttaaaaagataaaagagactatccaagttgtagaaatcgtcaatatgtgaaccagtattgcagtttttaaaataatttacctttgaatgactcacttacaacaagcataattttttaatttgtaaaaatgttaatgcagcagagctagcataactacaaatgcattttataaaatgtcaaaaagtgaatggaacaaaattatatccatagacacacacacacacaagggttcacaactgccgcatggcacatgtaaattaaaaatgttcaagtgttgttgttgttttttttcttagagacaaagtctcactatgttgcccagtctgctctcgaactcctgggctcaagcaatcctcccacctcggcctcccaaatgttggcagtacaggcgtgacccactgtgcctggccacaagggttttgggtaaagacaaaaatgggtaattgttcatacaatgtaaaactgcccactggtgaacagttttcaatatgtgaaaaaattataacttcaagtctttgtttctcaccaaatggctgtcctggtaatttgttgtttcaaataattccttttcaatgaaatctttactcccagatcaaagtggataggaaatgttgccagcttatctttaagctggacaaacgaatccttgaatttaataagatttcaggcacctaagtgcaggatacttaatcataaaaaagcttcaggggactctcctggaactgtgcctacagggaagcatcattccatagccagctccgggctggtaatctggcgttggaggtacatactagttgatgcacctagactcatgcctctagggaaggcagtaaatggcagtcctggtagtgccctaggagagaaaatgacaggactccaaatttacttttaaagggggctatgagggatggcctatctttctgtcttctccattacaggtccaaaaactaggcagagttttcaaaaacatttctaggaaggataaaatttggagaagaggatttgtaagcataaagtaataacatctttcttggcttctgccagttaaaggccaccatgatttccactcttgttcctcagggccatggaaatggatcagagcaacaaaaaaatagctgctggaatcttcacagccttgtataaagactgcatgttctctgtgaactgttcccttcaacaaagacatggcaaactcagcgtgactactgtttataagtaatcccccatgctgagggctaggctggatgaggctgggttgttacaggggtcccagaagctctcctgtattaggtacagaccaggaagtggctggcttaagagcacagagctgggatcaaactttattaaaacacactggcccaccccaccaggcatgtagattctcagagcaagcaaacaagacatactaaaacatacaaatgcataactcattttcctggtgtttcaaatatttattttaggtagtaaaggcttttgtcgttctaaatcctgattacaagtcacatgatcaagaacaactaataaaggagattcaggagcatgttaaaaaaactacagcaccttacaaatatcccagaaaggtaggcatcctaattataacgaatatttgctcagtgttgtggacaatttcaagtgtttatttttacattttaatgaatattttcttcacacatgctgcaccacatgtcccaaactgaactgatgacatatgggtaagaatcagaatctttgagattaaaatgaaaccctgaacctattttgtttggtcctttggcttactggactcacagtaaatacttaatatcaagacaactttcctaacaatacccttttccctattttggctgttacccaaaacccattccaaagactattctaattcttccacctagaattcataatcaaactgctatataattggctttatgtaaagataaaaatttccaggctaattttcttccccttgatgccaacaggtagaatttattcaagagctgccaaagactatcagtgggaagacaaaaagaaatgaactgaggaagaaagaatggaagacaatttaaagttgtttcattaattaccatatctataaaacaaacatagtatctgtcaatctctagaaaccacaagatgatggagaggtcataaaaactgtggtagtatgcttagaaactgttgatttaaaatatcttgtggttatgatatcagaggctaaattttgaaataaaatatttggcaaattcctcc

SEQ ID NO: 36818 - DNA, 46926 bp, Homo sapiens
gcgccgagcgggagccgcgcgggagcagcgcagctacggcggcggcagcggcggcgcggttgcgattccgagccgttgagacgcctctgcggcagctggtggcgcaggtggcttgcgtggacgcgggtagaggcgaccggccagcaaccgcagcgtcggcgcccgcggccccggcaggtgagcgggcgacggggactcgccccgcccccccctcggtggcgtcgctcctggctgtagcggggaagtggacgcggcccgcccgggagccgagggggccgaggctgcagccgctgggcagcaggttgcgggggaggccttgcgtgggcggaagggggccgctcgcttctcggaatccctgcctttttctctcccatgcaccccctcccttttggggcttaagctcggtggaaaaagcccggagaaagatggggcgggcagacgggcgatttctggccgggcagcatccctgcttcaggtggtggcgtctcttcggtggcggggtggaggacctgctccagcgcggaggcagcgcactggcgggggaggagcgggaggcggccgtcccctcgctctcccacccccacccgccggttcccctccccctccccttgcggcccctcccttcggggttcttcgctttaaccgccctcggtgctctccctagcaggcgcgtcgggacgccccgaggcatcctcccccgcccgcgggcccggtagctgggcccgcgtccgccgcccgcatccccgcgccgccgcatctcctcgccgcctcccgggcttcggacccccggtctcgcccccgaaacatgactcgcgatttcaaacctggagacctcatcttcgccaagatgaaaggttatccccattggccagctcgagtaagtgatttgtagccctcgcgcttagcagtgctaccctcctctccagaggcctgctgcccaccgtgtctctttattttttcttctgtcctttctctccctcgctttagtctcatttgtaacctgacctttcattttagttttttgcccaataatctcccgtgtaattatgaaaatccagacgtttctacatacctgtgtatttccctatggtttattggcagacttggacagattttcttcctaggaaatatttaaatgcgttgctagttaatattccattgtaggtgaaataatgaagagtgaatttttgtttaaaaattagtgaaacattgacatttccatagttttggatcaagtacaaaatatcaatggaatttgtgcagattacacacaaacacttggatgtcagagaagtgcgtatgtgattaaattggatttacagggttttaaaaaaaataccttgtacttgatgaggccttctggatttgcttgtttaatacagattcaggactggatattcttgaaagtattacagtagtttagtaccgaggaagggccagaaaattcatttctccttttttatttgagatgtttatgaccttgaagaagttgttttacctttttgtttccaataggcaaaaaggaggtgtggaccagattcctcagttcacatctagtggtacagagaaatgattaaggacccaggatgttttgtgacattgaggaattgagactgtttaaagatctacgctccatttttagaaaaagggttctttttgtttatggtggtacccaggctctcaaacagagatagataggacctaagatatgttgcaatcaattagattaggtaaactcaagatcctttaaaaatatacttacatggggttctgaagttttatttttccaagccatttattttcgactaatttactgtcctttgaaaatgtatttcttaaaaataattaaattctgtagttttagttatgtcagcaggggaatggtggaaaacacccattagataacggagtcctgtctaggagctgagagtgccatccaagtgtaaaacgatcactgttccttgactttcttccatctagctgctctacgtaaactcctgttcacaagtttccttccaaagcttttttccttgcctataaagtctgccttttcggtgcagtcttacttgaacaatccttagtcataatccttgtctgtatattttacattctaatctattcctttcgtgataatcttttgttttaattcttaactctgtgtatgctttgacctccaaatatattgtgagaccgagggcaacaaccttaaatggaatttgtttataccctccatagtccgtagtatatatgatgcacctataaaacacaattcacgttcaaatggagcctagggaaactgatcaggtttaaggcccctctgatatactttttcatggtcttcgaggtatccttgtttattttgaggtgtttgaaaatatgaggttgtctaatagatctatattccgatttgcatgccacagtgaagttaaaagccaaaggaaatgtttaaaaaatctcccaaatcaccctccccacgctcatatgttaagtgactaagagtgctactgaaaataaaatagggtagcctttggaagaccagagtgttttccttatttaacaagttctacatttaacaagttcatttggattggaagggaagtgtttgtcttttcccttttccccatcattttttctgagaaacacctccatttagtgttggtgtattctgtgtccaacagttacattcctttttctgtcttcttcattcttaaaaatttgaaatctttgctgtagagtttagagtccatatttaaagtctgagccgtaaaggtgacacctcttgttgcaatttttgctttaacatttctgtctacatgtcccaaacttcattaatttttaagtcttaaacattcatgtacataatcgtttaccagtaataattatttaaaaaatcaacttaaattttgcccggcatttgctaaaggctataggtgctaggtatttgcataaactctttaagctgtttgctagcagaaagaggcatatgaactgggttaacagaaatgatctcttaagggattaaggatttttgcaattatcgggacattcccacaaagttgagataacaggtgtgatcttcatcatataagtggggaaataggtccctagagatattgggtggtaatgattctgttggtgtgtgaaagcctttagacttccctcacaaatcagttcagtcatcctgatggtcttcttctgcaacaccataatgcttacagaggatagtaggtcctctgatggtcaacccccttcttaacaaagtcagctgattttcaaattgaagtgtttttgaaattatgaaaattatgacatttaaaatagatatgttgttaaattctttttttttgttttttttaaagacaggatctcactctgtcacccaggcttgagtgcagtggcatgatctcggctcactgcaacctctgttgcccaggttcaagtgattcgcctctggagtggctgagattacaggcacctgacaccgtgccctgctaatttttgtatttttagtagagaccgggtttcaccatattggtcaggctggtcttgaactcctgacctcatgatccatccaccttgccctcccagagtgctgggattacaggtgtgagccaccgcgcctggccgacatgttgttaaattctagctagatagtactgctttagtcctgaggtctgcttttcctttattgatgagggaaagtaacaagtattatggatatattagacgtgacagcacctgatgatttcttccttacataatttaaaaggttgaaagagcagtgaaaaaggaacaggtagcctcatgtgattcaggcacatcagtgaaggatcttttcatagtaagtttttcagactttgggaggtactgatttaaacttttgtcaatgtctgcttttacattagtctgttatttgtatagatttcctgcagaactaacatttagggttgtcaaataggttcagactccttacctgaaatgatatgattaacaattcagaattctgggattttaggaaggcagggagagtacatatgccatatattttgctgctggtgcggtctggaatagcacataataatatgtctgcaaagaaacaacagtggaaacaggtggataaaagaaatgactgataccctcaatgtcagtccaggttttgccaccaaatgagttttgacagaaattttggttttcagagcttcttgggtttcagatttggggataggagattatgggcctgcagaactggcccattttataacagaacccttttggatgttgtgctcttgtttattcagataaatgttgaggtgtgtatgatttaaaatattttaatttttctcacttttcttttaggtagacgaagttcctgatggagctgtaaagccacccacaaacaaactacccattttcttttttggaactcatgagacgtaagtcctgttagctttaaaggcaaatcagagctaatttaacagggttattaggcagtagacattaattcaagggggaaatcgtaacgtaataggaaactttaaaatctttgaactttggaaagagtctttaagtctctatttttaaggtagcgtttacagatgctataggtttattttttactggaattgatatttccttaaccaaaaaggaaagtagaaattctctgagcaataagaatgattgatggatgaaaatacataaggaaagttttaataagtgatctgatattcctatacagtaaaataagtgctttttataaggactagttggtacctaatttttggttttatgatatcagatatgcaaactgtgtatattgtggagaaggtgagaagaggaagtctagctagttccctccatgtgtttatatggtccctgaagctctgctgcctctggtgggtatgtgggcagagaactgatgtgaagcaaatttttcaaaaattgcagctgaatgttgacgtatgttactgccaagtgcatgggatcactcaggaggctaccgttaatttcccgaagaatgttcctatgtacctataatttaatggccttagaaatactatataatctggttgattttggacttgaagtttggtgtctgtcataattttggtagtcttgtttacctgggatgaggagaaacaaaactattgctattctgattagaattatgtattcctaagagtggctgcaatggcaatatttggtttaaagttgcttagctactgtataaactttcacacaatgtctttaatagctctattgagatggaatttacatacaaagaagttcacctgcttaaagtgattttcaatagattttagtatatttagtagattttagtatattgactatcataaccttttgatgatcactttcccctctccaaccgtaaacaaccactagtctactgtctgtatagacttaccagttctggacattttatttgaatggtgtcatacaatatttcataataagtttttaaaaaaatacaactttggatccagaattggtttggccttcatcataattagagttaggttcaagtgtattctatatataacaatataatttttaagaagtgataagtttctgattccatgggatactttaaagaaactcttcagtaaatttaatagaggacaaaagtatcttttaatggaaaatggtgcagtgtatattagagtagggcttttcaaagtgtgttgtcaggtctagcaccattagcatctcttgcgaactttaattaaaatgtaagttcttggctgggtgtggtggctgacacctgtaatcccaacactttgggaggccaaggcgggagggtcacttgagttcaggagttggagaccagcctgcaacatggtgaaactgtgtctctacaaaaaatacaaaaattagccgtttgtggtggcacacacatgtggtcccagctactccagaggctgaggtggaaccgtcacctgagccggggaggcaaaggttgcagtgagccaagatctcaccactgcagacctcatctcaaaaaaaaaaaaaaaaaaaaagttcttaggccttattctagacctactgaataaagctgtgagtgtggagccaaagacctgttttaacaagccttccagatgattctgatttacgttgaagtttggaaatactgtagtaatgtgagtggacattccttagcatttttcagttttataagcttaaaagtctttaattctgatttttgtctgaaatggaacaggttttttcttttttttttttttgagaccgagtctagctctgttgcccaggctggagtgcagtggcatgatctccgctcactgcatgctccgcctcctgggttcacgccattctcctgcctcagcctcccgagtagctgggactacaggtgcctgccaccacgccaggctaattttttgtatttttagtagagatggggtttcaccgtgttagccaggatggtctcgatctcctgacctcgtgatctgcccacctcggcctcctaaagtgctggaatggaaccgattttatacttctatatatcctgatagtcttacagaatacacagtccattcttacgttactattttaaatttagaagaggaatgattatcccttctcctgcatttaaaaggattttcatatataaatatatgtacactttaaaccaaaacaaactaaactaaataactaaactgttgtttggttaataggtaattagatagttaatgaagacagtgaattactaatattcaagaatttaggatatattcaaggaattcaaatgaatttaactttaaagttaagctgacaatactgaattttcatttcaaaatgcacttggtttttgccttagtgttcttatgattataccatttatctttggaaaagcagtgctgccccatatgtatgttggtctggtggtgacttcttttgtacttaagattaatttttgggctgggcgcggtggcttacgcgtgtaatcccagcactttgggaggctgaagcgggcggatgacgaggtcaggagttcaagaccactttggccaatatagtgaaaccccatctctactgaaaatacaaaaattagcctggcatggtagtgtgcacctgtagtctcagctacttgggaggctgaggcaggagaattgcttgaacccaggaggcagagggtgtggtgagccgagattgtgccattgcactccagcctgggcaacagagtgagactctgtctctaaaaaacaaacaaaaaaatactaatttttggaaactaggtctctgatgatcttttttcccctcaaaatttgggagggtagttatttgaagtttttttttttttggagacagagtctcattccatggcccaggatggaacacagcggcgatcatagttgactgcatccttgaactcctgggcctaagtgatcctcccatctcaacttcccaagtagctgataactgcagtagcttgctaatttttgtattttttattattattattattttttagagatggggtcttgctacatggcccaggctggtctccaacgcctggtttcaagtgatcctcctgccttagcctcccaaagtgctgagattacaggctactttatttttttatttttttattttttgtgatggagtctcctctgttgcccaggctggagtgcagtggcaccatctcggctcattgcaacctccacctctgagatacaagtgattcctctgcctcagcctcccaactagtcaggattacaggcacccgccaccacacccatctaatttttgtgtttttagtagagatggggtttcaccatgttggccaggctggtctcaaactcctgacctcaagtgatccacctgccttggcctcccaaagtgctgggattacaggtatgagcctctgtgcctggcctgtttgaactttttagtttggattttgcataaatagtttagtagtctgctaaactagaagaaaggtatatttggaaattgtactaattcgtaactggtttatagattaaggttttttaattgttaatttagagcagaattcttttgtaactgcattcttttcctggcctacagacgtctgattttacttaggacattcatagtaaatgttcagcaatcaagttttgaatattagacagtgagccctaactgtgaccatgtactagatattttaaacctaacatattcagacagatttttagtaagtgggaatgacatagactcaattcttactgaagccaagtcttggtattatccttgattacatgttatagtctttccccttcctttctacatctagtcagtcagcaaatcttgttctttgcctttcaaatgtattcggatctgtccgctcttggtcatctttgtataattcaagtccatgcgtaattacttctgtaaataatgtcctaagttgggcacactgggacatgtctgtagtcccagctactcaggaggctgaggcaggaggatcccttgatcccaggagttcaaatctggcttgtaacatagtaagaccctgtcttggggggtaaaaaaattaaaaatagtgcgcttactctatgttggtttcagtttccactcttcatatacagttggcctgctgtatctgtgggttctgtatccatggagtcatcctgtcacagattgaaaatatttgggggaaaaagatggttatgtctgtagtgaatatgtatagattttttttctttgtcattattaccttaatgcaatgtaacaactatatagcatttacattgtattaggtattataagtgatctagagatgatttaaagcagcaatggaagacagttttttccacgggggtttggggggatggttttgggatgaaaactgttccacctcagatcagcagccattacttagattcttataaggagcactcagactagatcccttgcatgtgcagtgcacagtagggtttgtgcttctgtgaggatctaatgctgccactgatctgacaggaggcagagctcaggtggtaatgcctccctcctgctgtgtagcgtggttcctaacaggccacggacgggtactggtccttggccagggggctggagaccccagatttaaagtatatgggagggtgtgcgttttatatatatatatatatatatatatatgctgttttatataagggacttaaacatctgtgaattttggtatctgcaggggtcgaggaaggataatccacagtcttacggatacggaggtacaactgtctagtcaaagagatctttatatctcagtcagatcatgtcatttcactgaaaaccttcagtgactccctattttaacattagcagtgaatcaaaaccaaaaactacctacaaatgatatttataaaaacctatacgaactagcccatgcttacctctccagcctcattacatttttcaccgcttttttctattgtaaaaataagcctcatcttatctcaggtcttttgttttccctttgcggggaaggttatgccttcggatatttgaagtcatttagatcttagctcacatcctcctcctcgtgtttattttccccactgcaacagtgactgaatttttttttttccccttttctctttttttcacccacactcgaagagctggatcagcagggaccttgtctatcttgtcatcattaacttaagtgcctggcacttagtagctgttaaataaatatttggtgattgaaagctttgtgcactagataaagtcatttgttgattatgcatttgctgtccattagccaacgtttatgtagagcaactagatcagaagtttgtttttgaatactgactgccatttacctgctatataaccttgggcaggttacttatatttgtgttttttttctttgtcatttgtaaagtggggataatattatcttgcctcagaatcttgggatgcaaataagacatgacatgaataatgcttagaacaatgcttggctattatttatttaaaatgttcagctttggcaaacttttatttcattttgggaacaagagttgtggggatttacccatttttccaagacttctagtagtatttattaaattgaaatgaagctcagtttgagttttggtgactaattacctttgctaattcagggactattcctacctagttctgtatcttagaagtctaggaaatttaaataaagatattttgctgttttttcctccttactgctcttaattgtcttaatgcaaagaagttgggtgctcagttttaggaactttaaatatacatcacaggctgttttaaaacccgtctaatttatagttttaggagtgaaggtcagtgcagaggtactgatagtggtgacaagaagaaaataaagtaatgaatcttaggataggatttttttcttctacactagttcttctgtacaagtttcatagctgcacgtattggtgtgggacttgtatggtttctcttaaattttacaccaaataatgagatgaactgtttattcatctcttttttttttggagacagagtcttgctctgtctcccaggctggagtgcagtggcagtggcgcaatctccgctcaaagcaaggtctgcctcctgggttcatgtcattctcctgcctcagcctcccaagtagctgggactacaggcgctcgccaccacacccagctgattttttgtgtttttagtagagaccgggtttcaccgtgatagccaggatggtcttgatctcctgacgtcatgatcctcctgcctcggcctccacagtgctgggattacaggcgtgagccaccacgcccagccctattgatctctctttaccagcaggttcatgagaaatagtgcgtgcatattcagttgtctgttgaataatttttctgttatagactaatacatgctattataaaatataaaatatttataataaactttcatattttgtgatttagtaatgtagaaatgaagcagcaagttagaatcaatatgttgttaaaaatggaatttttctgtttagcaatattacttggcaacacttaaatgagttttgagcttcatatatttggctctgatttcctgttttgtgtatgtgacttcggttttttttttttttttgagacagagtctcttgctctgtggtccaggctagagtgcagtggcgtgatcttggctcactgcaacctctgcctcccgggttcaagcgattctcctgcctcagcctcctgagtagctgggattacagggacgcgcccccaagcccagctaatttttgtactttcagtagaaatggggtttcaccatgttggccaggcgggtcttgaactcctgggctcaaatgttcctcccacctcagcctcctaaagtgttgggattacagacatgagccaccgtgcctggcctgtgacttgtttcttttaagagttctagttgtgtaacaactgaatttttgtgtgtgttcttgtgggtattcatattattcacaaaaagtgaattaagagagagaactgcttgtctttgtttatataccattaggaaaattggaatgcacatgtacacacttagggcttcaacgtgtgtgccatgtaagaaacacattgtagcatttgagctgcctcagtattataaaactagtattgaattcagttaatgatttcctgttttcttagaatgttttacatcagtcttgactcttacaagctttgacattggtatttgaggtctgagttcgtacatatagagaaatagcatgaatattttattaggagatgtttcaaagactgtattacaatggttaaaggaaagtccaaaacctctttaaggaacactgcaagttgagactctgctgttttaataggtaggtgaccttgcctgagtcagtctttttgaatttcaattttctcatctttaaaatgaggtttttggtgatccctcagtttcctttcagctctggaatttggtgggtaagttaccttgaatgtgtatcttttcttgttaaaattttaaaaaacaatatagaaggaaacaaatcctttttactcctattttttagaaataacccctaaacctggtaatattttgacgtgtttttttcaaacttgtctgtgcattttttaaaggagcttctgtcgtatatagttatgccctgcttttgtgtgcatgttaagcatttggtatgttattttaaagtggaatgccttgaagaatgaatcagtcagacctactgttaacattttgatgtatttcagactgacttacaattttttggtatttgatattatgtataattatatcctgcatttacttagcatattaaggatttttttatatgtaattttaaagtggaatgccttgaagaatgaatcagaaccacagctgcacaaggttgtacccttgggaagtagtatagtgatgtccgtcgaaaaactaatctggtccctgttcaccaaacctgtcggactgcgtgcccaaggaagatttttttttttttccatctgctgtcatttttgagtctcattaagagttcatcagtcttgagcatatcttactctttgtttttttgttttgttttgtgttttgaaacggagcctcactctgtcacccaggctggaatgcagtggcacgatcttgtctcactgcaatctccgcctcccgaattcaggcgattctcctgcttcaggcttcctagtggctgggattataggtgcacgccaccacggctggctaatttttgtatttttagtagagatggggttttgccgtcttggccaggctggtctcgaactcctgacctcaggtgacacgcccgccttggcctcccaaagtgctggggctggggttacaaatgtgagccaccattcccggcttgacccacttattcttagaatttattgtgaagataggtgcagagattgagcaatatgtttattatagcagtgtgattttataatataaaatttgacatggaaaatggcccaacaataggtttagctattcagtgaaatagtgtgtaggtgttaagtaattgttgacataaaaagatactcattttaatttaaagaggtctacttttgagtaagtttgtatcatatacattgaaattgcatagttatatatgtatatatacaaataagtgggctgaaaacagtagatttagttggtgagattgtggattagtttactttgataggatatgttattgtcaaaaaattttaacagctttattaaaatataattcatttctccaaaaagaaaccatgtattcattagcatttactttccatttctacccaatcttctttcccaccttggtctaggtggtagctaacctactttcttcctattctgggcacttcatataaatggaatcagccgggcgcggtggctcacgcctgtaatcccagcactttgggaggccgaggtgggcggatcacgaggtcaggagttcgagaccagcctggacaacatggtgaaaccccatctctactaaaaatataaaaagtagccaggcgtggttgcacatgcctgtaattccagctacttgggaggctaaggcaggagaattgtttgaacttgggaagcagaggatgttgcagtgagccaagatagcaccattgcactccagcctgagtgacagagcaagactctgtctcaaaaaaaaaaaaaaaaggaatcatagaacgtgtggtcttcagtggctggcttttctcacttaggatgatgtttttcaagattcatccatgctctagcctggatgtgatagtacattactactctactttttattgtcacatattccattatattgatttaccatatttattcatcacttgatagacatttgagttatttttacttttggcttttatgaataatgctgtgaacatttgtgtccaagtttttttgtgaacataagttttcatttctctaggagaaaattcctgggtcagatgtaatttcacgtttaacgttttgagaaaactctcagacttgccaaatcagctgcaccgtttaacattcccaccagcaattgtaggagggttccaatttctccacatccttgccaacacttgttattatttgttattttttggccgtctgagtgggagtgacggtagtatattgtgatttttgatttacatttcctggataacttaatgatgttgaattatgtgaactaaaaaaaagtgtgcgaatttaaaaatcttctgtacttaacatgaatttacatttgtaaaagtcttttcagttggaagaacatagttatttaatttttggtatattaagatacgtgaatttatgtatgacatcagttgaaccattatggttaataatgaaaggtacaacttgtaaatctgaatctgggagtaggagcaaggggtgaatttttttaaaaacctacttagcaaagttaagaataaaaaacaattgtagtgaaaaggtacacgtaaaatgaggtggtgtgaataaaactaaatgtaaacattacattttatgaatgaatatagttctgttaagactttctgttttaataaaccactttgctatgtcttattttgtgagacaaagctcaaacaaaacaagagcaagcaatgatacaatgtcacaaagaaagcaggaatggcaatactgctgtctgttaaaagtggaatttaaactcaaagcttgaagagagaagggtatatataggcagtccttagctttacatagttcctgtaggcacaaatttcaattgccatgacttagctaagtaacagtccactaacaacatggttaaaatttcacctaccctgccatattaactaattgtataaactacaacatttgctgctagtctttcaacctacaaattaagatgtaaatgacaggtgcatataatgtcacttttaaagcttcttggtgattggtcaccatgcattggtttctcaaaatcatgcacagtcggatgtatagttggcctctgtctcctaatgatgtccccatgtgacagtttaccaaaataaacaaggaaattggtcaacaaagatgatagtgcagcaaaaatcctaatgctagatgggaaatttgaatttaacataaatggaataatagaataaatagcttaccttgtgaatatagatggtttgcagttggagagacactaattgtccagccagagaaacttagtgaaggcaagcttatcaacataaatgaaaaaggtagttgtaatggaaaatatgaagatatcctattaatagaagtgataccaacaaaaaacattgaggatatttcacatcattgaaagcatgaaggataaaatattggaatgtgatctaaacttaggagtatgacagtttgccaaggcatagaagatagacgcattccatatcataataaatatcactagaagaaggcaagcactgttcaaactattcttgatagattttttttaatacaaagaaatgatacactttaatatcagtgttcctaatgttttaagttacagcatactaagttggtattggttttactatttcatttccttatgcatttacataaccgtcagtaatagactacttaatattctgacaaattttaaaggtcacagaacaatcgtaacttttcccattgattattaagattgccttgcatggtcctttttaagaactgctttttttgaggttaagaaaaatgattcatgtaaaaaaatttatcttttatacagtaactttgtggtagatcagtcttctgtggcttttagacttagagccatatctttaaaaaaaaataaatatttgaggttttaaaacattttcctgtaattatttttgaggtcttttcctactcctgaagttcctggtcaccccaattttgagccctttggggattttaaattgtaaatgagggtgcttaagattcaacttctttagttgtctttttagcttccaaattttatttttgccttgtttggttttaagagtttatacttttaaaataatctctttactgttgtttttctggtttttcaggagggagaatttgtgttgaattgggtttgttctgaccagaaatacgttttcatggaggtttaactcaagtcatttacttggaatttgaaacctgttacataagaggaatgttatactgttagagctaaatgtgttaatttttctaatttgagattatggacaggaattaatgatgtctagtaaaatcttcagtttttgatggaatgagatgatttcagtttaactccaaagtaaatttggtaaattattggtttgccttaatcctagcataataatattactttgaaaatgggatgtgcagttaaaatacatggatacaatgaatgttacagaatttaaataataaagctgacttttatataccctgattttttatatatgtgtgtgtgtgtattttttttttttttttttttttttttttgagatgcagttttgctcttgttgcccaggctggagtgcaatggtgtgatcttggctcaccacaacctccgcctcccgggttcaagcgattctattgcctcagcctcccaagtagctgggattacaggtgtgtgccaccacgcctggctaattttgtatttttagtagagacggcattttgccacattggccaggctggtttcaaacgcctgacctcaggtgatctgccctgctaggcctcccaagtgctgggattataggcatgagccaccacgcccagccatatttaaatagaactcttaagtcttttaattgaaattttattttagagcctttttaaaattctaactagaatattaactgtactcattagttccctaattcttaaagaattttagcagatcaggaatttatgatatgtatctaatgatagtaataattttaaaatttagtacattttagaggaaataagtatcagttccattttcctgttgctttggggagtatatgtatatcagctgtcatagtaaaattatcaacatacttacgtctagctttatagaactgacagacttatatgactcactgatgtggggaggagatgtacagggtccatcctggataatgtatctaaatatatatgtacagatggtccctgacctactgatatggtttggctctgtgtccccacccaaattacacctcgaattgtaataatccccacacatcaagggcaggaccaggtagaggtaattgaatgattggggcaatttcccaaatgctgttatggtgatagtgagtctcatgagatctgatggtttcataagtgtctggcatttcccctgcttgcgctcattccctctcctgggtccctgtgaagaggtaccttctgccgtgattgtaagtttcctgaggcctccccagccatgcggaactttgagtcaattaaacctcttttctttataaactatccagtcttgggtatttcctcatagcagtgtgagaactgactaatatggtaaattggtaccagaaagtggggtgatgctgtaaagatacctgaaaacgtggaagcgactttggaactgggtaacaggcagaggttggaacagtttggagggctcacaagaagacaggaaaatgtgggaaagttgagaacttctagagacttgttgaatggctttgacccaaatgctgataatgatatggccaatgaactccaggctgaggtggtctcagatggagatgaggagcgtgttgggaactggagtaaagatcactcttgctctgctctagcagggagactggtggctttttgcccctgccctagagatctgtggaactctgaacttgagagagatgatttagggtatctggcagaagaaatttctaagcagcaaggcatttaggaagtgacagagcataaaaggaaaatttgcagcccgatgatgcagtagaaaagaaaaacccattttctagggagaaattcaagcaggctgccaaacactaatcaccaagacaatggggaaaacacctccaaggcataccagtgaccttcctggcagcccctctcatcataggacgagaggcctaggagggaaaaatggtttcctggcctgggtcccgggccttcctgctgcgtgcagcgttgggacttggtgccctgtgtcccagctgctccagtcttggctaaaagggaccaaggtatagctgaggctgttgtttcagagggtgcaagccccaagccttggcagcttccacatggtgttgggtctgcggatgtgcagaagacaagaattgaggtttgggaaactctgcctagatttcagaagacatgtggaaatgcctggatgtccaggtagaagtctgctgcagggacgaagacttcgtggagaacctgtgctaggactgtgtggaagggaaatgtggggttgcatccccgacaccgagtccgcactggggcactggctgtgagaagaaggccaccatcctccagaccccagaatggtagatccaccgacagcttgcaccatgcacctggaaaagctgcagacattcaacaccagcctgaggcgggttgtgtaccatgcaaaaccataggggcagagctttttaaggctgtgggagctcacctcttgcatttgcatgatctgaatttgagacatgcagtcaaaggagatcattttggaacttgactgcccctattagatttcagacttggcatggggcctgtagcccctttgttttagtcagtttctcccatttgggatgggtgtatttagccaatgcctgtccccccattgtatctaggaagtaacttaacttgcttttgattttacaggctcctaggtggaagagacttgccttgcctcagatgagactttggacttggacttttgagttaatgctggaatgagttaagactttgggggatggggactgttggaagggcatggttgtgttttgaaatgtgaggacatgagatttgagagagggggcaggggcagaatgatatggtttggctctgtgtcccctcacaaatctcaccttgaattctaataatccccaggtgttaagggcggaaccaggtggaggtaattgaatgatggaggtggtttcccccatgttgttcttgtgatagtgagtttcatgagacctgatggtttcataagcgtctggcattttccctgcttgcatgcattctctcctgtggccctgtgaagaggtgccttctgccatgattgtaagtttcttggggcctccccagccgtgtggaactgtgagtcaattaaacttcttttctttataaattacccagtctctggtatttcttcatagcagcgtgagaatggactaacacacctatagtggttcaacttagattttttgactttagagtgggtttttcatggttacttaaatggatttctgacttcagatattttagatttacagtggacttattgggacataacctcctagtaaattaagaactatctgtgtatatatgtacacacatatgcaaacagttgaggctcgttatttgtggattccatatttgcgaatgtacctactcaccaaaattatttgtaagcccagatcagtagtacttgttgtacaggtcattcacaaacatgcactgagtagtggaaagacttgagtctcctgatacaacacattcttagctgaggttgtacaagggaatgcttgccttcttttttcagcactcatactgtaagcaagtatcttttttgcagtctgtttattgccatgcatttttttgcttttgttggtcattttgctatttaaactagctcccaagcataatgctaaagtgttctttcatgttgctaagtgcgagaaggttataatgtgctttacagagaaagcgcatgttacatacgctgttggctatgagttcagtgttaatgagttagcagtctgtattaaataaggtgtctttaaacagaaacacacataaaatgaatttatgtattgattggttcatgaaaaccttgtgattacaggaacctaaccctgtatttcccctaggagcaatggttgtgtatttgctaattcagttttcacagtgactttatagaacattactaccacagatagcaaaaattgatagtacatatatgaatgaatgggttataatatgtctgattccctcattcagtaaaataaaattcttaacatactcactgattattttaaaaacacgatagttttgtgagttgtataatatacgaagttattttgaagtgaaactatatttggggtgcagttaaatgtgttgattaatgctaatgtgtcaaagtttgtagtttaaaaaaacccaaatttattgaattaacctttttttttttttttttttttttgagacagagtctcactctgtcacccaggctggagtgcagtggcgtgatcacagctcactgcaacctccgcctcccgggttcaagcgattctcctgcctcatcctctcaagtagctgggactacaggtgcacgccaccacgcccggctaatttttgtatttttagtagagatggggtttcaccatgttggccaggctggtctcaaactcctgacctcaagtgatccacccgcctcagcttcccaaagtggtgagattacaggcgtaaggcaccacgcatggcgatgtaaccatttttaagtgtatagttcagcagtgttaagtacattcacattgtgcaacgtctgtggttttacttaataggattatggatttaaatagtagcttgttactgaatttaataaaagtatttggaattattaattgccctttaacttatttaagatttgtaatgcagtttaggttctgtatttttgataattgtgtaatagggtgtcttatctaataaattatgtatttgagcttgctttgcactcacatcttccccacttcttttttagtgcttttttaggaccaaaggatatatttccttactcagaaaataaggaaaagtatggcaaaccaaataaaagaaaaggttttaatgaaggtttatgggagatagataacaatccaaaagtgaaattttcaagtcaacaggtaagtcatattacataaaatttgatattacttatttaatcctggggaataatcactatcctagctgtaggaaagtaaatactaaaagccttgggaatttcatactagtttgttgtgttcttatttgtgaggttgaaccttgggcattttatatcaaaatgaattgacaaaatcattattttatgtagttaaacagatctcaagaaactgggaactattcagttatttaactcctgatagagggtttaatacgtcattgaatataaagctgtatgtactgttctaaatttaggttttgcgacttacatggtgtatgcctaagttttcttattctctttaattaattaattaaatttcttttttttttttttttttttgaggtgtagtttcgctcttgttgcccaggctggagtgcaatggtgcaatcttggctcactgcaacttatgcctcccgggttcaagtgattgtcctgcctcagcctcccaagtagctgggttacaggtgcccgccaccacgcctggctaactttttgtatttttactagagacagggttttgtcatgttggccagactgatctcaaactcctgacttcaggtgatccacccacctcagcctcccaaaatgctgggattacagatgagagccattgcgcgcagcctttaatttctaaatccatagaattgtattggaatatgaacctcatgagttaaattggtatgtgacaaatgtacttacagcactatgcaaattatatttattggtgtcagcagccaccttataccttcttttctgtggtttttcccatgggtccagagcttttattaatttatatgttatagtaaattttcatggagtggtttgcctttatccaatttgtattgtttttatcctacagaaaacactggttctcttacttctcctttgtgttggtattgatgtgatttagaaaaaatttattttttttgagaggagtctcgctctgtcgcccaggctggggtgcattggctctatcttggctcactgtaagctccgcctcccgggttcacaccattctcctgcctcagccttccgagtagctgggactacaggtgcccgccaccacacccggctaattttttgtatttttagtagagacggggtttcaccgtgttagccaggatggtctcgatctcctgaccttgtgatccgcccgcctcggccccccagagtgttgggattacaggcctgagccactgtgtccagcctaattttttgtatttttagtagagacggggtttcaccttgttagccaggatggtctcaatcttctgaccttgtgatctgcccacctcggcttcccaaagtgctgggattataggcttagaaaaattttttatattgtcgattgcactcttgaattgttgcatatattcccaaatgaatgttccagaactcttacgatttaaaataaacagatggctttataataggatcagagggctatgagaggtctttatgaagataattgggacagtttctctttcatcaataaacgtcctctgtttaagacctgaggtccaaaaactaggaagagcacgagtaaatctaaagaagcgaggtagcaacaaagtggaaattctgcagctttttactcttttttttgttgttgttgttgagatggagtctcactctgtcaccccggctggagtgcagtggcgtgatctcggctcactgaagcctctgccccccaggtcaagcaattctcctgcctcagcctcctgagtagctgggattacgtgtgcgctttgccaccgtgcctgggtaatttttgtatttttagtagagatggggtttcaccatcttggccaggccagtcttgaactcctgacctcgtgatccacccacctcagcctcccaaagtgctgggattacaggcataagtcactgtgcccggcctagctttttacttttaaaccgataaattttatttcttcacatgtgccatgctttaccttggagaactttttagatactgttctatctggaacatataaatctttcattgctgctccaaggccacattaaatgattagtgactttattacttcccagtacttacttgttaatggattcatcgaaccatatcataattgtttctgtacttgtctgtacctgctacagaatattatgttgcctctgtgaacaaaggtttatgtcctgtgtgcccagcatgtacacgtgtgagaagaatagctaatcactaaatatttgttgaatggctacatggtttcttatcattattgccttgactgtgtgatgggaagacatctgtctaaagagacagaattgattgttatctgaaacttaacgtcttgtaatttcttttttgttgttgtttttttggagacagcatcttgctctgtcgcccaggttggagtgcagtggtgcaattttgatcttgtctcgctgcaacctctgcctcctgggttttaagttatactcgtgcctcagcctcccgagtagctgggattacaggcgcgtgccaccatgcctggctaatttttgtatttttggtagagatggggtttcaccatattagccaggctggtcttgaacgcccgacttcaagtgatctgcctgcctcagcctcccaaagtgctgggattacaggtgtgagccacagtgcccaactacgttttgtaatttctcttggatcatttgtcctgtgattgcacctttatggtcttttttatcctccaaattgccaagccttgtcaccatataatcttggagttttttttaatttttattatttgagactgcgttgcccaggctggggtacagtggtgcaatcatggttcactacagcctcgacctcctgggctcaggctgaggagggaggatgccttgagcccaggaattgaggcttcagtgaaccataattgcgccactgcctccagcctgggtgatagagtgagaccctgtctctaaaaaaaaaataaaaataaagaattgtatatattattgggataaaaacttattttttgaaattaatagagttgattgctcacaggcagcaactaaacaatcaaatgcatcatctgatgttgaagttgaagaaaaggaaactagtgtttcaaaggaagataccgaccatgaagaaaaagccagcaatgaggtatgttctatttctcctaacattttaaacccattttgtttcaaggaagaaataatgaaatgagttggccatgattaattagtaagtaatttttaaagtacttcaaaagtgaattagaaaatatttaaggcttatttccttgtgtaaatattaaatacagtattgtcaaacaacttatgcatctttaagatgcatacctgttattatttgaagttatttttatatgtaaaacatgaagtccaactgtagggtgcggtagtgttaaggattttttttaaagagaagtgttgtaggatggatgtactggaaacagcattagactaaattttttaaaacctaggttgatgtccaactgtatatgatctgtgtgtaaagatgactcatttagcccttccaggcctaatgaaatggttgttagatgatcttcaatgtcccagccaccctttaaaattcacaattcaaatttatccacccctataattcagaattctagtgtagaaaaagtagttttataaatttaaatagacagacttcctggtgtaccagcaaccatgacttacatttgatctgacagtggaaatgcatttttctcactttataatgttgagacacaatgtttttaatttcagaactctacagagcaaaacagatttccccaatgctttcagttaaacgtgcttgtaacttttagtttaacaaggtttctttcattcctggaataatttattcagtattcagttttcttttttcttttttaggatgtgactaaagcagttgacataactactccaaaagctgccagaagggggagaaagagaaaggtaatttcactgacttaccaaccatggggatctgaaaagaatttttattttaattgggttgagggagagtagatacaatgaaaccttaaatttcagcttttattctaaaccctttaattttttatgggttatgttttacttggcaaaactatctgtgtttctttcttagtgatatagcacccttaaagtaacttgagtggtaaaggaaataaaatacaccagttttcattcattttaatgactgtgcctcagttttctctaaattgggtagaaatatatactccaaggttgtggaggattaaatgatttaacatatgtgaaatgtttatgctaaatcctgatacctaaacactagtaagtgttatataagtgttgtccattatgttgttgttgttgttacttcacgttgtgagaaatgagtgtgagtgacagtgcaaggttaggtacatagtaggcttttaattaatatgaaattttccttccatatacgaagttttgttcacacccttttctgacctatttatgtctcaaattattatcatataccaaagatgcaaagaaaaccaaaagttcagtatctcatgaggaggtaaactatgaaaataaataattacagtggcttatttgttgtgcagtatgggttggaagtggtgtgataacaagattttaaaatacaggcagaattttgtcaggcggatgaaggagcagggaaggacacatgaagccatttcacatagaggaaattcctactcaagcatcttgagtattgtatttcattattaacacaccataaagtctgagggaaatgggtaccaaaaaaacctgatgttgtcctaaagaccttggaacttacagaagtgatgggaaatgattgaattattttaaattttagatacctccttttaaaaaatttttttaagagatggggtctcatgctgtcacataggctagagtagtgcagtggcacaatcatgcctcactgcaacctgaaacttgtgggctcaagggattttcccatcttaccctccctaatagctgggactgtagaagtgtgccaccatacccggctaatttttttttttttttttttttttgagacggatctcgctctgtcatccaggttggtgtgaagtggtgcgatcttggctcactgcaacctccacctcccgaattcaaacaattctcttgcctcggcctcccaagtagctgggattacaggcatgcaccaccatgcccagctaatttttgtatttttttgttttgtttttgtttttgttttgagacggattctcacactgttgccccagctgaagtgcagtggcgccatctcggctcactgcaaccttcacctcccaggttcacgtgattctcctgcctcagccccccgattagctgggattacgggtgcacaccaccatgcacacctaatttttttgtatttttaggagagatgaggttttaccatgttggccaggctggtcttgaactcctggcctcaagtgatccacccacctcggcctcccaaagtgctggtgtgagccaccacgcccagctaatttttgtatttttagtagagatggggtctcaccatgttggccaggcttatctcgaactcctgacctcaggtgatctgcccatctcagcctcctgaagctctgggattacaggtgtgagccaccgggcctggcctatatatatatatttttttttttgatagacatggggttttgctatgttgcctaggctgatctctaactcccagcctcggtgatcctcccaaagcactaggattgcagatgtgagcctctgtacacaacttgatgcctcttttttctttttttttttaaatataaatttgtttttttttttttttggatacagagtttcattctgtcacccagactggagtgcagtggcatgatcttagctcactgcaacctccacctcccgggttcaagcgattctcctgcctcactcagcctcctgagtagctgggattacagacgtgcaccaccacgcctggctaatttttgtatttttagtagagatggggtttcaccatggtggccaggctggtctcaaactcctggcctcaagtgatctgctcacctctgcctcccaaagtgctgggattacaggcatccgccaccatacccagctaattttttgtatatttagtaaagacagggtttcactatgttggtcagccaggtcttgaactcctcaccttgtgatccgccttccttagcctcccaaagaatgcgtcatttttttaaagcagtgtgaacgatggggattggattggggcagtgagaccagttcactgtaaaattcattcagaattttagtactaactttactggacttggcatggatttgagtagtcagtaaagaagacaaggtctttgtttccattgaacttacatttttttttagacaaaaaataaatatttaaaataagagggtttaaatggggagttaatgagttggcaacagactaggctacaaaaggcctttctaaggagttggcatgagactggaaggacaaggatcttatagattttttaagtggtgtagacgagagatgggatttaagagcactttaagaggttaagttgatggttgatgagaagtggatggtaaagggggcgggggagggaactagaatctaaggtggctctaaggtctttacttgaataagctagttattgggagtgcagaggatgttggtttggaatcataggcatgagtaaggggaaggtgaagcacctgtgggaactggagtgaagagatatatatattgttctggcaccaaagagggagaagatgtaagttacagatgcagtctctggcatgaagatagggtaatagatgaggtcaaaggagaacggtttattgagaggatgcagaaaccagaatcctgaaggaatataatggagagggggaaaggttgctctgtgaaattatggctgagaatgaactgtcaagagaaaatctaagagggtatcaagctaaacaagggaagggggaatgtccagaatgaagaagtggtcagtaatgtcctgatttagagagggtaccagtaagatacttgccacataggctgctctaggatactttcaggtgaactccatttagttgaatggtaaggacagaaactagattaaggggttagagaataaatgttaatggtaaagttacactgtgctttttaaatctttgaaggcaaggagaatgtggcaacataatagggattttcatagctaagggaaagtgttaaaatgacaaaagacagtaaatgccttaacactttttctctgcaaaattaggaaagatcaaagatgtggagtcagtataaattattttatgtaaatacatgttggatgagagaatggaggggacatttgaaggaactgacttaacaaggaggagatggatgtttcagtctcttaacactgaaggggagggatggaggaggctctgaaaatttcttgggacactaggaaattaagggaattcctttctacagcccttactcccttctgccccatccacatcaaagcaagactttggatgtggtacaagtcgggaagaatagattgagtaaattatgcagctgttggtgggaggaggaggcctgatcagatagggtaaagtgactttgagatctcaactgagattgcataaaatgaatgcatgtttgtacattttttttttcccagcaggcttcagcagctgggaataatagaacagagaaggtagaattgtatagtaacctctcttgaggatttgtgggacagatacagcaaaacaaggatgtggaggacttatgaatacatttgaatagtaatcccatgaggtttttgtgtgtgtgtgaagtggtgtgtttttagttaagatcaaggaagctggtagagctagaaaggggtaaaaaatgaagagaaaatgagggttagatgtctcagagcaagtaaaatatggaagaaataaatctgtagtcagtagtttaagatattagcatttaagatgtttaaatatttaagcatatcctaagagtggaaaagttttaaatatatatgtttcgtataacttcattggtcctttctttagataaaatatttattattctttgattttattttcatgaggaatggttctgacttgcatgattttgccataatagtcatgaacacacgtgcatggtagggctgatctcttagtattagtgttaatatagttttaattattattgatgaacttgttacacttattggtacctccttaaaaaccatctcttttacctataattctttgttttttttgagacggagtcttgctctgttgcccaggctggagtgtggtagcaggatgtcagctcactgcaatctctgcctcctgggttcaagtgattctcctgccttagcctcttgagtggctgggattacaggtgcctgacttatttttgtatttttaatagagatggggtttcaccatgttggccaggctggtctcgaactcctgacctcgtgatctgctagccccagcctcccaaagcgctgagtgggaattacaggcatgggccactgcacccaaccctacctataattcttattcagtgttttgatttatttccaaaagcagaaagtgtaagtggagagagtcttctttgcaccaaagaattgaccagttataactgaattttagacaaattatgccctcttaactcctcagtaggaaaagagctctcagtcttgagttcttaagctttgttacctggggagctttataaaaacacagaatcctggttccctgactcagagctattgaatcaggattggggcagggcaactttgtaagttcttaaaattctagaaataaaacctgagctaataatgttcagggaggaattttcagtgttctctgagaacaactcaagggttaccttagatgagttttaataatacttttaatatgcttcattatgtttcagttatttaaagaaatgtttaaaaaactaataaagaaatggatacattcgtagaagtggaattgccatataaaggttttttgttttgttttgtttttttgagacagtcttgctctgtcgcccaggctggaatgcagtggcatgaatttcagttcactgcaacctctgccccctgagttccagcaattctcctgcctcagtttcctatgtagctgggattataggtgtgcgccacaagcctggctaatcttttgtttttagtagagaaagggtttcatcgtgttggccaggctggtcatgaacttctaacctcaagtgatccactcaccttggcctcccaaaatgctgggattacaggcgtgagccactgtgtccagccctatatagagatttgcacattctatattgccaatactcattcataattatgtgctttcataaagtatcagtttattgataccagcttattgatcattggtagtcaatgtatgaatgattctccacatgcttatcaacactgggcattatgtttacaaatcattgatgaaaaggcaatttttaatttttttaatcaatgagattggattatgcatgtttttgaatgccttcttgtttttatctttagtgatacagttaatgctgaattctaaatagttgggggagttggggaaggagcccatctcctcctttggtctttctctttcctccttttgcagttatgatcagtaccaactgctgcctcatgtttacattttgtttctaatttgtgttcttaacctttgttccattctaatgcttaaatcaataatactgattctcatttggggccattctctccaggagaatcatactagcagttatcaaagggcattagagtttgcaaatggtcagtggattccttactctctgttgtagtaaatcctttcttacgggaaataagaataactcctaaaggagaactgttaggtaacagtctcagtttagaaataaaatgtgtctgtatgaacgaagaattagaaataacattgtgttagttgcagtgtaatcacatactttgttctccatatcgcatcaagaatattagctttatttttacaaatgacttcatttctaagaaattttttgttttttttaagagttgttcactagagttataaactaagtttgaagatgttactcttgagttgattgttgaaaaaacaaaagatcatatagaggttatatctatacttgaactcaacgttaccatagactggcatatttttgccatcgaattaaactttgagtgcctactatttgctaaataagttaattaaatttttgtaattcaggcagaaaaacaagtagaaactgaggaggcaggagtagtgacaacagcaacagcatctgttaatctaaaagtgagtcctaaaagaggacgacctgcaggtaggattactgatgtttaaatatctgtttggcttgtgattaatattccagtccatttaaagtgttgctgcctcaaatattttggaatgaagcaaataggcaattgattatgtgtaacatacagatttcaaaggagataaacatgatttgtgctctgtttcaaagtatttaaatttgaaataaactttgctttatctctgttatgttttccctaaatagtggtaagagaggctgtggggaggttaaaattatcatgaataatgggtttattttacctttcacttaagagtcgtaagatttcaaaatggagttataatcagagaatgagaaatagcatttgattaaagtcattaatattttaaatttgtgcgttctttattgatagggattttgatttttacagtttgcagctctcttcagcattgcctatttaaaagtattttcttaatttggcaaattggaaatattttggaaaaatcttcgtaaaacaaaaccaaaattgagtgaattttttttctactttttaataggattcttactgaaaatggggggtaagatgagtaatacccagaaaagaaaaaagatttttatttatatattttggagtttaatattgcagtggataaaattaatagtgctagggaaactcagtgaattttgatatgaacttccaaagatatgtaactgcataagtaatataatatgtatatgaatattaaatataagtgctgtttcctattctaaaagttgaattttgtgacattactgttaaaacgatagtgaaaaatgttttaagccctctcagtcataataaggacaaattgaggattactctgtttacctctttataaattttttgttgttgctcattttaaccatggtgggggaggtattattttttcaatttagcaataattgtatctgtaataagctactaatattcttaaatagtatgtatcatttctaatatttatatctgagatttgtatcttaaatagaaactagtagttactgattttttttccatgtgtatattagctacagaagtcaagattccaaaaccaagaggcagacccaaaatggtaaaacagccctgtccttcagagagtgacatgtgagtttatttttaatgtataattatgcaataaatgagacatttgactttaaacaagcacatatctctgcgattttatcagttttctcttacaggatgtttgttattattttgatctttcttaaaattacaggaaaaactgggaaaattttgtaaagtaaaaattggtaaggaatggctatttatcatttcattaattaagactcttgggtatatcaatttatatagatacttagataatacaacataaaatatataatagagaaattgggcaagatggtatgtttcaggaattttagaatatatttgaagtaatgtcacaaatttttttttttttttttttttttttaaagatggggtttcactctgtcgcccaggctggagtgcagtgctgcaatcgcacactgtaacctcaaactcctgggctcaaggagcctcttcccactttagcctcccaagtagctgggaccacaggtgtgtgccaccacacctggctaactttttttgatgagactggtctcatcgttcccaggctggtctcaaactcctgggctcaaacgattctcccacctcatccttccatagtgctggaattataggggtgagccacgtgcctagcctacaaatcttttttttatctcctctagaataggtgctttatttaaaaatagggctaaaataatttttgtatgtaaatttaatttttaaagcatttcagaataactattcagttatccaggaaattgtgcgtgttttttggttttttgcatttttcccttgctgccttttctacttggatcctttttactttggcttttttggggaatctttgccagaaggaatagagagtatatttagacaaagggggagaaaaactttttgtggctattgtgtttgaagatttgaaaggcttaagtggggtatgtctattaagcatagatttacattgttttgaatgaactgattatagaaaattctaattgtagaacactattagagaattggtatgtttcaaccaaaatatgtttaaagagtttcactgccagtctgtatttactttcaaaaatagtggcacataacaatatatcatatacttgaaaattactaagagagtagactttaagggttctcaccacaaaataaaaatatgtatgtgaggtggtatggtaaatagcttgatttagccattccacagtgtatacgtacatcaaaacattgtgttgcacaccataaacacatagaatttttacctgtcaatttttaaaaatagtggcagaaaaatacaacatactttaactattatagtgaaattaagaaattggatacttaacaggtgagttggcagtcattattccctaggaaatctgaaattctgctgggaaaatactgtgagatccctctgttttggatataattagtgttccctaattaggtcccagttttcccccggagtatgcttcccactccgtttgtcttcttggcttttggctgattcctctggaacttctctactttttcagtatcatcctttgttgcatctgaaaaggtcattggaaaatactgccctcctcatcagctgagcagctttctcagcctactttcggaccatagtgatctgagggcccagtgtacctttttaggaacttatcctcatctcacttactttcttttgatggagtctggtgtcacttttggtaatgtaatacttttgtatgtgtgtttaattctggtcagcttcctatgcaattattgttaagacttttctcagacatgctcgtctttttatatttaataacagatactttgagtttataggtttttgtgagaaaccatccctcaggaatcatttgtccatctgaaggattaatgaagtccaattttaattcttaaggattgcagctataccctttattgggtctttgacccaggctatcacccaatttgaaagtcctacatcctcacttgaaaataggctaatcttttttgaacacatctttcttgaacactatcaaattcaccttgatagtcatttcacgctaccagtattctattttgaaacttcttcacccaaagccacaagttgattgaatatattttcttatttctgctgcggtccaacagttttacccattgtataataacgtattagggtttccagtctcccagccctaaagcaagtgactacatgttttaggtttttggtcctggtgtcagtttctctattagtgagctttttcctgaggcaatggacaaccctaaaatagcagtagcctttacaacgtttatttcttattcatgctgtgcgtaggctgagtgtgagctgtaactactcttggctgtgtatctgggcacacactcagtggagtgcagaactaaactgtataagctctttttaaacttctgctcttcaccgttagaacaccatgtatctcttagcgtctacttctttgtcacgggtactgatgtgacacaacagtagaatagagcccagaagagctaaaaaccaactcataatcctcagaaatgtttgttaaagcccactgaagctcttagggttgtgtttgcattagtctttgcttatattaacatatattaaaagattaagaaatttacaaatacaactttgctaatatcccttacctgctaaaaagggaagttgtcacaagtctgtatttcatggaagaaccactgggaaaagactcattggtagcaagcagtgatagtcatgtttatgtaaattgttttggcacaaagattatttcacaccttgaaataatcttttttatgaccttaggataaatttttaaaataaatccctaaagtcactttttaaagaccagctgcatggtatcccactgtatgttttataattcttaagatctatcctatgtatggatagacgattttaaaaacattgtcatctattcttttgtacataatgcaaatatattggttaggatacattgttagaagcagatttgctgggtcaaatggtatttgtatttttaatagctatttccttccatacaggtgtaacattttgggagaagtagttggccagtattgtttaagagacacagaaatgtctttttaaatgggactctagtcccatttttaggaaactgattatcaaaatatttacatcagtggaaatcctgaagaaagcaaatagtttcacttgcatgcttttactttcatttattaaaagtaaaggatggttttaatcccagagaggctaaagttaaaaggataaaaaccataggaccattagaaaataagcatacccaatgataattatataataaaaagtttctaaaggggcaaaagtaaatttcttctcttccaacttaatagttcttaagtggtcagggaatcacttgtctggaaagaggttaatggatttggaattgagatgttgggcttgttatttgaccttttgcatcatcattttctcatttgtcaaatggaaggggttgaactgaatgataggaagtctcttcaagctctcaaattcattgatttaattgaataatttgcgaaaatctcaatgaaattctttggacagttaaaaggttacagtttttaaacggcttattccagcttcaaatgaagtatttatttgtaaaagaattgctttagaagaatatatatcaaccataaaagtaattacgtggttagtatttgcattatttgattctcctagagcctatttctgtagtaccaacttgcataaatatgcagcagtaattaggattattgagcagtttaggtagtttctcttgttttagtggtgtctgtgaaattcagtggtgatgggaatacttaggtgctagtcagcacagcactgtctgaaaacatgcttaattggctatatatttatcatatgcttaagttgggacctttttaccctgcaaagaatatttgagttctaaaacgaccgtatttgatttcacttccgcaattccatttgtcccagtgtgtctactttttaaacataatttattcttacaaatatgtagaatttaagttccataagagccagggatctgcccatcttctatcttctaatttataccaaaaggatgttctgtgacagaattccttttatgattggatagtgaagacactctttttactttgttttagatttgcctttaaattaaaaattatagcttactgatatctaaaatactattatagttgaatgacaagtatacattgttatgttctctaaaatagcattactgaagaggacaaaagtaagaaaaaggggcaagaggaaaaacaacctaaaaagcagcctaagaaggatgaagagggccagaaggaagaagataagccaagaaaagagccggataaaaaagaggggaagaaagaagttgaatcaaaaaggaaaaatttagctaaaacaggggttacttcaacctccgattctgaagaagaaggagatgatcaagaaggtgaaaaggtataaagtttacatatataaaatggctgttctattcttagtttatatatatattttttgttttttctttgttttttttttgtttttttttttgttttttttttgtttgagatggagtctcgctgtgttgcttaggctggagtgcagtggcacaatcttggttcactgcaacctctgcctcctggattcaagtaattctccagccttagcctcctgagtagctggaagtacaggcatgtgccaccactaccggctaatttttgtatttttagtggagacaaggttttgcaatcttggtcaggctggtcttgaactcctgatctcaggtgaacctcccaccttggcctcccaaagtgccgggattacaggcaccacacctggccatttatgtatttcttaatctgcccagtttaagagcttttaatattttggaggaagtctataaatatcagtggcagttaaaatgaatttgtttacctttttgaatagacttgaattagctgtgttacaaagcatattgaaaacgtccctttattatctgttctctaaattcatctattttacaattatgatctggaaattaagtaaacagtacctttccaataaccccatctgtctagaaaaggtagatgaaataggctgtggccagtgaagacaaatgttaaaagaggtggatttatatagagatttttgttatttacccccaagaagttcttaacacccttcaggcctattgtacattttatcagtggtatgtaaatttatttggacgccatagttgttgggaacctcattaaagctgtgtatccttttgtgtagaaaaataaaattttgtgtatagccttagagatttacagattcaggtcatgcaaatcttttgtttactttcatctgatttttggctcatttcttaatcttttagaaaccaaacattttaaattggataggtcatgtagtgtgcttgtcagtactcaagtcaaatcactctgtagagaggcaaacagactgacatactatattttatccaaaggacatcactcctatagcagggcataaaacaagatgattatttcacggtcattaatcaaagttaaacttgcagagataggtgtaattcaaagactatttttaggttgctaatttgagtattcatcccttttttaaaaactagctgctgcttttcccccaagattataattccataagcactagtcactgactttatagttaaataaaaccatcctaattctcaaaacagaagagaaaaggtgggaggaactttcagactgctcacagaaggaatatgctgaaaggccaacatgagaaagaagcagcagatcgaaaacgcaagcaagaggaacaaatggaaactgagcagtaagtatttttttttttctaaattttgggttctttttaaaggctagcatggaatttttaaataatagactttcattttccagactttatgaagccttttgaagaagtgacttttcccatgtgttagaaaaatcttcaatatatgatgatgatcttatttcaggcttcattctcttctgagaggatgaaattgactgaggcagtcactctgtgaattatttttgaatttaaacgaagtgcagataggatttaattgatactggctttgcaagaagtgtactcatcctcaaccatttgtttgtataatataatacatatagatagaggggcgataatatactggtagacaaagaatgcaggaaatgcccttattcatcacaccaccaagcaggcctcaccctaaagaccagcaaaagtaacaaaagcacatttggaaacccaggaagccagtaaaagtaaatctaaaggctgacagggtgtacattattatgtatgtgcaatataaatcaaattcaaagctgttttctcttaaattttgatacttatagagacaggacttgccatggggaatttctttccccttactatataattttattactagaaggaaaagtaatagcaatgataataatgaacagacttcgtgtctttattacatttgctttcctagttacctttagactgtcacttctgagttctttctctgacatgcttttcttttctcgtgaagcgtcttacattctgactaaattttgtttttttgttgttgttttagtgaggtgatttttaaaacatgctctaggtcaataagacaaagttaatgatgagcagtaaaacaattcttgaacaattttgtactttttttctttatataatatatccgtaagccaaagtctttcttgacaagtacagcgttttactctgctttcttagtttggaggatatacaagtagttttagctccttgagggagtaatttaaataacttatctaaagctcaaaaatattattccctctaatgttagactttaagcacttctgtaaatatttaagttattctttgtcacctatcattttctattctatcttttcactgaaaagctgttggactgtttgttgcttttgactttattgtgatctcaaaattaagatataaaattagttgttactagtatatgtagcccaacccttctttagtatcttaaagttatctttatgtatttcagtttcttttgaatgtcctccaatgtaactttctcaaattctaatatttgtgttttctttccttctcctgttattacaaaactttgtacttggacagttttgctctgtaaagcatttcagatgcagcttgtgtgaaatgcattatgcaaaataaagtttattgtattgtattcccagccaaacaacatgtaatctacagtaataaaaaatatatctcattttgggctcaaagcattaatccagttactgaaaagagaatacaagtggagcaaacaagagatgaagatcttgatacagactcattggactgaatttcccccttccccccattgatggaagaatgttccagattctaaattgaggacttcattattaatggcattactgtgttatgattaacaaatttcctgtaaggtacacactacatactaaggtcggccatcattcctgttttttttttttttttttttttttaaccaagcttaaaatgaagctttgtgtttgaaagtaataacaagctcagacgaagatggtggttgtacattattcatctagaaaatataaaaattcattttgttttgaagctagttattaaactggaatagcagttatatccctgagaatggggcccttctcttgacattcctttgttgtttaattctttagaatcttaataaatgtttttttaatcctgagagattaaacagtagtagacttgttaagaatgaaactgtaaccaaaattttaaaataaagttttttttaaaaaaaaaacctgatttttagatattttttgttcttgtctatttgaattggttcataatatggcctgaactctaagccaaggtactagaaattaagatttcaattttaagtggttatttttgtgattgacaataaaatggtaccttttgtgaaatgttagtgaatgttactggacgtcattcaagtttgatgaattggccaaaattttaaaaacagtgttatcttaagtctatttaactttaaagctaacttcagaactcattaatctgcttgttacatgcacaatgattaaattggtctattttaagatgcagctttaaaaaagaatggatgtagaagccattaaacatttataggtgtcatcttcccattgtggcctgtttgtccagtgaccctgaaattgctcttctagcaacacactatttgtgatgtcactgaaaagccagatatgatttaatctagcatgttaattagagttttgcttatatttatgctacggaactgcaccattctaagagctacagtcagttcctttgcagtctaggctattgacttattttaaggaaaacatttttagcttttacatagggattgtgggcatttagtcacaaaattccaatgtgttgaaatatttttgttaacatttgataggcagaataaagatgaaggaaagaagccagaagttaagaaagtggagaagaagcgaggttagttatttcactttctaagatacataaaattatacatggaaaagaagttatatagacataacttttcatgtattggttttggaataattttatactcatatcctacaaatagaatttttcaaatccctaatgggctttatataaattgcattgtattttaagcataatcaagtgaacttgcttgagttgtttatgtttaatgctcattaattatttgatggtgtcaaattttagtacacttgctgaaagctggatgctttcccatttcagacaaatcccttggttaaacataaggaaaagcaggtgtttggggactggagagcagaggagttatcatatgcagactatttattttaggaaaaacgcagccaagtggtggttttgtgcttttacactgcatgttgcttttctcaaccactaaaaatggcaataagtacttattcttagttaagctattgtgcatatctttgagcttcttagtaaagattactaagaacattttttttttaagtccactaattcattatacttagcctgtatatagaaatactggttttggaaaaactgttcactgtttttcacatattttaatttgtagaaacatcaatggattctcgacttcaaaggatacatgctgagattaaaaattcactcaaaattgataatcttgtaagtgtttaacttcatttaatacttcagtactgcatttatagcttcatcttttattttctcacatgatcttatgagtatgtaaatttaagggataattactggtcattttgcactacctctttttttttggaaacgatctttagaaacagattgtttaagtgttaagataattaacagctatgaaattactgttttgtcatgaaggatgtgaacagatgcattgaggccttggatgaacttgcttcacttcaggtcacaatgcaacaagctcagaaacacacagagatgattactacactgaaaaaagtaagtgatttcaagtcatgtggattctttgaattttgtcattacttcatttaaaaattgtttaaaaaatcaattaggaaaacaattatgatgaatgtatattgttttctcagatacggcgattcaaagttagtcaggtaatcatggaaaagtctacaatgttgtataacaagtttaagaacatgttcttggttggtgaaggagattccgtgatcacccaagtgctgaataaatctcttgctgaacaaagacagcatgaggaagcgaataaaaccaaagatcaagggaagaaagggccaaacaaaaagctagagaaggaacaaacaggtatgtggtaaaaagccaacaatttcacaccagtttttaaaccatttgccaggactgcttttaaaaatggctttcatacatagtttcactgtgtatacgccacagaaaaagtatacaaaggcaaaatggtgaaaatctgatgggcctattgaaggactagagcagtgtgcattgagaacaaaaaatcatgtcagtttatattcgacttctaaggcagaaaccattgctcatgaggcagatgactctggataaacaatttttaaaaacccatccatcacaatgcctcctaatccctagagtacccacttcctggttgctcagctgcttctgttttcttctcacctaaaaagtaaaatagcgtacagtagccttttaaattaaaacacagcctcataggtggagactacacctgccattacttgatacaggtattctgatgatgctgctgagttaccctgaacagacttcacagtattaatgccatgtccttttttttttttttttttaaaagatggagtttcgctcttgttgtccaggctggagtgcagtggcgtgatctcggctcaccacaaccctccaccttctgggttcaagcgattctcctgcctcaacctccagagtagctgggattacaggcatacgccaccacacctagctaattttgtatttttagtaggcacggggtttctccatgttggtcaggctggtcttgaactcccgacctatggtaatccacctgccgtggcttcccaaagtgctgggattacaggcatgagccaccgcgcctggtgataaagtcttacaaagcacttagatgtgtagcatatatgtaaggcactgaaccttagcttctacttttttcactaactttagcagtagttaaatcctgctagtacttattactaacagtagttattttcttttcatttgtattaggaaaaatttataacttatacaaatagaaataacttctcatgtccttgtcatccagctttggcagttcagtttatgatcattgtgcttttgtagcccataagctttctctatgcccctcttgaaagttgttttacgaaaaatccctgacataccatttcactcataaacatttcagaatgtatgaaagactcttaaaacagaatcatagtaccattatcagctcctccagtcttgttattaaacatcttagtggcagctgcttaaggtaaaagctggcatttcaaaagcagtcggttggttttttgtttttgttgctttattggggaatgacatgggtccccttagagaattattaatacgacttacaggaaaaccccctttattaggcacaaaaatatcaattaggaaatactcctttagcactttgttctaaaatagtaaattttaaaatttgattcacattgcttttccgtggtagaataaatgaatatgctaagaattacaacaccctgtagtattcctggtaatagtaacaaccagaataatcagattaataatccacttcctgtactcatagatagttaacctgctttttatggtgccttagctacccaaagcctctggtggtcatctgctcccctttttgacaaagccatcaaaacccaattctaacattcaagagagggctgtattacaatgtaatttcaaataaaagacattaagtagtagaaacacgatggccatgttgtattttgattctggatctttagtggacaccttcaattattgttttgtaagctttaacaaagtttttccattggattccttcgcaagggtcaaagactctaaatggaggatctgatgctcaagatggtaatcagccacaacataacggggagagcaatgaagacagcaaagacaaccatgaagccagcacgaagaaaaagtgaggaataggttttaatgggtcttgtgtgttttttattattcaggtttttaatcacagttctgttccaaggttatcttactataataagcagttatcttttgatcacccaattcctgaattcagtaagcaagttacaattcaaaaaggaagaagagtaaaaaccttttattgacagtgactttgccactgaattcaagggaatggaactagctgggaacccagttaaaaagaaaatatttgctcctggactacttttactgagatactgttagtaatgacttgcattcacactttcttgaattgtgaaaggataattgtaaaaagttagatggagaatcacagttttgttgttgttgttttttctttgagacagagtttcactcttgttgctcaggctggagtgcaatggcacgatcgtgctcactgcaacctccacttcctgggttcaagcgattctcctgcctcagcctcccaagtagctgggattacaggcacctgccaccacgcccatctaattttttgtatttttagtagagatgaggtttcaccatgttggccagcccggcctcgaactcctgacctcaggtgatccacccaccttggcttcccagtgttgggattacagctgtgagccaacatgcccggccatcacaggctattttttaatacccaccctaaaataggctatggagccatagttgaagtcttgctttgttccactgtgtatctgaaggagttagatagaagcatcccttctaattctgaaattgagggaaatcttgttgtctatgtgtgtatcaacctctctttttattaagattttgaaatatgttggtatcacagatataaaacattctcatgttctttaaagagaattcacttttatgctagaaatgatggaaagggcttggtccatgacactttgctgagttattttgcttcatctgcatattactttgggaagaagatacaacatggtaaaataacagttttgaagaagaaaaaaataataatgactgttctaataacaagtcaagtttttcttttgtttggttggtttcagtcttttcatgggtttaaaaatataatgcagacttaatgtctttttttccttcatcaggagaaaatcctaattccagttgtacctttcccccttttcttcaggccatccagtgaagagagagagactgaaatatctctgaaggattctacactagataactaggttgacatacctggaatatagagaacacttgagaagtttgtaatggttttcatttgaaatagactgctgaaagttttaaatttttataagcataggtttgatgttgaaaacttgttttgagggagaaaatccctttgttttaaagtaaagtaaacattatcgctaagtgtacttgtgcagtattaacagctacattatacagtaaatgtgggataaaatccatttagaaaatgttaaactgcttttccagacatggttgtagcatattttcaattagtgtgtgtatgttaatgtgtaattgatagtagaacaaagttacatttttaaaactgctacttgtataaaccttgcctcttttcccaaatactgtgggttttgtgcatagtttttacaaaccttggatttaccagactgtcttttcactgtttgtgggttttgtagaagttacacatttttatggtagataaaatgttacttctatacaagtactcactccctttttatcaaaagttaattttaatctcacagtctacattgtgctacattatccagcttctttggaacaatgtgtgctctgtatggttttttttggtatgacaactaattaagcaactgacatggaactgagaattctacaaactataaaacattaatttttgaaggtaatttagttttgtggctgggcattcagtgaagtcttaggacttctttgcagacaactgactgggtatatataggaatgaatctggctttagggttaaatcatttaaggtccttttataggcaggcactagtaactaaaactgaaaactaagtaagtttatttttgaggaatgttgttaaaaatgtctttaggaagtcactaaaacttaattggaagaaaaaatcatgatgcttatacaataaatatgaataaatgttatataaggaaactcacctatttgaaatcatggctatattgtttttattttctagattccaaaaatacaaacactagttgttccagcattgtactttgataagtctgtacattgacgtgtatggactaaatccagggtaaaatcaatgttacaaaatttaagggtatgttaactaaaggatagcatttctaagatattttgaatattagggtcatttggcacttctcagcaagtaggatacttctcatgttttgaaattatatgaatatggaaaaaaatggcttaagaccagcgtctctgtatgacattgtgtggttgaccctctgagataactgttttcatctacagaattgcatttttgcttttaaagaggtcttataatggaactaggaatcaccgttttgagagaacctgcatatataccagtcattatctgtttggtccttatacagttttaacttacttagatttattctagttaagccataagttcaacgtgtaaacttgttttcattaaagaatttttctatca

SEQ ID NO: 36819 - DNA, 30921 bp, Homo sapiens
gcggcgcaggcgcagagtccccgggccaagatggctgcgcggtgctccacacgctggttgctggtggttgtggggaccccgcggctgccggctatatcgggtagaggggcccggccgcccagggagggcgtggtgggggcatggctgagccgcaagctgagcgtccccgcctttgcgtcttccctgacctcttgcggcccccgagcgctgctgacattgagacctggtgtcagccttacaggtgagggcaggttccaacttccgagtggcggtttcagggcctagaaaagagtgagtctcctcgctgtgactacggctgcaggggtagtggggtggagggtgtcttccgacgcggatgcacaattgccggagacacagacaggcaggaggcggggaggccccagtggctgctcagccgtcaaggaagggagagaagcgtggagcccccggcggcggtgatgaaacgccccgtagatcgtgaaccttcacctctctgtcaacatttctggaggccgctgctccctcgtcctcttcctttcccatctctccaccttctagcccgtagcggaagggaagagctaactgccattcggagaggcctaggtactttgttacaacaaccctgcaagatgcctgccgtcatcaccattttaaagaatgagaaactgagattcaacggaggaatcgaccagcccaaggtcatggagttagactagaagagttgtctcaaacccaaagcagtcatgtcatagtttacgctctttctaccacgtggtgctaattgaagggcacagttaacaatctttttagaagtctttagttggtgattgtaataataacacagtcagacatttattgagcacttactgttggccaggcatggttttccccttacatcacatttccacatgataggcactgttattccattttataaagatactgaggcttagatgttaaaccacttataaatgtcacaaggaggtggaggcttgatatcattgcctgagatgacactgaattatacattaagccttgaagtgcttagtcatgttttcttttcttttcttttctttttttttttgaaactgaatcttgctctgttgcccaggccggagtgcagtggctcaatctcgactcactgcaacctccgactcctgggttcaagagattatcctgcctcagcctccccagtagctggaactagaggcatgcgccaccacgcctggccaatttttgtatctttaatagagacgggatttcgccatgttggccaggctggtctcaaactccagacctcaggtgatccgcctccccttggcttcccaaagtgctgggattacaggcgtgaaccaccgtgccctgcttagccttcttttcttatgccgtgtgttttgtgctgtgtgttgtacgtacctgaattgtgctagttttgtgtcctctagaatttgtgcaaatggtatttaagctatctataaatttataaagattaattaaagggccctgacaagataatttataccaactaacttcctgttgcaatccagtttgtaatagttacatagtagacaatcattaaagtatcagtaattgtggttacttcatgcaatgtaaagaaaagagcctgggcttcaggggtgaacttccccagcgtctgtgagcggggtgtattatttaaccccttcgagcacctgtctgaaaattcattcattcacaggtgttaattgaggccaattgtatgccagccactgttctgggcactgaggagatggcagagaacaaagagattggatgtgtgtttggttaagagaatgattatttatgtatttaattattttttaagacagggcctcctgttgcccagactggtgcagaggcacaattacaactcagtgcaaccttgacctcccaggttcaatcgatcctccatcctcagcctcctgagtagctgggactacaggcatgcaccaccacacccagctagttttctgtagatggggtttcaccatgttacccaggctgggctaaagtgattcccttgcttcagcttcccaaagtgctggggttacaggcatcagccactgcacctggccaacagaatgaattttttttttttttgagacggagtctcgctgtgttgcccaggctggagtgcagtggcgctatctcagctcactgcaagctccgcctcccgggttcacgccattctcctgcctcagccttctgagtagctgggactacaggcgcccgccaccacgcccagctaattttttgtatttttagtagagacagggtttcaccgtgttagccaagatggtctcgatctcctgaacttgtgatccacccgcctcagcctcccaaagtgctggaattacaggcttgagccaccgcgaccggccttatttttattttgagatggactcttgctctgttgcccaggccaaattgcagtgatgtgatcctggctcacttcagcctcccaagatgctgggcttataggtgtgtgccaccatgccaggctagatttttcaacatgagcaaaagtggccatttttagagcttgctaacattttctaatgtcaaggttgttttaaatagaatctggctgcatcttttcattcaaatattaatccttaggtgacttgttttattaagccaaatttgttcatgttccagctgtacaaatttgggagcactcgttattattgtgtatgtgaaagagagaaacaggcactaaacactaagctttgtgtgaagctgtgactaaggaactgcggttagctgtcttgttccccaagtgagctcataacctgccatgggcaagttttatatcaggtagtgtacacaggtgagaggtggcatccttcagggtacgtgctgttttcacagatagagtcatcaactggttgggcggggtggctcacgactgtaattccagcgctatgctggcgctgaggcaggaggatcacatgagcctagcagtttgggaccagcctgggcaacataggcagatcccatctctacaaaaagattttttttttttttttttttttttgagacggagtctcactctgtcgcccaggctggagtgcagtggcacgatctcggctcactgcaaactccgcctcccgggttcaggccattctcctgcctcagcctcccgagtagctgggactacaggcacctgcaaccgcgcccagctaattttttgtatttttagtagagatggagtttcactgtgttagccaggacgtctcgatctcctgacctcgtgatccacccgcctccgcctcccaaagtgctgggattacaggtgtgagccaccgcgcccggccaagattttttttgtttgtttgtttgagacggagtcttgctctgtagccaggctggagtgcagtggtgcgatctcggctcaccatgatcttgactcaccgtgatctcggctcaccgcatcctccgcttcctgggttcaagtgatcctcttgcctcagtctcctgagtagctgggactacaggcacgtgccaccactcccagttaatttttgtatttttagcagatactggatttcaccatattggccaggatggtctcgatctctttacccatgatctgtccacctcagcctcctaaagtgctgggattacaggtgtgagtcaccgcgcccggcctacaaaaagatttttaaaaattagctgactgtggccggacatggtggctcacgcctgtaatcccagcactttgggaggcctatgcgggcggatcacctgaagtcaggagtttgagaccagcctgatcaacatggagaaaccccgtctctacaaaaaatacaaaattagccaggcctggtggcgcatgcctgtaaacccgggtactcgggaggctggggcaggagaattgcttgaacgtgaaagtcggaggttgccgtgagccgagttagcgccattgcactccagcctgatcaacaagagcgaaactgtgtctcaaaaaaaaaaaaattagccaactatggtggcaactgcctgtactcccagctgcttgggaggctgaggtgggagtttcacttgagcccagaaggttgaggctgcagtgagccatgatgatgccactgcactccagcctgggcaacagagtatgactctttctctaccaaaaaattaataaagtcatcaactgagaagccatgtggtggcgagcctctatagtcctagctactcaggaggttgaggtgggaggattgctggagtccaggaatttgaatttggcctaggcaacataatgagacccctgtctcttaaaaaaaaaaattttgaaaaggtcattaactcagcgtccaaacactagtctgtgatcttgtctcaaatctagtagtaagatgacataacaacattttagatgtgacttttcttccaagcagaaagaaagcagttgttggtggccaggtatggtggctcatgcctgcaatcccattactttgggaggtgggttgatcgcctgaggtcaggagtttgagaccagcctggccaagatggccaaagcttgtctctactaaaaatagaaaaagttggtcaggcgtggtggcgggttcctgtaatcccagctactcgggaggctgagacaggagaatcgcttgaacccaggaggcagaggttgcagtgagccgagatcgcgccactgccctccagcctgggcaacaagagccaaactccctgtcaaaaaaaaaaaaaaagaaagcagttgttggacagtgggttggccattcttagaacgacttggaggcttattttattctgggttgttctaaaaaggacaggacatttactggtcatatgtgataaaataaatagtctattaaatgaaatctaattattgttaatcattgatgccctatggataatgtcaaaagtcatcagactggggatggtggctcatgcctgtaaccccagcactttggtaggatgaggccggcggatcacttgaggtcaggagttcgagaccagcctggccaacatggtgaaacttcttacctactaaaaatacaaaaattagccaggtgtggtggtgtgcgcctatagtcctggctacttgagaggctaaagcagaagaatcgctcgaacctgggagatggaggttgcagtgaaccgagatcacaccactgcactccagcctgggtgacagagtgagactctgtctcaaaaaaagaaaaaacaaagccatcagtcttgtaattaaacgtgatttgtctttatccacatgcagttttgtgcgttactatctctgtactaactcctgtccgtgttctctgcccgtaatgttgaagccacagctgccacaggtcactaccagcctccgccttgtggcattggaatgagtggtgagagagaggctggactgggccgggcaaccccttactccgaaataaaaagagggttgagtacaagttcaataataagtcaggtctagtgttttctcaagtctgactgaagaaacacaaagtggtctcctgacccctactacttccagtgtgctttttgtatcccgaggatattgggtgtgccaaacacacggatttatttcctatttctaattttaagtatcctgaccattcctatccattctcctgtctgatcatcctttacctggcctcctacttggatgtgctcaaccaacctctggttgtgttttgtgctgattaacttcgagtagtctcccaggcttcctagagttgtttctcttttttttttttcaggtggagtcttgctctgtcgcccaggctggagtgcaatggcgcgatcttggctcactgcaacctcagcctcccaggttcaaacaattctcatgcctcagcctcccaagtagctgggattacaggcgtgcaccaccatgaccggctaatttttgtatttttagtagagacaagatttcaccatgttggccagcttggtctcgaactcctgacctcaagtgatccacccgcctcggcctcccaaagtgctgggattacaataggcgtgagccaccttgcctggcctagagttgtttctcatgcaaacctaatgggttctttgtttaacatttgcagtggctccctattgctcttaggataaaatccagactccttagcatagctctaaggcccttcctattcctaggccccattaatcgttatcatctctaaccaccactaccaccactgccatctagtttagttataggtataaatctgtatggattcaaagtcctctttagcctatttctgtctctctctcttttttttccatgtcataagtttatttacaaacatctagtatgtcatataagttcaagtctttgatccatttatttatttatttttaatagagacagggtctctgtgttgcccaggctggtttcgaactcctgggctcaagcgatcctcacgcctcaggttcccaaagtgctgggattacaggcgagagccactgtgcccaggcttatttttctttctttttttttttcttttttttttctgtgatggagtttcactcctgttgcccaggctggagtgcaatggcgcgatcttggctcactgcaacctctgccccccaggttcaagcgattctcttgcttcagcctccttactagctgggattacaggcatgtaccaccacatccggctaattttgtatttttagtagagatggggtttctccatgttggtcaggctggtctctaactcctgacctcaggtgatccgcccgccttggcctcccaaagtgctgggattacaggcaggagccaccatacccggcccggcttattcactttttaaacagatttcatctattaaaacacctccagtctgggcgtggtggcacacgcctgtagtcccagttacttgggaggctgaggcaggagagtcgcttgaacccagcaggcggaggttgcagtgagccaaaatcgcaccactgcacgccagtctgggcaagaagagcgaaactccgtctcaaaaaacaaagaaacaaaaagcctgccgggcacggtggctcacgccggtaatcccagcactttgggaggtcgaggcaggcggatcatgaggtcaggagatcgagaccatcctggctaacacggcgaaaccccgtctctactaaaaatatgaaaaaattagccgagtgtggtggcaggcgcccgtagtcccagctacttgggaggctgaggcaggagaatggcgtgaacccgggaagtggagcttgcagtgagccaggatggcgccactgcactccagcctgggcgacagagcgagactccatctcaaaaaacaaaaaacctgctcttcctatctgttaagtggatgaactaaaacatccttgtttcttaagcagttggtgtcttgctattaaaaaaggtgctgtgaatccagatccaaagtacaaagtcatcctagttagtaaccgccatttgttttccactgaaagtggcaaatgctttcctgggcagcttagccagtttctgcagcttaacagctgatgcctagaagttcttccccgaccttcttagattgatttgtcattggttctcagcaggggacacttttacttcccaggggacatttggcaatgcctggagacggggagttctctactggcatctagtgggtggagacctcctgagtttctggtgaatgtctggagtagggcttgaacatctgtgttttcatcagtctaatgatgctgttggtccagggagcgcagtcttgagaactgctccttaagtagatacccaaggctgcaagatagagggaaaagaatgtggggagttgttaagcattaaatgtgacagaaaaatatgaaaatatgaaaatacctagcaaatggtaagtgctcatgtggcataagaggggggagctgaatccctttttaatcatctcccagtcaggagtattattcctttagtggtttactgagaccactccagtagtataagcgaggagaatcagcctcatccaatactctgacatagtttaatattaattgaatactgtggcttccttagccattattgaagtgcattagggaacagccctaaagctgtagcctgtgtattagtctgttctcatgcagctaataaagacatacctaagactgggtaaattttaaaggaaagaggtttatttaactcacagttcagcacggctggggaggcctcagcgatcgtggcggaaggggaagcaaacacatccttcttaacatggcagcaggaagaatgagcaaaagggtgagcccctcataaaactatcagatctcatgagaacttactatcgcgagaccagcatggaggtaaccgctcctgtgattcagttacctcccatcaggtccctcccatgacacgtggggattatgggaactaaaattctagttgagatctgggtggggacacagccaaaccttatcagtttgtttgttccttcacagatatagcctggtgggtcatgtactcacagttttcttttgttgagaacattcccagagtgattttctttgttttttcctttttaggaacaaaacataaccctttcatttgtactgcctccttccacacgagtgcccctttggccaaagaagattattatcagatattaggagtgcctcgaaatgccagccagaaagagatcaagaaagcctattatcaggtctgtatggaagtcaggttttggtgaccaaattgtagtaggaatgttgttgatcccatgtgatcctgatcagtacagcgtatgtgcccatatgaataggtctcatgagctgatagtatagaagggtgtgataaagctggactttgctagactgtttttcgatgcacaatgctgtagaggttggtgcttcagaaaaaagaggtgagtccaaaccagagattttaagaagtttttttttctagagctgttttcataattaaatttaatctgtattttctgaatcagtagatatgctagtctaagttttaggtagttattttttgcatccagataaaagtttagaggtttagaattacttcctttcctttcttttttttttttttttttttttttttttgagatggagtctcactccattgctgaggctggagtgcagtggcgcaatcttggctcactgcaacctctgcctcctgggttcaagcagttctcctgtgtccgcctcccaagtagctgggactataggcacctgccaccacacccggctaattttttttgtatttttagtagagacgcggtttcactttgttggtcaggctggtcttaaactcctgacctcaggtgatccacctgcctcagcctcccaaagtgctgggattacaggcgtgagccaccgcgcctggccctttcttaacctggaaaatgtgaaattcccattgtatcccagggtctattagggtagttagggtagctgagtaaagttgtatacgagatgtctacaccactggttcctagacccttggtttgctctgaccaacaaaataaaatcaatattggaggcaccattgtaggattgacagctttttataagtgcacagttcactggagttgtgcacctgtcaccacagtcaactttaggacattttcattacctcgaaaagaaactctgtattcattagcactccccttccattgtcctctctccccggtccctagcagctgctaatctgcgtcctgcctctttggatttgcctattctcaatattcatatacagggaatcatacaatatgtatccttttgtgtgtcttggcttctttcattcacataatgttttcagggttcatctgtgttatagtttgtgtcaatacttcatccctttttatggtcaaataatctgttgcatggattaatcacattttgtttattcatcgtttgatggacatttggatattttccactttttgctatcatgaacagtgctgctatatagacattcatatgtaagtttttgtgtagacatgttttcagttctcttggatatttaggagtatagttgctgagtcatatggtaactggatgtttaaccttttgagaagctgccagcctttttcaaagcagctgcaccattttacattcccaccagcagcatatgagggccatgatttctccacatcccagtgaacacttaactattatcgtctgtctttttaattacgaccctagtgaataagaaatgctatctcgttagagtttcgatttgctttttccctgatgactaatgatggtgagcatctttcttgtgcatgttggctattagtatgtctttggagaaacgtgtgtttggatccattgcccacttttaactgggttgtcttttttttttaattgggttgtaatggaatgaacagaggcatggggacaggaagcagagatcctggcctgtgaagagcgaatggcctgtctcttcctgagctcaagagtcaggtgcctgatccaagagtgggaaaagattgaaaagatggaggctgggttggactcacatgacagttgatttgaggcccttagtaagtcccagagacataatttaagagaaagacttaatttagagaaccattcagatttttaggcacggaagtaaaaagatcaggtaaagctgtagcaattactgtattttatttacctacaaaaataattgaaacagcagagacgtctatttattcagtcattttcttccctttttaaaaattttttcttttttcagacagagtctcgccgtgtggctcaggctggagtgcagtggtgcagtcttggctcactgcaacctctgtctcctgggctcaagcaattctcctgcctcagcctcccgagtacctgtgtttataggcgcgtgtgaccatacctggctaatttttgtatttttagtagagatggggtttcgccatgttggccaggctgttctcaaactcctgacctctggtgatccacccagctcagcatctcaaagtgctgggataacaggcatgagccactgcgcccggccccctttttaaaaatttgtttttcttttttgttcatttacctattctaagccatgctgggtgctaagggcaaagatacatcagaatcagttcctgccctcaagttaagagatggatacattaaaacagatcattattattattattttgtggggcggacagaatctcactccgtcacctaggctggagtgcagtgcctcgatctctgctcactgcaacctccacctcccaggttcaagtgattctcgtgcttcagcctcctgagtagctgggaccacaggcatgtgccaccacgcctgactaattttttctatttttggtggagaggggtttcgctgtgttgcccaggctggtgttgaactcctgagcttaagtgatctgcctgccttcacttcccaaagtgttgggattacaggcgtgagccactgcacccagccgagagacaacttttataaagggaacataattatgactggtatttggggttctgttgtatcgggggttttgttgtttctggtatttggggttcacattgtatctggagtaatttatcatgtttttcccttagcttgccaagaagtatcaccctgacacaaataaggatgatcccaaagccaaggagaagttctcccagctggcagaagcctatgaggtaatatgacttcggtgcatgcggtcactgctgttcagctatgtgtatgaatcaaaggttgcattgctacctgggacagcctggtgtgtcatacagtccagtgtgaaggccatgtccctgcgccaagtaatcttgttaagaaaaataaaaaaaaagagattccaggccaagcatggtggctcactcctgtagtcctagcactttgggaagctgaggcaggaggatcacttgacctcaggagttggcttgaccctaggagtttgagaccagcttgggcaatgtagtaagaccacgtctctacaaaaaaaaaaaaaaaaatcaccaggcgtggtggtggcgcacctgtaaacccagctacttgggaggctgagtcaggttcatcacttgaggggctcaaagctgcagtgacccatgatgccatgattgtgccatagaactatggtctgggcaacagaaaaagaccttctctcaaaaaataaaaaattaaaaaaaaaacaaaacaacaacattctaagactaacttggaatctcaatgaagaacaggatccaggccaggcgtggtggctcatgcctgtaatcccaacactttgggaggccgaggcaggtggatcaccaggtcaggagatcgagaccatcccggctaacacggtgaaaccccgtctctactaaaaataaaaaaaaattagccgggcatggcggcatgcgcctgtagtcccaggtgctggggaggctgaggcaggagaatggcgtgaacccgggaggcggagcttgcagtgagctgagattgcgccactgcactccagcctgggcgacagagcaagaccccgtctcaaaaaaaaaaaaaagaacaggatccaataatctgtactaataaagttccccaggtaatttacacttgtagctggatttgggaattcacagttggattaattaattcagcccttattcaatgacatccccttcctccacctcagggcatcactgctttttggggatagaggttattgtaaaagtagaagcccattattgtcctataagaatgtcaatgtaatcagaggacaaagcatacatctctgaaaacagctattgaccccacttccatagttttctgaaagtagacctttttcccagattttttgacaatcttttctttttttttttttttttttgcttaagagacagggtccctctatgttgcccaggctggtcttgaactcctgagctgaagagatcctcctgcctcagcctctcaaattgctaggattataggtgcaaggcaccagacctgcccgactttggccatcctaaaggggttcagtatatataggagctcatatatctataagagtagacagccacgtagaagaacaggctcaactcagtaaatcttttttgagtaaatatctgtcaactagatctaatgaaaagtttatttactagtgtaattttaaaataatatgttcttattaggtaactcaaactaattgataacataactaaacagtcttggaacctgcttctatggaagataagattaatttttttttttttttcaagagttgaggtctcagccaggtgcagtggcttacgtctataatccctataatcccagcactttgggaggccaagacaggcagatcaggaggtcaggagtttgagaccagcctggccaagagaccagcctgagcaatatggtgaaaccccatctctactaaaaatacaaaaattagccaggtgtggtggtgggtgcctgtaatcccagctattcaggaggctgaggcaggagaattgcttgaacccgggaggcatcagtgagccgaagattgcgccattgtactccagcctgggcaacagagcgagactcccaatcaaaaaaaaaaaaaaaagagttgaggtctcactctgttacctaggctggagtgtagtggcgagatcacagctcactgcagtctcaaactcttgggctcaagcagttttcctgcctcaacctcaacttcctgagtagctgggactacaggttccccactgcacccagaagattcaatttttaatggggcgggggggtgttattcttgtgaatgtgtttttccacatggttagttgatctgatgtttctgccaggggcatgagttttggagagtcctaatccaccgtgttgctgacttctgtcttcaagggggatgttattaaacggaccgagcctcagaacctaagagcagcaattccttgggaagggctggaaccaggagataaaacccaccaggaagtcatgaactcccacctgactcctcctctgccagccttcctcctttgcatcttaactgggtgccctaaaagttaccctaggcaccaagctgtcctccacctgctttcttagtccccctccattctaggtggaagtgtcttttcctttggaggaagcgtactcttttctgtttggccttaaggatagtgcctatttttttgagatagtgtctcactttgttgcccaggctggagtgcaatggtgcaatcacggttcactgcagcctcaacctcaacctccgtgctcaagcaatcctcccacctcagcctcccaagtagctggaactataggcgtgcaccaccattcttggttaatttttttgtatttttcttgtgatggggtttcaccatgttgcccaggctggtcttgaactcatgaactcaagcagtccacctgccttggcctcccaaagtcctgggattacaggtgtgagccaccatactcagcctagggcagtgtctttttaattaaagaaaaaaaaagtaagacaaacacataaaaaaaagatacaaagtgagggccaggcacggtggctcacgcttgtaatcccagcactttgggaggctgaggcagacggatcacgaggtcaagagatcgagaccatcctggcaaacgtggtgaaaccctgtctctactaaaaatacaaaaaaattagctgggcgtggtggtgcatgtctttagtcccaactactcgggaggctgaggcaggagaatcacttgaacccgagaggcagaggttgcagtgagccgagatcgcgccactgcactccagcctggcgacagagcaagactcccgtctcaaaaaaaaaaaaaaagatacaaagtgaatactacatttttccttgtccctccctaatccccctttttgaggtagttagtccttattaacagttttgtgggccaggcccagtggctcatgcctgtaatcccagtattttgggaggtcgaagtgggaggatcgcttgaggccaggagtttgaaagcagcctgggcaacatagcaagaccctgtctctacaaaaacttaaaacaatttgccaggactggtggtgtgcacctgtagacccagctactgtggaggctgaggcaggaggattgcttcaacctgggaggttgaggctgcagtgagctaggattgcaccactgctattgtcgttgctgttacttctgttactccggttgttctggcttgcagaaaacctttcgatgaaggtaagggtaggaagcataaattctctacgaggtaatgtcccctgaggagagaggtgaagtgtgaatctgtgaagaatccagggtgcctgtgaggtcaagcgaggatcaacacaaacattttcccagcatgcgcgacggcgggagagttcgtgagacttttggaagcacttcacgccctacacttagcattcagtttggtcatctcatccctcttctaggtgctagtcacaggcccaccccaacctcataggatgtgtttgcacacagggccacttaataaatgttatggctgccttatttgctgtgaactcttgtctgtattcctgggccttggtagacctgggatgcccagtggctctgcctttcactgtaggttttgagtgatgaggtgaagaggaagcagtacgatgcctacggctctgcaggcttcgatcctggggccagcggctcccagcatagctactggaagggaggccccactgtggaccccgaggagctgttcaggaagatctttggcgagttctcatcctcttcatttggagatttccagaccgtgtttgatcagcctcaggaagtaagttcctcacttggaagaattattcaaattttagactaagtatgggtcaaacaaatttttttatcagtttctgtttctcagaaaggcaaggcagcttaaatggagtgatctggaggcagccattttagtagaaaataatttcagtatttgaaaaatcgcataggtagtaatgagtatgtccattctgatggtattcttaacagttgcataatgaggtagcacctaaggctttcagagcccatgagggtgtgagtgttgtctctcatctgctacagtattccaggagagttctgtccggtgggaaggcactgctgatcctctctcatttatgtccttataagacactgtcagagtggaagagagaggggatatatttatgatctaaattatgattgtggatcattcaggctgtttttaagtgccatgtacgagtatttatctgtgaacattttcagtctgttgaaagtacgttttcatttaagtcatacattatctcttaaaaatcccaaagagtagggcagaattcgttcagtgagtcctacctatgcttacttggcagagtgcaagtaagtacagtggtgaaagagtgactgaaaatgtgggccagtaccctcctttccctttagagccgagcgtcagttttggtcgttgcaaacaaaagttgacaggctgtcccttggtttctttagtacttcatggagttgacattcaatcaagctgcaaagggggtcaacaaggagttcaccgtgaacatcatggacacgtgtgagcgctgcaacggcaaggggaacgagcccggcaccaaggtgcagcattgccactactgtggcggctccggcatggtaaggctctgcccgagactccacctcccacggcttgcaccactgactgagaagagctggttgtggcactgctcccagagaacgtatgctgggaattgggggagttggtgaactcagcctggctgtctttcccccgtgaccctgaggagacgagcctgtgctcctctttccctgataccacaggctcagcaaccagagcacagcagctccgggggcggggcgggggattgcatccagttgtcactttcttctttatttttctaacaattgctttggtaattcaaggggaaataatcttttttaaatgtactgttcagctcccaggagtcttcaggtacttctgtagacaggcggtatcatatttttcagtgtcgtgtggtcaagttgatgatctggagtgcagaagtttgtgtgttctagaaaatcagatgaacagattgaggccctgcacctgggttcctaggcagtgtgtttgagtgcacatgcacataaaaaacaagccttaaagagacatttttcttacgcacattgtggtcccagaaccacccatcagtttacctgcgtacttaggttaccatttttcttgtttttatcaggaaaccatcaacacaggcccttttgtgatgcgttccacgtgtaggagatgtggtggccgcggctccatcatcatatcgccctgtgtggtctgcaggggagcaggacaagccaagcagaaaaagcgagtgatgatccctgtgcctgcaggtgggtgcttgggcccgccatgtccaggagcttggagagggcagacagggttgaggctaccacaccgtgtggagagggtggacagggccgaggccactgcactgagtgtgagtgggctcttggtagaagttatggttgaggccctggagccccaggctggaggaggaactggagtctccttgaatctttctgtttctgccagttatccttaaaatttacactttgcatgtcacaatggggagaagagacctgacgtgcctactctgcttcttcctggtgagggagcagcttccaacccccgggctcctctcctctctcccctgtcttagtcaccgaagccatcattgtccctgctgccaccctatctacatcagccccacggatcccacccctcactccatgtctactgttcccttgcccaaaactcactttctgctttcttttttcggttaactttattcatcttggagatcccagcttgagtatcccttccctagctagcctcacaccctcctccctgttcttttttttttcttttttgagacggagtctcgctctgtcacccaggctggagcgcagtggcccgatctcggcccactgcaagctctgcctcccaggctcatgccattctcctgcctcagcctcccaaggagctgggactacaggcacctgccaccacacccagctaattttttgtatttttagtagagacggggtttcatcgtgttagccaggatggtctcgatctcctgacctcgtgatccacccgcctcggcttcccaaagtgctgagattatagtcatgagccaccgcgcgtggcctgctttactgttgtttagatgtctgtttctctagagttgtgagcatttccattgaagagcatgtctctgtttgtagttatgcattagtgctatcgtttggttaacacccatcaccccagtgagaccatgaactccctgaggtactgcctagaccaagcctgaggcaggtgctcagtcatcaggtgtctgtgttgcatctctggaaggttacccatgtgcctcttagataatgacattgttcctcgttaataagaaacaggagtggggaagaagctgtgggttacaagtggatcttgggtggaaagtgctgtgggaggtctcacaataactgctccctttcttttttttctttttcttttctttttttttttttttttaagacggagtctcgctctgttgccaggctggcgtgtagtggagtgatctcggctcactgcaacctccgcctcctgggttcaagcgattctctttcctcagcctcctgagtagctgggactacaggcgtgtgccaccacgcccagttaatttttagtagagaccaggtttcaccatgttggccaggatggtctcgatctcttgacgtcatgatctgcccgcctcggcctcccaaagtgctgggattacaggcgtgagccaccgcgtcctgcctaacttctccctttctaatgtcccttgtaggagtcgaggatggccagaccgtgaggatgcctgtgggaaaaagggaaattttcattacgttcagggtaggtgccctgccccgcacagcttctgttgggcctttcctctcttcgggtgggtgtggctgaggctgctcccatgtaatcaaagcttcacaggaacatgtctcgccattcatgtttctgaggggcacagtggccacctagatgtggtttttagctgtttgttaccttcaagattctgtgccttgtgtggagagaagacaacttcttcaacatgctaacaagttagaaatacaggtcacataaaaatacaggaaacatcttgtgtttttatgataagattgttgatgaggcagtgagtgtgaaagttacaattttacatactgtatacaggggcaaaccttggttttctgagatggtggaaacattaatgaagacaatgccttctactggcaattgccctcctatgtgtacacctgagaaaaacccacacaagcctagcaggcgataggtacaaaggggtgcacaagagtcctgtccatggtagcaagacactgccttcctccaacaagagaatggctcagtgagccgtggtggtcagaggctgctgcagggcagtcggaaggaaagaatgagagctgaactcaagggatgctccaggcgttgcaggtacagacagcagggatggaaggcagcttgccagtggctgtagggcctcagagaccatctgtgtaaagttttaaaacctgtgagatggcattatgtattatttagggacacggaaatacatagtaagtagaagcttgtaggaatgataaatgttaaagtcagggttgtggttagctgaggagggcaagactcaccggtgtttatgatgttttattttattttactttattttttgaggtggggtattgctttgttgcctaggatgaaatgcagtggggcagtcttggctcactgtagcctcagactccctgggctcaggtgatcctcccacctcagcctcctgagtagctgggactacaggcacacgccaccaggcccggctgacttttgtatctttagtaaagatgaggtttcaccatgttgcccagggtggtctcaaaccccagggctcaaatgatccacccaccttggcctcccaaagtgctgggattacaggtatgagccactgcgcccggcctgtgatattttgttacctccactgggttgtgggtatgacatgcttgttatattatttactcttcccttttttttcttttttttttctggaaagagagtcttgctctgttgcccagtctggagtgcagtggcatgatctcagctcactgcaacctccacctcccaggttcaagcgattctcttgcctcagcctcctgagtagctgggactacaggcatgcgccactacacccaggtaatttttgtatttttagtagagatggggtttcaccatgttggcaggctggtctcgaattcctgacctcaggtgatccacccaccttagccttccaaagtgctgggattacaagcgtgagccaccacggctggcctatactttctaataaagtaagatttttttttttttttttttgaggtggagtctcgctctgttgctcaggctggagtgcagtggtgtgatctctgttcagtgcaaacttcatctcccaggttcaagtggatcttctgcctcagcctcctgagtagctgggattacaggggcccgccaccacacctggttaatttttgtatttttagtagagacaaggtttcaccatgttggtcagtctggtctcaaactcctgacctcaggtgatccactcaccttggcctcccaaagtgctgggattacaggtgtgtgccactgtgcctggctaaagtaagattaaaaaaaaaaaatcaaaagccagttttacatttttgtttcccttcacgattgaatggcttgatctgagactgaggaaatccaggcacgcttccatttcggcatttcaagtgtgtagaacattgcagtgttgaaatatgtagaacatgtcattcctgggcctgggatggtgtctccttgttggaaggacagttctttccctcaacactgcactttatgtatggaaggggtgtgtagtttgtcaggtctgagcttgggcctggccaggcatgcagctggtgtttagtctgcagtggacttatcttcacatgcatctgtcatgtttggccttaggtgcagaaaagccctgtgttccggagggacggcgcagacatccactccgacctctttatttctatagctcaggctcttcttgggggtacagccagagcccagggcctgtacgagacgatcaacgtgacggtaagagggtgtgagaacacctttgtcacccctgtactttattgctctttttctgaaatggaaaagaactgaccagtggcctggaacccatgagtgaccagcatgtgggggggcactcacaggggaggacatgaggaattttaggctgctccttgagtgtggaccacaagccacaggccttgagtctataatcgcatgggaagcagttcctggctggcatcactcccacactggttagcggggcctgggaactgggcgcattcaggacacagaagggttcaccctgggttgtgctctctgcacttgcttctgtccagtgtctggctccaagagcagaagactcgggcggtgcatatcccttttgccacagtgatggctgcctgtgtgctgccagcacctgtcccccacctctctcttgacctgcccctccagctcttcccacctccaggccacatcattctctgtattcgcctcagaaccttctccagcttctttgtggggaaccttggggtaacctccatgaaggaggtgggcattttgggccaaggctttctcctccatctgggggctattccctggcttctccagggtcctgtggttccaagggccagggagcgacctcagccacgcaccctgtattggcttttcctgctttgctccctcactcctgcttcctgggctcacttgcccaaactcttgccccctcatcctagtcacaggctctgctctgggcagacccaacttagctcatttccatgtgcttgtgggcgggcttggcccagaaacccaagtggtggttctttttttttttttgagatggagtctcgctttgtcgtcaggtgcacgccaccacacctggctaattttttgtattttagtagagacagggtttcaccgtatttcccaggctggtcttcaactcctgatctcaggcagttcacccgcctcggcctcccaaagtgctgggattaaaaggcgtgagccactgcgcccagcccagtggcagttcttttttttttttttttttttttttgagacagagtcttgctctgtcgccaggctggagtgcagtagcgcgatcttggctcgtggcaatctccgcctcccaggttcaagcgattcccacctcagcctcctgagtacctgggcctacaagcacgcgccaccatgcctggctaattttttgtattttagtagcgatggggtttcaccatgttggccaggaaggtctcaatcacctgacctcgtgatctgcctgcctcagccccccaaagtgctgggattacaggcatgagccactgcgcccggcctttttttttacccaccccctccaccaccgctctgccgagacagagtcttgctctgtcagccagagctggagtgcaatggcacaatcttggctcactgcaacctccgcctcccgggttcaagcaattctcctacctcagcctcctgagtagctgagattacaggtgcacgttaccatgccctgctgatttttgtatttttagtagagacggggtttcatcatgttggccaggcaggtcttgaactcctgacctcgtgatcagcctgcctcgacctcccaaagtgatgggagcgtgagccagtggtagttcttttcaaggaattcctatcaagattgtcttcatgtagtgaaaactttttatttgagcaactggggaccaggggaaaccacagattttctttctttatagatcccccctgggactcagacagaccagaagattcggatgggtgggaaaggcatcccccggattaacagctacggctacggagaccactacatccacatcaagatacgagttccaaagtaagtgccccctaggctgtggccaagcccgcctggtcctgcggtggcactgcccttggagctctgtggcttgggcaggttactgctccctgtaagtcaggtggttcctgcccgagttatctgtctgtaaagtggacatagtagaatggtcaacttctttttttttgagatggagtctcgctgtgtcccccaggctggagtgcagtggcgccatctcggctcactgcaacctccgcttcccaggttcaagcgattctcctgcctcagcctcccgagtagctgggattacaggtgcctgccaccatgcccggctaattttttgtatttttagtagagatggggtttcaccgtgttagccagagtggcctcaatctcctgacctagtgatccacccaccttggcctcccaaagtgttgggattacaggcgtgagccaccatgcccggccagaatggtcgacttcttggagttgttgggagaattaaatgaacaacacataggaattgctttgctgctgctgctattgttgattttcttcttttttttttgagaaggaatctgtcactgtgttgcccaggctggaatgtggtggtgccatttcagctcactgcaacctcctcctccccagttcaaatgattctcctgcctcagcctcccgagtagctgggactacaggcgcttaccaccacgcccagctaatttttgtatttttagtagagacggagtttcactggccaggctaatctcgaactcctgacctcaggtgatctgcccaccttgacttcccaaagtggtgggattacaggtgtgagccagcacgcctggcccgttgcttttcttgttgatgttactagcactgttaggagctggagaggtggcctgggcagagtgctgtgggtacctagggcgggacatgcctgactcccctcgggagcactcatgctttttgttaattagataatttctttttttttttttgagatggtgtctagctctgtctctaggtggagttcagtggtgcaatctccacctcccagatttaagcaattctcctgcctcagcctcccaagtagctgggactataggcatgtgccgccacgcccagctaatttttgtattttcagtagagacggggtttcaccttgttggccaggatggtctctatctcctgaccttgtgatccgcccaccttggcctcccaaaatgctgggattacaggcatgagccactgcgcctggcctaattagataatttcttacttgcttcacatacacactggtaaaatctgtttcccctcctgtaaactgtatttagcatagccacagtgacacttgtttaaatgacttagtgtagggtgttttaggagcttttctgtacagaagctttgagggcatggtccttaggttctcaccgctgcactggctcagggtgtccgcccctgccaaggttgggtccctctcttcccatgtgctgcgagggtgctggctgcctgtgagttctttccaaagcttcccggcggaagccttggctgctgactctgctcggtccacaggaggctaacgagccggcagcagagcctgatcctgagctacgccgaggacgagacagatgtggaggggacggtgaacggcgtcaccctcaccagctctggtaaggagtctgaagactacatggtgacacgtgggggcctcagagccccccagggtatggacaattcagggcagcatgttggggtttccacttcgggttcttcatgaagcctttaaaatgtgcagttgaaagaggggggctgtgggcggggacagcgggcagggagccgcagcccccagtccaagcttcgcctcctctctctgtgtgtgtttctgtgctgaggtgagagcaccagggcacttcctgcaggcagctctgcgtgtctcagacccagtgttctgagttctattcttggttctgccacttgccctgtgacctcggacaaatccttccctgagagctcctggcaaaagcgtaaggagagagcatggattggaaggatttgtgcacttcccacctgggacactccgccaggatttcagagtgtcttaaaacaacagcagccacagcagtggagccgcagtcagcagactccgtccgccgctttagagcaggactccctccaagttatctagccgtgaacagatgcaccatttaccctgagctcagacatcgtgctagcgagtggctgtgttagggatctgtcaccagaacacctgctgtgggcgctgagacaatggcaccccagctgcagcccctcttcccatggggtctggggcctctttcctgggactcctggctcagggcagggcaggctgtgcccaggggtccttggttcaggcggcatgtatttcctcctcattgcatcattttgtttttgtttggatcctgggtggagttctcagaacttgagcagccttagattagtgcatggtaattcgtagcaggtgtttggagctgggggccgattttccaataaagtggaggatttggagctccaggggcaggggcaggggctgggatggaagtccctggaatttcactgagctcctgttgctcccaggggactggaattcctctgttaaaaagcagctgccggccgggcgcagtggctcttgcctgtaatcccagcactttgggaggcaggggcaggtggatcacttgaagtcaggagtttgagaccagcctggacagcatggcgaaaccccatccctactaaaaatacaaaaattagctgggtatggtggtgcatgcctgtaatctcagctactcaggacgctgaggcaggagaatcgcttgaacccaggaggcagaggatgcagtgagccaagaccacaccactgcactccagcttgggtgacagtgagactctctgaaaaaaaaaaaaaaaaaaaaaaaaagggcctggcgcggtggctcacgcctgtaatcctagcactttgggacgccgaggagggtggatcacgaggtcaggagtttgagaccagcctgaccaacatggtgaaaccctgtctctactaaaaaaaaaaaaaaaatacaaaaactagcggggcatggtggtgggcatccataatcccagctactctggaggctgaggcaggataattgcttgaatccaggaggcagagggtgcagtgagccaagattgcaccactgcactacagcctgggtgacatagcgagactctgtctcaaaaaaacaacaacaaaaaagcagctgccacaaaactctgtagcccaaccaggttccaaatgtcacttattttaatggtttggtacatatactgtgtatatgtatactatcttttgttcttgttgtatctcttgaactaaaatagaagtggtaatagagtagctattccccggaactctaatcagtgcacctgtggcttctccttcctcaaaccctacaatcacataacatgcgagattggttccatagacagctgtccttccctcctcccgcccatcagggtagcttgaggtgtgctacggccgggccctgggtgggttcgtgggtgttgcttactctgttggaggttgggtattactggtcaccagttgatgttttgaccctctctctgatactgtaagttgaaagttgattccgccacccactgagatcctttgtcacttccatggttacttgtcctgatcactcagcctcactcagctgttccctcactcagccaggatgtcttctcctgtgtgcaagacactgtcagctcttccttttaaagatcttggtgaggccggatgcagcggctcacacctataatcccagcactttgggcggctaatgcaggaagatcacttgaacccaggagttcgagaccagcctgggcaatatagcgagactctgtctctacaaaaaatttcaaaactagccaggtgcaaagtagtatgcacctctatcaccagctacttgggaagctgagatgagaagatcacttgagccttagtactcaaggctgcggtgagtcatgacagcgacactgtactccagcctgggtgccagggcaagactctgtccctaagcatacaccgtcacatgtcagtctgctgcctgtgggtggttaagtctctcattatactgtgaagacagttagttttgcatccacatatgacagtattacaggacatataattctcatgtcctaagaacttaagcaacagtgggatttatttatttatttgaggcagagtcttgctctgtggcccagcctggagtgcagtggtgcagtcatagctcacggcagcctcaaactcctggactcaagtgatcctcccaccttggcctcccagagtgttggaattacagacatgagccactgtgcctgaccagcatagtttttgatgcgtttagtatcttaatgtagctgctgaaaaccttaagagctgaccccggtctcccagaaagaccatggtgtgcttagagactcagcacttgcagggataaacaggtccatcttctggcgaacagagagggaactgggggggcttgcaattactatgtgactttttgagtgagagacacagtatggctccttgttgttctttttttttttttctttttttggagacggagtctcactctgtcacccgggccggagtgcagtggcgtgatctcggctcactgcaacgcactctgcctcttgggttcaaccaattctgcctcagcctcccgagtagctgggactacaggtgcatgccgcccctggctaattttttgtattttagtagagatgggtttcaccatgttcgaggccggtctcgaactcctgagctcaggcaatccgcctgccttggcctcccaaagtgcggggattacaggcgtgagccactgtgcccggccttttcttttttgagactgggtctcactctgttttatgtagcctccctcaccccttcccggggacctgtggccccaaactttggacctttcactagcgaaggcaccttcttacttagactgaggcctttactcttttatgcactgtgcgtggcctaggtctctgagcacattaaaaatgagctctacaattaacatgccaagttcaggtctatattctaactcacaacaaaagtgtgcactccttgtctagtagttggcaaatctgtaacacgtttgtgtgagaaagtacctctagatggtgtcagcctgggccctaaagaaattgcagcacagcttccctaggttgagagcatttaggttaggtgccccaaatggggacaacttgctcagggagatagactgctgatgtgagggatgagatggagtgcctgtgacaaaggattgtgcgtggccgtgactcccacatgggctgttctgcagggtctttgcgcacacagcagcatggaatctggccagttggtctagagtagggtttttcttggcagtcattatttaccttcttatagccaacagcatggtggttgagtctcagctttggagtcagactgcatgggctcgcactcagtcctccctcccgcttgttggctctgtggccttgggtaaaccctgtaacctctctgtgcctcctttttttgttttttcatctgtgaaatttgcctgtaaggaagtgtatggcctggcctgggaggtgcctggcacttgactgtgtttttgtcactgttgctcagatagagacagctgtcatagtccgtctctatttcttgtttccctgctgtgggtccttgattgaaagagcagttgggagaccctcaggctctgagtggcctgttcacctcagtcgtctgcaaggtgaggcatcctgtgccatcttaggagtggcccccactcttcttgaggtggcacttggccgcttcttgaacgtgggcccctgggtggccaggcgggggtaggtgggccctgggatgtgactgtggaagtgcaggcccatgacgccagttctttctgctgtttgtgcccaggtggcagcaccatggatagctccgcaggaagcaaggctaggcgtgaggctggggaggacgaggagggattcctttccaaacttaagaaaatgtttacctcatgatatcccagccgaggtaggaaaaccctggaggttttttttccctttgttttcctctgtgaactaatcctggttttctcccactttaaccaatattgtgcccccacccccaggagttggaacaggtgccagtccaaggtgtggtaaacctagctccactaggagctggcctctcagcctagggaatagatgacgtggcaatcagcctgtagtgcaggactggctgggctgccgcggccagcctctggctgtgtcttcttcctggggaggtggcgatgctggggctgttgtacagcccccctgcagtggtgggtccggcttgcccatggtcacagagggcgagtcaggcagagccaggcctagaactcagatctcctcacgtcctgcctgcttggaagctgccctcctgcgtggacagcgcagggctgtgcaagcctgggggctgctccaggggtagcgcttgctcgccgtgtcatcttgggacccactttggtttattatgctcatctcagcaagtggggttctcgcccctctcttggcacagctgctttccagggattaacagacgctccccacaggggtgtgttcccttgaaatgttgagtataaggtaacagcctatctctttggctcaggaaaaagatccactggaaactaggccgggaagcagcagcccctccaagggccagggcacctgggagacgggaggattccagaacagcagcactgagctcccacccgcagagcctctggacggccttggcaacagcaaaatcatgggacaacacctctctccacggaaaggtcacagtggacagcccgggcagtaggatgcagccccagaggctggtggcagtttcctgtccattggtaggtgacggcccctggctcaggcagagggagatggttagactcttgcagggctaaaactctaatttggaattgaatattgtggatatcttagttaaaggccatgcttacagcttagaaatgaagccttaagctgcatcaagttacgaagtgattaatttccttctcagcaaacctccgggaggttccagaatgagttcttcctgacaggttgtcttcactgggagcgtggggcccccaggccccaccagcaccgtcctcccctaatgaggggccctgccgaggcatcagctgctctgctcagttagtttttattcccggggtaccaagcagctgcacagtcggtgcctgggaggcacgtagaggcccagagagtccctgggggttctgctctgaccgtgtgggtggtgatccttgtcaggatgtacagtccttgctcccaccccatccgggatggccgcctgtccctgactattgagtcctgttgttgtaagccaggcatggagggctcctgcccttctgctgagccacagcccattgcagcactgtgctggccagacttcagctgccttgggaactgaagccctgccactgttgctagtcaggggcttggttctcccacttacactgttgacatctattttctgaagtgtgtttaaattattcagtgctaatcattgttttttcctttgtaaatgttgattcagaaaaggaaagcacaggctaagcagttgaaggttccccaccattcagtgagagcagaacccccattccccagcctctgctggtagcatgtcgcagtttccatgtgtttcaggatcttcgggctgtcgttagacaggttaatgaagaacacttctcaacagtttcctttttgttttcctttataattcactaaaataaagcatctattagtgtctgatttaggaatgtaaaatgattctgtattaatgtaaataagattatctattgcaaaaagatatttcaaacct

SEQ ID NO: 36820 - DNA, 185726 bp, Homo sapiens
attcggctgcccccaaggccaggcatccagtgtgcttagtgctgagcagggtttcagagctcacccccaggagggtgcagacctcagccaaggtcgcagagcagaggagacccgtgggctgggattccacctgtgcccaccctggcagcatcccacctcctgagtcctctcggcacccagcaaggtaggcactctttgcgtctggttttagcggtggggacgcctgggcgtggagagggggtgcggcgtgtcgggtctcatagcttagcggccgagcagaggtttggccctggtctgtctgagtccaagaccctgctgtgtgcccctgccccggaggagccccactccgtttcagccctgaatcaggactagggtgtctgtccgccctgatgtgacacagtgctgtgactttgggtttgtgctttcgatttttagagtagcagcaataacaaaaaacagtagcagatggcttcttcctactgctgcatggggtgggacgaagggcagggggttcagattcttttgttcactcattcataaaaaacattctgggtgccctggccacgggccagcgctcaaggctccagggaccagcgggggacatgtcagatggaccttccctaggggagcttatgccacggtgaggggagtcagaggggtgggctcagtgcctgggcctgctcacatgctgtgtgaccttggacaggttgcttcacctctctgagcctcggtctctaatttgtgaattcaggataaacttggctttttctctgagcaagcaaggatcacacctgtgtccttattctttctcacggcctcacatccaccaaagcttgtgggcacggatcatcctttgcaccggctccagtttccagagaggccctggcaggctttgcattggctcatccaggaaataaccgggagctggtgctgggggcctcaaggaccagctggttttaaggtggaagttttgcctaaggtgcttagagttctgaagggaagtgctggtacccagagtcacgcgtgcagcagctgtgagagggagcgggctgcatgcgggctcttgatgggaaccctgtggatggtcgggtcatctccaatgcccagtcctggctgggcccttgttgcacccgctcaccacctgcccggacatgcagtctgttcctgctcactctcagccttctctcctctgggccttcctcctgctgttcctatgcctagtctgatttttttttgtcgtccttcacctgctgggcttctgctggctcttttttttttttttttttgagatggagtttcactcttgttcaggctggagtgcgatggcgcaatctcggctcactgcagcctctgcctccagcaattcttctgcctcagcctcccaagtagctgggattacaggcgcccgccaccacacctggcttacttttgtatttttagtggagatggagtttcaccatgttggccaggctggtctcgaactcccgacctcaggtgatccacccgcctctgccccccaaagtgctgggatcacaggtgtgagccaccgcgccctgcctgctagttctttaagccgctgctggaaggcatccttctctagaaagtcttcctggctgcctcctgttcaccgcaggccaggcggacccacggccccctcagtgccatctcaccctgggctctgctcatgcctttgggccagcgcttgtcatacagagcttctctgccctgttcccaggtctccccgacagcctggggctgctctgtgtgattcatctctgggtcccagggctcagctgggggctggcacagagtgggaccccagcagcattcgatgaattgagagcacgagtgagcgacagacatcagggcacctgcgttaggggacaggaggaagcctgggatgatggatggtcagctggacagtggaaaattaagatttctggggccttgaaagagactgccatgggagtcagtgccttggggggtcaggagcactggcctccaggtctgagcctctccccttgtagctgagtgaccctgagtgactccccactctcctaggcctcaggagatacgtgcggccaccccaggtccattctgcaaacgcagcatttattcatgcgagggaggcaggcaggagcaggcttgtgttcttaggatgctcacagtggtgtcccacaaacacacagacagaaaaaagacctaaatgaaatgtaccgagatggggagcagtaatttctttggtggtttgtttcttcttccatcctttttgtatttttcaaatttttagagtcccttcagtgacttcgagcgtgcattgagagcccagtaacactggggggcaactgccacaaagacacagcctcagccaggcgcagtgactcatgcctgtaatcccagcaccttgggaggccaaggcttgtggatcacctgaggtcaggagtttgagaccagccggaccaacatggagaaaccccatctctactaaaaatacaaaaaaattagctaggcattgtggcgcatgcctgtaatcccggctactcgggaggctgagggaggagaagcacttgaacccaggaggcgcggttgcagtgagccgagatcgccccattgcactccagcctgggcaacaagagcgaaactccatctcaaaataataataataacaataatagtaagactcagcctccccgctctgggacactcagtctgatggggcaggctggtcagaagacatagagccatggtgtgtttggaactttcacagagggaagcctggggctcgggaagcccggaaaagatgccggcgcagcctgagggcttgtacaggtgccactgtgccgaagggtggctacgagggaggcaggtgtatgggtgagggtgagtgcagtgtggctggaggcttagggaaaggtgagtaggacggcgagagacccacggggaatgagggctggacctcagcctgagtgagtgtgtttggtggggtgagcagtgatgtcagtccctcctgggagctgctgtgatttggggctttctactttattcactcaacaaacgtttctcagaatggagggtgctcggggccgtagggcacagatactgatgtggccctttagggtcacagggtccagggttcaagtcccagctccaccactatccagctgtgcaacttttgacagtttgctgtacctctctgagtctcagatacttcatctttgaaatgggcagaagagcacctgccccgtggcttcctgtgaggatgtatagaaaatgctggtccagctcctggaatggcatgtccctcccccaccctaaagtgcacgtttagtggaaggaaaggggggatggggaaggatgggggatggggacagaagtgagcatctgaacctaacaggagggctggtccctgcctggtggggcagcaaggggtcctgccacagcccagcgaggaggtgggcatcccagagccgcagcagtggcagcgctgcctccatggaggtcccacagcaggactcgccagcctttgtcctccccaccctgggtgcccgactttcccatggaagctgctgcatcttcccatgcctgcccaccacagcaggtgggctgggacgtctctctgagctgcagatcccctggttgggagagtaggggacggacatctggcctgagacccccccacacacaccagggcaggttcctggctccctgccagagcctagctgcctgcctagaggctcagagtccccaagaactcaaggtgacacagtggtggcagtgtgtgacagaggaaggagccaaggtgggatttgagaacctggggcagggcagggcagacctggggcacaggctgcgggacccggacagagcagggtcggactacaatgtggtctccacattcatgcatccatcatgcagctctcactggaccctggcattccagggccacgattgtctgccagactagcacggcagcggctctgccttcctcaccctactgtgctgccagtggttcctgtgtctcttctctctcggcccctgcatctgcagagctgaggtgctgatcctcctctcctggcctctgtgtgaggctcaaatgacaccagcccatgaagggctcagcacatgcctgccacatagtaggagtctgcaggatgatggctgttcacccggagggccagccttcctttgactgggttcctgggaactctgggaagtgctttgcaaaatgttagttaaaaaaaaagtttgggaggccaggcgcagtggcttatgcctctaatcccagaactttgggaggccgaggcgggcagatcatgaggtcagcagtttgagaccagcctggccaacatggtgaaaccctgtctctactaaaaatataaaaattagctgggcatgatggtgggtgcctgtaatcccagctactcaggaagctgaggcgggagaatcgcttgaaaccggaaggcagaggttgcagtgagccaagatcgcaccactgcactccagcctgggcaataagagcaagactttgtctcaaagaaaaaaaaaaaaaaagtctgagaaacatccctttttgaagagtccagcagacagtgcaggcacagctctggggaggcgaggatggctgttgaactttgtttgactctgtgttttccagccttatgggaccaggggccctgctgggaaagagcagccactgagtcccagggggacacctgtgccttgtgtagctgtgcagagggtgctgtggggctcacggagggctgaggcaggagatgatgtgggcaaactgccctgttcagaggtccctgtggccacagcctggagggcaggcaggaggaggaagcccagccacagggaggccaatgtggaagggatgctgtggccagagccgtggcctgagagcacagtggctggagggaggagccggcaacagtaggaatctgcagggcctgggagacagcacagagggaacatgctccacgcggccatggacctgcctcaccactggcccactgagttacaaggggcgtggccagcagagctgagatgtcctcaggagaggagccagcccaatgaggcagggaggcctgcatgctagggtcaaggttagccacactcccttgctctgctggccccaaagctgagaggaccctccagggaggcctctggccacagtgccgggcagattatgggaaggcagtgtcacggtcactgagctcaggtgaatttcctccttacgtgtactctaatacaggggatgccataggcagacggtggagagaatggggggaggaggaaggggatggggaggaggcccatccaggccccagccagagctcttcatccaccttccaccgtggctgtcagctgcctggacatagcctctggtgctgggctctggattccaccatgtccccgctggcctctctgtgcccataggtgaaatgaagaccccctgcgcctcacactctgccttctcacagagcaattatgaaagcctggtgaagacatggaggccggcacggggtgactgatttggccaaggtcagatttgaatccggcacttagctcaggcctggcccataggaggttctcaagaaacacttgagttaaaaggaggctgcagatggctctctcgacacgggaatgtcgcagagacaatcatggtacctggcgtgtggccagagctgagtagctgctaagccatgttataattacaggagtcacctaaggaaattgccgctctcattctgcagggccgcccaaggcctctctgagcccactagggaatgtgcccactgtagcgggaggtctggacagtactgtcctctaaacgcagatgtgtgtgtggtggggcagggctacagagaagactttggtggattaggttactccaagaagggttttgcaggatgaataggagttggccaaccagaccaggcttaagggaagatcatcccaaaataagtgaagggtgagcatgtggacatgaactgagcctgacttccaaggacagagccttccaccaggaagctggcctctgctcccattcactcaggaggtttcaaggaggcccctgggtcccctgcctctcctctcagaccctgggagctgattgctcaggctgcctgcaagaagctgggagcttctaactgcatggccaccctctggccttatccctgcagtgaagccctggagagccccttcctgtcatctgccccttgagtctggggaaatccaagtgggccaagccagtgcttggggagcgacagagtttgtagtcgagatagccacccaccttgagggccacctggcagccccagctcctgaggaagaggcttcttgccttggcccccaccccatctgccacccacacccagaaccacaagacagagggcccagacctaggttactcaaaaccagaaactgccgagaagatctgaatgaggagcccccttggggccagggccaggtggctgggcaaagccttcctcccacgcccagcaccccgaaggagggcaggggctggggggagccagccaggagactgtgtccaccctcccaggccaccctgccttaggccccaacaaagggcaactcatagacccttggggacctctgaatcaggtcctctgattggcctcagatccagtccctctggggtcccaagccctggctgcagagtcaccccctctctcctccccatggctcattagctacatcctaagcctcagtctccccatcagtaagatgagaagcctactcgcgagccacccggggaatggaagcagcttccacggatgaacaactgtgtccacccctgtcatccttgatagggttcatggatggctgaagaggggccagcccaatcctttgtcagaagccctagcccaggaacaggggctgggcccctcgcaggggttggtttcattggctttgactgcagcgacaggtagggtgtgtcccccggactgggtgggggtgtcgaaaccaggacttccagaattgattgagggtccaggagggcccgggccagaggggtgggctgaggaggggcctggggcttttcagttaaacaagccacctgtggccaccccagcccccaccccagtgcccacagagcctgagctgtgagcccagtgaggccaggagctggaagccagtctgatccagcctcgagagtggtagaaaatgtgctggtgatggccaggcgcggtggcttatacctgtaatcccggcactttgggaggccgaggtaggtggatcacctgaggtcaggagttcaagaccagcctggccaacatggtgaaaccctgtctctaccaaaaaaaatacaaaaattagctgggcgtggtggcggcagctgagtagttccagctactcaggaggctgaagcaggaaaatcacttgaacctgggaggtggaggttgcagtgagccgagatcgcgccattgtactccagcctgggcaacagagcgagactcaaaagaaaatgtcctggggatgatggggaaggggcaaagagcactggggaccagggtcaggatgcctgagggtcacctcctacccgcggtccaactgcctgtgctgcctggtgttgcccagcttgcacccgcccccagctctctgcccagggcactgttgtgaggttaggggcagacagcgggtgtgggtgcagagcacagggccgggctgatgtcagcgtccacagtaggggagcagccccttcctgtcgctctggtctgtgctccacttggccgtgctgggtgaggtcatccttccaggccctggtgaaatgtcatctctggaggctcaggcgtcctccctcctggggattctggagcctccctttactgccctcttgtggctctcaggggaagggaagtggcagcccgggactcagggcccggcacgaagtaggcgctcctggtggccgctggggttactgaccgtgggaagcgtgtagctccagagtcacagctgggctctgatttcagcccttccactcactcaccctacaacccgggcaagtcagctttccctcggagcctctggttcctcttctgaaaaatgtgggtggaaattctggcctgtaggtctgccccaggtcggagggtagatgggtacgcagtgccagcacccagtagggcctccgtgagtgagcatgtgtcctttaccccatgcactgggacagtcctgctctgctggtgaccctacatatcccactcctgtgcaaggcctcagtctcaccatctgtaaaatggacagtggagattagaatggacagagcaagaccccatctcaaaacaaacaaacaaaaaacgatttctcctctgtctggaatagagccatgtgtatttaatcagaaaaatgttttccctcctccaccccaaatctgtggatgctccatagagaagggccatgcttatccctcagtttctccttaaggtgggagccttgcgctttcagagaagccagtgaaagccacacccctctcgccagtgaaagccacacccctctccccagtgaaagccacaccctctccccagtgaaagccacacccctctccccagtgaaagccacaagctctccccagtgaaaggcacactcacagccaccgtgactctgccaggcgtgggctgtggtgcctgacaccctctcagacatgcccaggcacatgctggagttgctcagaacttctacacagaatcccaagcaccaagggtggggctggaatcaaagccgagatacgtgatgccccttccgcctaactttgtccccttctaacccagatagtgcccagaaagatggttccacttgcaggccctgtgcccagggccctggcttccgtggtaccatcctttctccctgggggagcaccgtgatgatgccacacatcagaagttcccctattggggcccggcatggtggctcacgtctgtaatcccagcactctgggaggccaaggcaggcaaatcccctgaggtcaggagtgagagcaggctggccaacatggtgaaaccccgtttctactaaaagtacaaacattagccaggtgtggtaacacacacctgtaatctcagctacttggaggctgaggcacaagaatccttgaacccaggagagagaggttgcagtgagctgagatcgcaccactgcactccagcctgggcgacagagtgagactgtctcaaaacaaaaagaaaagaaaaagaagttcccctattgggcacctggctttcacaacatcttgttctattcttgtgtttttgttgttgttgttgttgttgatttttttgagacagggactcgctctgtcgcccaggctggggtgcagtggcattaactcggctcactgcaacgtgtgcctcccgggatcaaaagcttctcctgcctcagcctcccgagtagctgggattacaggtatgtgccaccacgcctggctaattttttttatttgtttgttttgttttgagatggagtctcgctctgtcgcccaggctagagtgcagtggctcgatcttggctcactcactgcaacctccacctcccagcttcaagcgattctcctgcctcagcctcctgagtagctgggattacaggtgtacaccaccacgcccagctaatttttgtatttttagtagagatggggtttcacaatgttggtcaggctggtcttgaactcctgacttcatgatccgcctgccttggcctcccaaagtaatttttgtatttttaatagagactgggttttgccatgctggccaggcaggtcttgaactcctgatctcatgatctgcccacctcgacctcccaaaatgctgggattacaggcatgaactaccacacccggcaaatacgatatttgattccttcttttacatctttaattatgtgaggcaaatttaattttacagtctcctccaatggtttctcgggaatttccttctggtatgtgtggtgtttgcttgtccctccctcaggctggtctgtttctgtgtgttgtgtaatttgggatcatgagtttatctccagcaagggctttatctgtgagaatcccagctcgtgggcatgcctcccagagcattgtttattgttgctgatatagaacacttgtacatacttttggggtatgtgtgatattttgacccctgtacacaatgtgtttgatcaaatccgggtaatcgggaaacccatcgcttcaaacatctatattgtctttgcatttggaacattacaattcttctagctactttgaaatatatgataaattattgttaatgatgatttccctatccagagcgttttataattgctctcccaagcagcctacggctgtcacaggcctggggccactttctcatcggttgggttaggctttataaatacaaacctaatcccaggctagagcagacccatggctagagtccctcaggagaactgcacactttttcctacctcaagctcaggaggagtcagacaagttttcttgtcatctcttattgtcagtgggtagatctttttctaggctacattttattaaggttgcagctcctcaagccctctggtgttctgtggagaattcagtttcacctcccagcatcctgcttgctccgcgcctggtctcctggctgctatcacagtttaataaaccctccgtctcaacaccctctctccacccccacaaggctgccacactttcacttaatgtctgaggttgtgttttgttttgttttgagatggagtctcactccgtcgcccaggctggagtgcattggcgcgatctcggctcactgcaacctccgcctcccgggttcaagcgattctcctgtctcagccccccgagtagctgggactacaggcgtccaccaccacacctggctaatttttgtatttttagtagagacggggtttcaccctgttggtcaggctggtctcgaactcctgacctcaggtgatctgcccgccctggcctcccaaagtgctgggattacaggcgtgagccaccgcacccggcctgagtttctagtttaaaacattttcctagccgggtgcagtggctcacacctgtaataccaacactttgggaggctgaggcaggcgtatcacttgaagtcaggagtttgagaccagcctggccaacaaggtgaaaccccgtctctactaaaaatacaaaaattagccgggtgtggtggtgcacccctgtagtcccaggtactggggaggctgaggcaggagaatcgcttgaacctgggaggcggaggttgcagtgagctgtgatcgcaccactgcattccagcctgggctacagagcgagacttcgtctcaaaagaaaaaaatatttcctgcaatgttactattatactagttagagtgcaactagtagagcataatagttaagaacacggacgctatgaccagactgcttaggcttggaacccagctccatcggcaaggagggggctcagtttcttcatctgtgaaatggggggcagcaacagtctaccatatggggttgctgccaggctagagggcttgatccatgaaggcagggaggctgtcactccatatgtgtaactgcgtacttcaagcactatgctggccttcagtaatgtcagtattaaatgtgctattacatcctatatatggccaggtgcagtgtggctcacgcctgtaattccagcattttgggaggccgaggcaggcggatcacttgaggtcaggagttcgagaccagcctggcccacatggtgaaaccctgtctctcctaaaaatacaaaaattagccgggcatggtggtgcacgcctgtgatcccagctactcgggaggctgaagcaggagactggcttgaattcgggaggtggaggttgcagtgagccgagatcactccaccgcactccagctattacatcttatatcttatgtgttataatataaatatatcttaaggagaattgtaatattatcatgctggcccctgattttccacacttttttacaagctcgatcatagaagatgtttgtaattttttatctaacatttctaggacacaggcagggagggaatttttaggttttctcgttctctaaattgcccagcttcttgatcttcatgtgatgaagacaatataataataaccctcccatttattaccatttcttacggggaccttaccggatcctgcccacctgcgtccagttagtctgctaactcacgggtcgtctttggagttccgaggaatccagcttagccacctaccagcttggtgactcatcttcccatctgtacacatctttcatcccttatcagacacccccagggccagatgtggcttggaaattcctatgggatgacccctgggcatctgggcggcaagtgggaaccacagctacgagagtttctgtagccagattacccgaagagggtaaacaaaggctctaagtagcctccctttagggaccaagtgtgttcaaggactgagctccgtgtaggctgggacttgaccattggattgcgcaccatggaagtcacctgtggcctgggcagaagggccatggaaaagtggtggggacaggagctcatctcagagttttgttttgttttgttttgagacggagtctcgctctatcacccaggctggagtgcagtggcgtgatctcggctcactgcaacctccacctcctgagttcaagcaattctcccatctcagccttccgagtagctgggactacaggcgcccgccaccacgcctggctaatttttgtatttttagtagagatggggtttcaccatgttggtcaggctggtctcgaactcctgacctcaagtgatctgcccgcctcggcttcccaaagtgctgggattacaggcgtgagccatcatacccggcctcattccagagttttgctctaaaagggaacaggagaaggcactgctggccaaaggtggttttgtggtccagagggagggggcagcacgggtctgacaggagaaggtgagactgagcttacagaggagggaagcggcacctgagcactggggcccaaggaggatgtgggagggggcaggctgcagaagtcagggatgcgggggcaggtgaccagaaggccaggagggagagagaagaccctgtgggcagacagagcccccaggagaggaagcaccggatcagggatccccagctctgtgtgggcaggtgaatgtccactgggtgttgacctgtgcctgaacgttgacctgagcacccagtctgatggaggagacaagcacagtctgagaccctgacacaaggcagggggagggaggagggccagggactgttggctaagttgggtaaaggagagaaaggattccatggtggggttggggggaacctgacagagggcatggcagggccagaggccaccttggaggaagaggcagccccgctcactgtcacggccaaggctgagtgagcacctgcagctgtgaatacgtttagagcctgtggttacccagggagggagatgtgatgaggattctcatttcacagatggggaaactgaggcacagtcaagcagagggaatcagcccgaggtcgacatctattaagtggtgaagccgcgatcctctggctgcacagcccatgctctgaatcgcactttactacccactgttattattattattatcactgaaaaaataacccagccggaggatgaggagcagggcaccccaggcagagggcagagcctgggtaaaggcccagatcttccaggcaacaagtgggcactttgtctcctggttcggggggtggcgggagaggggcctggcagggcgtggcgggagacgaagcagaattggaaggagtggaagactgtgctcagactggagggtcttggatgccaggcttggaaacctggaatttatcctgcaggcagagggcctcatccagagcctctgagcagccagggcagaggcatcctgggtgcccaagtgaacgtgctggcagcctcgggaaggtggattcccggggcggggaggcaggagagtcctgagcccccgagggctgtgtggtggagggggtgggcaggctgtgggcaggggctgagaaagagggcagaggaacggtgagcccaggcttcaggtaggaagatctgggctgcttccgggaggatttgggtagagaaaaccggggtctggaatggggattctgaggttggtcctggccctgcccctcaccagcctgtgaccctgcaggtgacgtcaggactcagaacctccatgtccacctcggtggcacggagaggaggctacccagctggaggggttgtggtggggaggccgtggcccgcgctgggcacagcatgtactcagcggtggggaccctgccctagactcagtgcccctggcacgcctggagctgactcctcctgcccctgtgaagagttggggcccctccagcgcccctgcagtttgggaggccgagcagtttgggaggccgaggcgggtagatcacctgaggtcaggagttcaagaccagcctggccaacatggcaaaaccccgtctctactaaaaacacaaaaactagccaggcgtggtggtgcacgcctgtaatcgcagctactcaggaggctgaggaaggagaatcgcttgaacctgggaggtagaggctgcagtgagccgagattgcaccactgcattccagcctgcgcgacgggagcaagactccatctcaaaaaaaaaaagacactgaaatccaccaagttttttccagatgaggactccttggtagcagaagtgggggcatggctggtggttgccaccctggttggacgcccctcctccacgagggaagccagggccttgccagtgtccagaggagccgacatcacctccacagtcggctctgtgggctcaattgatgccatcaggaacgcgggccaagttttgatgggctgtttcctgcctccctaccctgctggaccggaatttctgactgggaatagtcattcctgcctcccagggctgtttggaggagcgatgaaagaacgagtgaaaaagcactgcctaagccctcagatcccacacccccaaatcctacaccaagcccacacccgtctcctcctcctcccggggctcctccacccggggctcctcctcccacgctcctccaccaggggctcctccacctggcgctcctccacccagggctcctcctcccggggctcctcctcccacgctcctccaccaggggctccccctctcggtgctcctcctcccggggctcctcctcccagggctcctcctgggggctcctcctcccagggctcctcctcccggggctcctccaccttagctcctccacccagggatcctcctcctcccgggggctcctcctcctggggctcctccaccgggggaaattcttcctcccgggggctcctcctcccagggctcctccacctggcactcctcctcctgggggctcctcctcccgggggctcctccacctggcactcctccacccagggctcctcctcccggggctcctcctcccagggcagtgtcaggcagggcttcacattgcagtgtgaactctgacatcccaagcagcattccttccatccaagattcttctaagaaaaggctgccagccaagaaggtgccttgggaagaatacaggttgggagtgcagcccgggagtccgtcccgctctgccgcctgccctgaggagcctcagtctgcaggtctgcagagcggggatgttccccgggcctgcctggcagggcggctgcaaacacgaaggttcggaagtgcacgagctctcagcacggggccaggcacagctgggtggtgttaggctgccaggctgggatacctttgcagaggttactcctcctggccccaggagtttgtgtttttcccctaaagaaagcagagctagagggaatgagggtgtctccagtgtgctgagtgtcagggtgggacctttccccatctggacatggggtttcctggaggtcaaagccagagcctggcagggagtgggctctgtttggggaaaggcaacgtatttgtgtcctgggcctgccataactaatgaccataaaccaggtggcttataacagaatctcattctctcacagttctggaggctgaaagtctgaaatcaaggtgtcctgggaggccaaggtggttgggttgcttgatcccaggagttcgagaccagccttggcaacatagaaagaccctgtctctaccaaaaatacaaactagtcaggtgtggtggcgtgtgcctgtagtcctagctaccagggaggctgtgggaggatcgcctgagcccaggaggtcaaggctgcagtgagtcatgatcacaccactgcacttcagcctgggtgacagagcaagaccctgtctcaaaaaaaaagtgtcagcagagccaagaatccttcagcttctggtgactccaagggtgccttggcttgtgggccgcatcactccagtctctgcttccatcctcacacagccctctcctctgggtctctgtatctctgtgacttcacatttcacatggactttttttttttttttttttttttctgaggtggagtcttgctgtgtcacctaggctggagtgcaggctcagtggctcactcggctcagtgcaagctctgtctctcaggttcacgccattctcctgcctcagcctcctacaagtagctgggactacaggcgcctgccaccacactcggctattttttttttttttttttttgtatttttagtagagacagggtttcaccgtgttagccagtatggtctcgatgatacgcccacctcagcctcccaaagtgctgagattacaggcatgagccactgcgccctgcccacatggccttcttataaggacatcagtcactggatttagggcccacttactccagtatgacctcatctcaatttgattacatctgcaaacaccatctgtccgaatactgtcacattcataggtgccaagggctgggacttcagtgtctttggaggacacaattcagcagttgagcagtctgaatacccaaggacggccaagaagggccagcacgtcattgtcagaacaggaagcttcgagggacaggcacctgtgtggtgctggcccagcccatcccctgcctccacactctactcataatgttggttaaagaaaaggtgactgctggccaggtgtggtggctcatgcctgtaatcccaggactttgagaagccaaggcaggtggatcacttgaggtcagaagttcgagaccagcctggccaacatggtgaaaccccatctctactaaaaatacaaaaattatccaggtgtggtggtgcatgcctcccagctacacgggaggttgaggtaagaggatcacttgaacctgggaggtggaggttgtagttagccgagatcgtgccactgcactccagcctgggcaatagagcaagactccatccatgcacggacactctgttctgggtcgctggcagacacaggcatggtcctcattagtgtagggaagacacactgaagcctgccctcctgcctgagtttgaatcctggcccagccatgtgacctaggataagtcacctaacctttcagagccccaactaacccacctgtaaactaggatgatgggaatagctgcctgccttggagtgctatggaattcaagggtggataccccatggctggcccataataagtgctcactaaccccaggaggaacgtggtcttatctccccactccaaggacagagactaaagcttgacagggaaggtattgcagctatcaacctaaatgacaagcagtggccaggtgccgtgactcacacctgtaatcctagcactttgagaggctgagacgggctgatcacttgaggtccggagttcaaaaccagcctggccgacacgatgaaaccccatctctactaaaaatacaaaaattagctaggcgtggtggcaggcacctgtaatcccagctactcaggggactgaggcaagagaatcgcttgaacccaggaggcagaggttgcagtgagccaagatcgtgccagtgcactccatcctgggtgacagagcaagactctgtctcaaaaaataataataaaataagaaggagagaggggctgtctacaagaaaatcatatttcttcaggaatcaggcattgcaatgggaattcgcatgccatattaaactatgtgttatgttcagggacaaagaaagacaaaggtttttaaaggaaaaaggaggaggattacataattgttttgagataattgtccctggctacaaggatcaataacaagggtggcaccagcccgaggttggacaggcagttgctgagcagatgtcctcacagaggtatttttggtgtgtgattgctatggcctttgtgcaaggttgtggttttttagagccttttgtgatcattcttgttatcaggcatttttatataagaagcctctcttcatggcctttcctggctctatttctcagggggttttgtttgtttgttttttgtttttgtttttgttttgagacagagttttgctcctgccacccaggctggagtgcaatggctcagtctgggcttactgcaacctctacctcccgggttcaagcaattctcttgcctcagcctcctcagtatctgggattacagatgcacaccaacatgcccagctaatttttttgtatttttagtagagacagggtttcaccatgttgactaggctggtctcgaacccctgacctcaagtgatccacccatctcggtctcccaaagtgcgcccagcctgtcagggtttttttaaacacaagtgattccattttgattctgacaactttttttttttttttttttttttttgatacagagtccctctctgtcacccaggctggagtgcaatggcacagtcactgaaacctccacctcccaggtttaagtgattttcctgcctcagcctcctgagtagctgggattacaggcacacaccaccacacttggctaatttttgtatttttagtagagatggggtttcaccatgttggccaggctggtctggaattcctgacctcaggtgatccacccgcctcagcctcccaaagtgctggcataacaggcatgagccaccgcgtccagccaattctgacaactttgacacaaaggaggtggcagagctgagggcagacccagtttgggagattccaaaacctgtctctgcaatgccatcctcgagcttggacagtcacctccttataccacagaggcacctattgagagactagaatcaggttataaaacacctgccccagaagagactttggaaaccgattggtgttcaagacctggctgacaggtgggaaggtggcttggagagagaatcttatgcaggtgcatgtgtgacgtctggtgtattaagaccagggacctgctggccagagccccctccccggcccctagaactgaaatccagaacaaaaggagggcacgtgtcttgggtgcacagaaccagaccaccagggtggagaagggctcagatggagtcctggtagctcagctggtcaagagaagacttaaaggaagcggtccaccttcaaacctcaaggctgctgtgggaccaaggaagacatgaacttacgtatttatttatttatttatttatttatttatttgagatgcagtcctgctctgtcgcccaggctagagtgcagtggcacgatcttggctcactgtaaactccgcttccagggttcgagcgattctcctgcctcagcctccctagtagctgggactacaggtgtgcaccaccatatccggctaatttttgtatttttagtagagacagggtttcaccatgttagccagggtagtctccaactcctgacctcaggtgatccactggcctcagcctcctaaagtactgggatcacaggcgtgagccaccacacccggccaggacatgaacatatcagatggcagagctaggaagggacgatgggctcaccttctggtagcagggaccatgtctttcttgttccttgctgtgttccccacacagcctcagtttccccagtcgtgaaatgggaataataacagttgatcctggctccaaggccaccaggtccggtggcctggtgcttggtgccggagtcaccgcgagtaccctgggctcccccagcgtggtggccctgactcaggaacctccttctgccgtgcgaccaccctggcggcggtcaccaagcccttggcgtgcccctgtgactgtgtgtggattttttctgtgccctcacagggcagtggtgtcacccttctcgcccatctcagggaagggatgggacggcccggatggcagagactgtggggacagagccaggcactccccatggctttccgtgcccagcacgttgccaggcctcttccagggtgtccgggactgaccaggctgctcctcagggggcagaaggcacttttgggtcggctttgagggaacaccaggcttcgccaccagggggcggacgtgcccctccagagcaggcagtgcctaggaaagcaggcagggcgtgggcaactgaggtcaccacctgagggccgtgccccggggagagtgggcgagatggaggctgtctctctctcccgcccagcccgcagggctccagcctcagctcccccacttgctgactctgacctcggacatacgcctcggcctccctgggcctctgtttgtctgtctgtaaaatgggactggtctcccacttggcagccttgtggggacgagtcggggcagtgtgtttagtggccgcccctgtatcatgcctatagtacccctccctgggccccaaactggccccttcaggggtatgctgtctcctccctttggctggcctgtgtcccagagatcatgatgtcacttgcagtgctgatggactagaactcagagtcccgggttcatgagctgccctgacttactggtctgttcctgtcccctgggtgtccagccggggctgagccaggcttagggattgcaggcccttcagaagggtagttctgaggatatcagggtcccccttggtgaccaaggggatcctctaccagctgccgacaccccactggccagggggagtttggaatgagtttgggtcctggggaggagaggacgtggttgatgccatcgggcctggcaccttcctggagcaggggccactctggtggctttggggatgtgtgaatgagtctggagcaggggtggctctggtggctttggggttgtgtgaatgagtctggagcagaggtggctctggtggctttggggatgtgtgaatgagtctggagtgggggccactctggtggctttggggatgtgtgactgagtccctttgtctctcatttccttaacagagggacatttcccttccctggtctcagacacaaatgagccctgcccagggtaccccgccacaatacaattgctgggtcccccagccccctcctcagacccagaaagccccataagtgagaggagggcccggtgggcacctggaggccttgtgcctgctggcaggggcagtagccgggtgggagctgtcacgtggggctcaggcccagcaagactgtcacctgatgcttcagggcggccagaatccgggtttctgtgtcaatctctccgttgtaaaatgttgtaagatgttggccgcacgcagtttggtttattttcctccgacgctgcaggccacacagagcacacttaggggctagactccgccctttgtcccccagttgccccctgctctgagggtttgtgacagctctgtccccttgtggcctctgcctggggtttctggccccggggcagccccgcagctgtgccctctctgcctgtcacggcccaaacccagagcactagcacctttgcttgagcctccactgccctcctggcgctgggctgttgggtgtagacagattttacacatctgtggctggggccagggagaggttatagctaattccttaacgctgactagagatgccttttttaaagatctctttaaaattcctcagccatccccacctccggaatttctggctggccgcttctcccagatgcctacagcattcccagccccctgtttccctcctcctgcctcccacctcgggctgcccatttctctctgatttcttatcccaagcagtcaggcctccctccctctctggagctggcccctcctgccagccaggccctgcctgtggtcagcaagcttgggaccaggctgtgctgagcccacaaagccagtcctctcctgagagccagcctccggcgtgggaaaccatttcatcccatccggatccctggcggttctgctttgctgcgtttacaccagtggccatgacggagattctcgctcacatctgtccagcctgggcacttttatgaggcattttcaccagtggggtccaatgtaatccctttattcttatgagataaatgttcatccatccgttaaaccaaatatctatgaagcacccagtctgtgctaggcacggggactgtagcagtgaacaagttgttacggttcttgccctcctggcttatggcataggatggaaaaaaagtcatcgggtgacaacaggacgccccctgagcctaattgagagtgaaggcggtcagagacaggggcaactaacttctctgaaagacgttctagggcaggggagggacccgcagctggagggcaagcaggtctcaaaggcccctccgaggagtcaaggatctgggctttatcctctgttttcattcttttcagagacaattcagtacatgctttagtatttttatatgttttttgttgttgtttttgtttttttttttacagcagtaaggtaggaaatccttgtctggccatgaaatttggtttgggatctaaaagatacagtgttcccgtaagtttgagagcgtgggctaggcacagtagttcatgcctgtaatcctaacactatgggtggccaaaagtgggaggactccttgagtccagaagtttgagaccagcctgggcaacatagcaagaccttgtctctattacaaaattttttaaaaattagccagggagccgggcacagtggttcattcttgtaatcccagcactttaggaggccgaggtgggaggatcacctgaggtcaggagtttaagaccagcctggccaacatggtgaaaccccatctctactaataaataaaaaaatcagccaggcgtggtggtaggtgcctataatctcagctactcactagattgaggcaggagaatcacttgaacctgggaggcagaggttagcagtgagccatgattgcgccattgcactccacaggcgacaagagcgaaacgccatcacacacgcaaaaaatcagccaggcatggtggcacatgccttgtagtcccagctattcaggaggctaacgtgggagggttgcttgaacccaggaggtagaggctgcagtgaccacagtggtgccactgcattcaacctgggccaaaaagtgagactctgtctcaaaaagaaaagaaaacgtgtacagcacttgacagttagtttataaagcacctgttgctgcctgtgggccccaagctgcctgtgagatgaaccgttccatcccgctttactgatgagcaagtttgtctgtttatgtctctgtctcccaaagacgatggtatttatgtctggaacacaggaggtactcaggagacactggttgatttgcactaaacaaagactcttcatgaggctctcttactttttattttattttattatgatgatgatgatttttgagacggagttttgctgttgttgcccaggctggagtgcagtggcgagatctcagctctctgcaacctctgcctcccaggttcaagcgattctcctgtctcagcctcctgagtagctgggattacgggcatgcaccaccacgcccagctaattttgtatttttaatagagatggggtttctccatgttggccgggctggtcttgaactcctgacctcaggtgatcctcccacctcggcctcccaaagtgctgggattacaggcatgagccatcacctctctcttacattttatatggggccctcccagctcctggagctgtggctgtcaccccccatctgatggaggggtcaggtgagccttgtgggaatcccagaagctggggactgggaagggccctgttcaaggggctggacgctccctgtggtgaagcccaactctaccatttgttgattgcacaatgttggcacaatgttgggcaagttatttcactctgtgagcctcaatgtcctcaactggaaaatggggagaagaataatctctacctcacggaagtagttcatgttagttcatgtgaaatcagacatctaaaagtgctctgcgaagcaggcaggaagcaccggctgtgccctgccttcactgggatcactctgcccccaccacagggacttgggaaactgcttggttttaccatccaagagacctgggggtgggagataaggagcaaaccctctacttcttcaagccctcactccagcaaatcctccaggcagccaggcaatgctgaagtccctgtccaagggggtctaggctgagcccgggtggagtgggttcttgggccaaggtgcctggaggggactgaaggcctctacccaaagtcctcatgagaactgggtgggggagcctgtgttcaggtgaggggtacggaggcacctctgtggcacagcctttgcgaggagggctgtggagggagacctccggggccggggtcgaaggacatcgtgtgggcgcgaccgcagtgctgggcggggggcgggcgcttgggcttgggccctgcgtcctgtgcgtgttggtttcctgtgggcacgtggggccctcggaagaggggaggagggtgagcacgtcctcagagggcagacccagcgaggcgtcgtggcagctgcggccgcggagacgccggctccgcctcttgcacacgccccctcgcctgaggccccgccccgcccgcgatgcccccgcccccttccccgccccgccccccggggcgccgagacccgcccctgggcccgcccccgggtccgcccccggcctccgtttgcgccgggtctgtgctggccgcgcgcctggcgctccacgctgagcctctccgtgcaatgattaacccggcggggcggccggcgcgggacccgagacggaggcgcggggccggggcgggaccccgcaggaccgctcggcttcctgctctcgccggagtttccgcgtagagggcgcatcgccggcccggggcccttggtgcggcgtggcgcagggcgcggcgtggggcgcgcgtgggcgcggcgcaggcggcccgggtcaccatgaggactctccgcaggttgaagttcatgagttcgcccagcctcagtgacctgggcaagagagagccggccgccgccgcggacgagcggggcacgcagcagcgccgggcctgcgccaacgccacctggaacaggtaaggccgcgccctcccggccacccggaggccctggagccgggggaggggacccctgagccgtccgcgggctaggggccgccccgagccaggaacgctgccgaaggcggcgcggcgcttcacagtttgcaaagaacttgccccgccggagtggtgcgggcctggaggaaagttcagtgcagcgtggttccagaacccagggaagggagcgaggcccgccagcgcccggggctggcccagaagcgcccggcgggtgggcggcggggtgggccgggaagccgcgtgcccgcctcctacccggggtctttccacgtctccactgcggtgctcgtgacaacctgggaggctaacggagcaggaagtatttttcccattttgcggctgagcacgggagcctcggggctcagtgggtgggtcgcgcaggcttcctgtgtctctttaagctcccttcggctttcccttgagaggccccctgtcctccagctgtcagcagggggtgcggcagctgcgaggcattctttagaggactctcctccaggggtcattcccagacaagcaggggcctgggaagccccttctcccagctttgtttgaggagcaagtccgggatctggaaaagagacggtttatttagtggaactccccagcgtctctgctccctaggaaaatgagaggcaggagaaagtgaggcaggctgttcgcgggaggcagtggacactgttcgggggaggctgtggacactgttcgggggaggctgtggacgttgcccctctcgcgcccacacctggcagtaaaatcttgccagatgctccaccggctgtggtcttggccaccgggaacccggctgtcacttggacacacgttattttcagttcattgaatgcattgtgagcgtcatggtgggctcagggctgccagcgagaccctcttcaaacgtggtctcttctgtctctgagttgcaaactgctagagggctgtcacatgcctgcctccgtttccctctccgtcagtgggtattcgcattcctccctgtggggagggctggtgtgggaacagtgaaggaaggactcctgttgggaaatctccctgacccaacgactgcacagtgtcttaagagctgtgttctccaccaggcacggcggctcacacctgtaatcctagcactttgggaggccaagatgggaggattacttgagccagggaagtcgaggctgccatgagccatgatgccaccactgcactccagcctcggtgacagagcaagaccctatctcaaaaaaaaagaagagcagtgttctcctccagtattgagatgaaagccatctctctgtccttgaatctctgccgtgatttagaggaaagagttaaatagacttatttcaaatcccaactctgcctcttccctactctgtggtcttgagcaagtcaggtcctcaatttccttatccataaaacgggcagataacagtgcccacctcatggggctgttgtagggatgaaatttgaacatgcaaaataaagccctcaacacagtgcttagcacatagtaagtcctctgtacctcacagctcaaccccagactcacgcagtggaccagtgtcggggtgtccctgtagggatggcatttggagggctccacaggaatcagtcagttcctgagcacccactgacagccacttggtgagctccctcccacccccgaggtggggcgtcctgctgcgggtccccagacaggtgggggcactggctggttgctggcttagacactgccctcacccaaccttgggtgaccctggagtgggctctgagtctcaagtgtcttctcagagttcagggaggcctcagggggactctgcctgagcaacccccgccccaccagatttcactcagcagcctggcagattgcagagaaatgccagcccctccccgcggcacctgcagggctccaggtctcccagcccttaggcctacatcagctcccaccaccccaggcagcaggggcacggccatttcctgcactcctcttatgtgccaggccccaggccagccccgttcactgcccttaactgactttgccactctcctagcccagcgaggtattaccagcaccccccaccgagagatgcagaagggcagagagagcacccaggagacatgcccagctcatccatcacctgcacaggatgcagcagagcctgcgccccagctctcctccccagcagatgtgggagatggagccaagagaaggcaaactggcttcaccagccaagtccctgagtggaaactgcagggagcagggcaccccttctggtccctgtctgcatgctcctgctcctagcggtgctccctgccagggccccctaggacaacagatctgtgcagggtcggggacaggcgtgtcattctgcagggcctggccgtgtactcctcattatgagtccaagacacacccccttttatctgtgtgactgtattagcttcccagagctgctgtaacaaagaccacaaactcggtggcctaaaacagcagaaatttgttccctcacagttctggagccagaagcttgaagtccaggtgtcgctcccaccagaggctctaggggaggagcttcttgaagcttctggtggctctttggcttgtggctgcatcactccaatatgtacctccccatggctttcatttccacgtccaaatctccctctcctttctctctctctattttttttcctttcttgagacggagtttcactcttgtccaggctggagtgcaatggtgtgatctcagctcactgcagcttctgcctcctgggttcaagcaattctccttcctcagcctctggagtagctgggattacaggcgcccaccaccacgcccggctaattttttgtacttttagtagagacggggttttgccatgttggtcaggctagtctctaactcctgacctcaggtgatctgcccacctcggcctcccaaagtgctgggattacaggtgtgagccaccgtgcccagcctcttttttgttttcttttgagacggaatcttgctctgtcacccaggctggagtgcactggtgcaatctcagctcactgcaacctccacctcccgggttcaagtgattctcctgtcgcagcctccctaatagctgggattacaggcgtgcaccaccatgcccagctaatttttgtttttgtttttgaggtggagtctcactctgtcacccaggctggagtgcagtggtgcaatctcagctcattgcattctccgcccccacaggttcaagcaattctcctgcttcagcctcccaagtagctgggattgtaggcgcccactaccatgccaccatgcccagctaatttttgtatttttagtagagacagggtttcaccgtgttggccaggctactctcaaactcctgacctctggtgatccgcctgcctcagcctccggaagtgctgggattacaggcatgagccaccacaccaggctccctcccctttctcttgtaaaaacactagttattggatttagggcccatccttagttaaggatcatctccaggtccttaattaaataccgctgcaaagaccctatttccatcaagtgtaaggcttgctctgtcatgagaactgagtcattgattgattgattgattcattcattcattcgtttattcattcattcattgactgtgccagcactgggctgctcagggcatagattcagcagagaacagcctcctggagcttagagttcccagagggaggcattggtaaataaacaaggaggtaagtaaatgcaggtgggcttagtgctgggaggaaagcaaaccaggggccctggagtgctgagcatttcgctggggtctgccttccattctttcctccatggatgttgattctgtaggtgtgcaggaaatgtttggtttttctcttttgagagagggtcttgctctgtcacccgggctggagtacagtggcacaatcatggctcaggcagccttgacttcccaggctccagcgatcctcccacctcagtctcccaagtagctacaggtgtgtgccatcacaccggctaatttttttttttgtatttttggtggagatagggtttcgccatgttgcccaggctgatctcgaacttctgacctcaagcaatccacctgcctcagtctcccagagtgctgggattacaggcatgagccactgcacttgggccagggaatgtttgtaagggagctatggatgcccggctggcctgccggccgggccccccttacagaacataaaccaggactgcagagcttgtttcctgagtgcccactccttatttattggtcaggttttgcccctagcctgtgacagatctgcctcccagtgccaaggtggcagagatgtgtccccatcgggctctcccaggctggtggggtgacagataaagacacgaagtctgacctgccatacccctggcacccccatccttatccccttccttccttcctccctcctcaagggcccctgtccctgttccctgctagctcccaggcagctccagttcactcctccctgggtctggcccctgtgcccctatggggcttccagctatgaaggccgtgctcttgggctgcggggccaaggtgtactttcacatcttcccactggaggaggaggaggtgggacaggagtggccggccactggggcgtgccctgcaggcagagctgaagtggccccagggagggcctgtgtggaggagggcctgcacgccagcctcaggacccagggcatgagggtgccctgcttggaggctccggcagggtcaggcggcccggtgacccctgactaggccccagctgccggcatgcccttggcgggctctgtgcttgtgccctaggcctggccccagcctctgcctcctggcagggatgcatcttgccatccccttctgcctcccccagccccataggctctagagaaactcccaaaagatgccccagacccagagcaggccccaaaatgccatgagggcacgtgggggtaccaagccctctgagccagtgccccgccagttgccctcacctctgtctggggatccccagcagggctcaccactgcagagaccccagctgggggtgggaggagctccccaagccccacccctgcagtccacaccaacacagacccctccatgtgtttgggccagagggcctcaaccatgatgggacacttcctccttgccaggcctgtgtctcccaaatgcttgaggctttagagagccgggcccaccttctgcttgaagtggaggcccaggcaggcagttgtagtgcgtggccccaagatgccagcctcgtgcagggccggcgatgattcgcttctcactcactccacacaaatccacctccaaggctagggtgactgtcttcagcctacaaatggggaaacctggccaggcgtggtggctcatgcctgtaatcccagctactttgggacgttgaggcaggagaatcacttgaatccgggagacggaggttgcagtgagccgagaacacgccactgcactccagcctaggtgacagagcgagactccaactcaaaaaacaacaaacaaaaaacaaatagggaaaccaatgccagaggaggaaaggcactcgatcaagatcccctgctaatgtcagggtccggggtctgaatccaggtctaacatggggccaggacatagtgacacatgtgggttcatgtcccagctggggccagggctaggtgggtgttggtggcaagagctggcttccatagctagggtcagagcacaaaggcagggccctaaaggaccttgtctgcactccctggtcctggacaggaaccagctgaggctgtgaccactccagccacctgccccaaccctgcacccgtgtctcccccagcaacaccgtgctccccattacacagcaatagtaccacctacaccctgacctgtaccgggccctatggatgagctttcattccccacagtaacctttaaggtgagctcaatactcccattttgcagatgagcaaacaggctcggaatggtacagggaggccaaacgccgtagctcatgcctgtaatcccagcactttgggaggccaatccaggtggatcatctgaggtcaggagttcaagaccagcctggccaacatggtgaaaccccgtctctactaaaaatacaaaaattagcccagcgtggtggtgggcgcctgtagtcctagctactcaggaggctgaggcaggagaatcacttgaacctgggaggtagaggttgtagtgagctaagatcgtgctgttgcactccagcctgggggacagagtgagactctgtctcaaaaaaaaaaaaaaaaaaaaaaaaaaagaaggtacaaggactgcccaggttcatgcagtgatttgggacggaagctgggattcaacccaggtctcaccgggagcacgtgctcatgggggtctctgaaggccagaggatgttggctgaagcctccaggctggatgggggcctggggccagtgagggggcctgtgttcggctccccaccacccctgcttgtggctccccaccacccctgcctgcttgctctgggtcccaagctccgtgcctctcagaagcagcctgagcagatttcttgccctagttcccagaacctgtgactctgaggctttatgtgttgaaaaggactttgtaatcacaagggtctgtgtgagggagaggcgggggtaaaagggacagagatgcagtgacgggcacagagagcttggaaggtgtcacgctgctggctgtgaagatggaggaaggggccccaagccaaagaatgtgggcacctctgggagctggaaaaggcggggacaggtatttctccccccgcccgagcctccagaaggaacggccccaccaacacgttgattttagtccagggaaactgatttagaacttccaggccaggcgcagtggctcacacctgtaatcccagcactttggaaggccagcgcaggcggatcaccaggtcaggagttcgagatcagcctggccaacatggtggaaccccatctctactaaaaatacaaaaattatccaggagtggtggcgcgcacctgtaatcccagctcctctggaggctgaggcaggagaatcgcttgaacccaggaggcagaggttgcagtgagctgagattgcaccgctgcactccagcctaggtgacagaacgagactccatctcaaaaaaacaaacagagaaaaagaacttccgacctcagaaccgtaagggaacaaatttgagttgttttcagccaccgagttaggggtaatttgttatggccgccacggaaacccacacactgagctgctcttttctcacgtgtgtggtggtacaccaccctgaccccctacccgccgcccctcccaacccggcctcatgctggggaggtggagggtggaggtgggatgtgaggcgggtaggcaagcagccaaagggaggccatgggtgcggcactgtcctcccccatggcctgttctggacagacagggcccccggatcagcccctagggcctcagcccttctcttcagcccaagccccagtggcagcagatctcagcactgccaggcagcatggagcctccctaaggatcctccccttctctccctcacctgcaccccccccccagcgctcaggaggggctggcccccctgctgggacttggcctcaggaggacttaccctcctgggatgtgaggccctgccctgggagggcactgcctgctggggctgggggggcttcctagaggaggcggtccacatctggacaagggaggtcatgggccgtttccactcaagccctcacccagaagccatgacatttacacatgccccaactgggcccgtctttgcagggcccagaggggcagctggggtttcgtttctgttttgggagatgacaggtcacatgagaccctcccaccctcctcgcccttcctgtatccctgagtggcccgcagcgaggctttcttgtttaccaaacacccttagcctaccttctcccaagggtttggctggggtggagaggagcagaggtcctgggtgtgggggaggggcctctgcgggtgccaggctgtgtgcctctgtgtcttctgtaatctgggggctggtggttaggtgactgagaagccacagagtaggtgggcccaggctgggtgtggccaaggtgtggtagatacaagcctctccctgtagcttcacagaaaaggccgcagggcagggcagggcagggcagggcgtgctgaccttacagcaccccgggcggtcggcactgtactgagaagtccattttccagatggggacactgaaccactgagtgattaggtggtaactcggccgagttacccagcccagaagtgtagttcagagtccacagagggagcaggcaggggtggggagtgtgggtgggagaacacccagggcgaggagcccaggagaggctcaggcctccacggagggaagggcgtgccatggcgttcgcgggcaggtgttcgctggcaggtgcttgctgggctttgctctgtgcggccagagtgtgaggccaggtggggcgtcaggaggtctaaccgtaagccaagtagacacttcctcccccaaaaagaagtagctagctttcccacacagctgcgagggagggcaggtgaagggcgagccccaggcagagggaacagcaggatggaggccccggggcagaaagaagccagggcagcttcagcctggggcctcaagggggtagtcaggagggcagtgtgagtgacgccagacccaagagggccacaggtcagagggagaacctcatccagaggtcccatggtgtagggtcacctctggcagggtgaccagagtgggctggagttccccaggggagttaatgaaaaggaaggaaggacaggctgctcagggcagatcactgaggacagcagggctgaagcctggggcccactgcgagccttggaggccctggctacaccgctgcactgtcccctctgcctgaattgggtccagcagtggctccaccgtccgctgtaagggaggcctgggctccaggagagaacttgggaaggcacctctgaacctccatccagggtgtggggacagtggccaggagtacctccactcgccatatcccagaggctctcccagcagatgcagggctgggtggaggcagccctggcatctccactgcctccaacccaccccaacagctgccacagggctgggagggtgtctgcagctgccaggattgtagggtggttgccgttgggggacagctggtttcctagcagacttccctcgggattttcaactttttttagtctgaaaatgggggcagggggcagctctactgtgacatagttgtggggctggggccaccccagggcttctcacaggggagcgtcatcccagccatgaggggatgaccagccaccagcctctcccctgggctggctcatccttcaaactctctaggggtggcgctctcacgattcctgatttacagacaggaaacagaaggtagagagcccgtgtccccagacacgggactaaggagcattccggtgcagtcgggcaccccaggccagggatacgtatctggcgtgatctcggccagtgcccgctgagaagctgatgaagccctgggcagagctggatctcagcctgtggccgggccaggccaagcaccagctgtggaacctggcacagcccccatgctgctcagagcctcctcgaagcatgtgggatatgcagcctgtgaccctgccctgcgccagcgaggacagggaggatagggagacgggaagccctggccagtcccggctccgtgtggggacgctgcctgggagaaggagcacaggggagttcaggtgcacaggggcccaagatgctggccgctctgtgacctccagcagaggacttagccacctgggccttggttttctcatctgcaaaatgggtggccaagtcacagggaagggtagagttaaagcagatgaggacgttaggagcatggtggcagctgcctgctttgtggtgtgggcagcatcgtgtggacagctgtcccctccaaggtgagaagtgtggtgctggtctgccataggaaccttggagctgcagctaggtcctgggtgggcggtggctgttgtacccagacctggttctcaccctgaggacctcgtggccagcagcgggcactcatgaccaggaaagtgaatcagcaaagtgctagtggagagtctgcactgggaagggaggggttgggggtcagagggcttcttgcaggtgatggcctctgaatcaagatgaatagctgcttgcctcatggatagggatgagaagggccttccagacaggagaagcagttgctactaagacccagagatgtggcgctacccggagggtcctgcagtctctggggtcagagctcaggatgcccgggagtgtggggaggggccatgtcgggaggagcctggatgctgcctgcaggacctcaggctgtgcctgctgggcaaagccctgggcagggaaggaactgcagcctccacagagggtggatgtggtggagaggtgggaggccagctcctgtcatccgaggtccaggcaagccaggaaggggtacggggagagctctaggaggtagaaatgggctagacttcccgacctcaggtgattcgcccacctcagcctcccacagtgctgggattacaggcgtgagccaccccgctcggcctaatttttgtatttttggtagaggcagggttttgccatgttggccaggctggtcttgaactcctgacctcaggtgatccacccatcttggcctcccaaagtgctgggattacaggagtgagccagcgcacctggcctggttttggtttttgtagaggcagggtctcactatgttgccctggctggtcttgacctcccagcctcaagcaatcctcctgccttggcctcccagagtgctgggattacaggcgtgaaccgccatgcccggctgccacagctaccttcccatcacaccagtcacgttgagcagttgtaacagagactggtgacccaggaagcctaaaagatttgctttctatcccttcacagaaaacgtttgccagctcctgcctcagagagttttgtttcgttttcttttgtttttttgagacggactgttgctctgtcgcccaggctggagtgcagtggcgcgatctcggctcatcgcaagctctgcctcccgggttcacgccactctcctgcctcagcctcccgagcagctgggactacaggcgcccgccatcgcgccctgctgattttttgtatttttagtagagacggggtttcaccatgttcgccaggatgatctcgatctcctgaccttgtggtccacccaccttggcctcccaaaacactgggattacaggcgtgagccaccgcgcccggcagccttagagagttttacaaacaggggcaggaagcatgagggggtcgggagccccacagctggctagggacgcagtgatgatcctgaactccgggtggccgtggaggtagagaaggggcaacagtccacaggacttggatgtgttggggggtgggagaggcgcaggggtttcctggtttctggcctgggcaaggtggggttaagaacccagaaaggaagctggctgaggtttggccacatagtgtgtgcagaggacacgggagcaaggtcctgcggcagtgaccagagggcatctggtgatacaggctgggctccagcagggccgggctgggggtgcagggcctcggagttgaagtgggtgtgagcagggtcctgcagggatggctatcctgcccttctaggagagagggaaagaggaatggggcctgatgggcaaccagggggctctcagacctcaggactgcagtgttttcttccctctgcccccagcatccacaacggggtgatcgccgtcttccagcgcaaggggctgcccgaccaggagctcttcagcctcaacgagggcgtccggtgagtgcctgtcccaccttggtccagggtccttgagtggcagggagggctaggcccagagtcgaaggccccagccaggcccctgacccgccagccacgcctgtgcttcctcccctagaggccatctgtcaacaggagagcgaggcccaagttagcagtggccatggggccaggacgtggtttcccgagctgccatgtgggccatgacctccataaaccacttcaggcctggtggccctgcacccccacagccccagagaaagttcttcaaggggaagcagggtgggacttggacagccgctggagatgacgctgacggcccccactggtgctgagcatcgtgaaggatatttattctgttaaagaggaaggacccacctgcctaacgacgggagtgttattcccggaaaagcaattccagccctgccaaacacccctcgtttcctgtgaatagccgggaaatgaggattgcgaagcagcaggctggacacacacccgacaagctgctgccccaagccaggtggcaggagcttcaagggagtctagggttgccatttgtagtggaggaggccaaagctcagagaggtcaagtgactcgccccagatcacacagctgctccaaggaggcagttcccagctctgtgctatttcctttggccctgaccctgttaccttgtccctgtgtcaaaagaatactggcaaaataggcagtaacccttccccttgttattcaggagaagagtcagtggactggccagactttcatacgcaggcgcccccctccaccctgtgtggcaaagctgaaggggcccttacatgtgggtaaactgaggcccaatacatgccgcttgttcagggtgtcctgcttttctctggcttatctggcccacccctgggtggggctctgggagctcattttcctgatgagcctctgcttcaggaaacaggagcctaaaggatctgccagggggcggggtggggggcagtttggtttggtttttgagacggggtcttgctcttgcccaggctggagtgtgggggtgcaatctcagctcactgcaacctctgcctcctgggctgaagcaaccctcccacctcagcctcctgagtggctgggactacaggtaggtaccaccacacccggctaattttttattttttgcagagatgggagtctcactacccaggctggtctcgaactcctgggctcaagccatcctcccacctccagcctctcaaagtgttagaattacaggtgtgagccaccatgcccggccagctgggtatttaaacaacaacaaaaggagttactgttaaatttacaaatccagcagcaggcacagtccccagctttggacatccttctcccctgccctccttggtgtgaacagcattggtaattggctgattcttgctgctgcctctccacagggctgacacagagcaggcagcctccccaggagtgtgtgctgggggtgggggcacagagaagctgccctgggccccaggcttccctcgtcagccccaggattctacccaagaaatgggtaaaaatcgggggctgtgttaaactttgagcccctggacagttaggttatttggggcaacttctttttagtcagttcagaatgaagtgctggaatgtttaaggaataatagcagggtctttttactgaagccttgctctgtgccagccttagaccaggagtttttcacaccaaacctgtagtggctcttgcccgtaatttcagcacattgggaagccaaggtagggggatcgctagaggccaggagtttgagaccagcctgggctgaacatgacaagacaccttctctattaatatgtgttaacgttttttaaaagtaaattaaaaaaatactcatccactcgtcactgcagccctgaggagtagatgccttgttatctccattttacaggtgaggagactgaggcagagagtggttgacgtgggttgcttgaggtcacagggctaataatgaatagagctggagctcaagcccctgacatcagggccactgggttgttcagcttctgccctaccccagctcttctggacggtgtggccacattaaactcagtgacattagcctgggcacagtggctcaccctgtaatcccagcactttgggaggccgaggcaggaggattgcttgcgttcaggagttcaaaaccagcctgggcaacatggtgaaaccctgtctctaccaaagatacataaaattagctgggcatggtggcaggcacctgtagtaccagctactcaggaggctgaggcatgagaatcatgtgagcccggaggaggaggttgcagtgtgtcaagactgtgtcactgcacttcagcctgggtaactgagtaagaccccatctcaaaagaaaaaaaaatgaaaggattttaattatacattaaatccataattggtcactagctttgatcccatgagagaatctgttactagagacattgattacaccagcctccaaatggtcccccttaccctttttttttttttttttttgagacgtagtttcactgttgttgcccaggctggagtgcagtggtgcgatctcagctcactgcgacctccgcctcccgggttcaagcgattctcctgcctcggcctcctgagtagctgggattacaggcacacatcaccacgcctggctaatttttatatttttagtagagacggggtttcaccatgttggccaggccggtctcaaactcctgacctcagatgatccacccgtctcagcctcccaaagtgctgggattccaggcgtgagccaccatgcccggtatccaggagattttcatcaccccagcaagaaggctttagcagccctcctcattaccctttccccagccctggcattgaccacagacagctttctgtctgtggatgtgcctattctggacattccatatcaatggaggtagagcaggtagcccttcacgcctggcttctctcactcagtgcagtgctcttgaggtccgctcagggaggagtacttacccctgctttgcttttttttttttttttgagacggagtttcactcttgttgcccaggctagagtgcaatggcgtgatctcggctcaccacaacctccacctcccaggttcaaggattctcctgcctcggcttcctgagtagctgggattacaggcatgtgccaccacgaccggctaattttgtatttttagtagagacggggtttgtccatgttggtcaggctggtcttgaactcccgacctcaggtgatccacctgcctcggcctcccagagtgctgggattacaggcgtgagccgttgcacccagcctgcctgcttcgcttcttttcatgccatatcatattctatcgtgtgtatggaaagcacagcatatcgcatccacctcggctgatggacgtgggttctttctaccttttggctgtgatgaataacgctgctgtgaacatctgtgtgcaagaatttgtgtggatgcacgttttcatctctcttttttttttttttttttttgagactgagtcttcatctgtcacccagactggagtgcagtggggcgatcttggctcactgcaacctccgcctcccgggttcaagcgattcttgtgcctcagcctcccgagtagctgggattacaggtgtgcatgaccacgcctggctaatttttatatttttagtagagacagggtttcaccatgttggccaggctggccttgaactcctgacctcaagtgatctgccagcctcagcctcccaaagtgctggggttacaggcctgagccaccgcaactggcctcatttctcttaggttcatatatctagcagtggaattgctgggtcccatgatgactctgtggttatctctttgaggtactctttcctttcccacagtggctgtaccatttcactgtcccacttagcagcgtataagcagggcaggagagttcagtttgtccacattctcaccaacacatgttaatttccagtgctttcattccgagaagtggcatctgtttgtggttttaatttgcatttccctgatgactgatgatgttgagcatcttttcaggtgtttattggtcatttagatatcttctttggagaactgtctgttcccatcccttgcccatttttcagttgggttatttgtctttgtattattgagctatgagagttctttatatattgtggatctagagtctgttagatactggtttgtaaatctttcctcccattctgtgagctgtcatttcactttatttctgtgtcctttgaagcacaaaaagtttttatttgtataatgtccagttgtctagctattttcttgatcccgtcctttgatcacctttcttcctcctaaggtacagaaatgaacacactttgcataatctttttttttttttttaagagactaggtctcgacttgctgaagagcagtggcatgaacatagctcactgccgcctgcaccttgtgggctcaagtgatcctcccacctcagcctcctgagtagctgggactagaggcgtccagcaccaagcctagctaattttttttttattttttgtagagatgaggtcttgctctgttgcccaagctggtctcaaactcctgggctcaagcaatcctcctgcctcagtgttgggattataggcgtgagccgctgcacctggctgagaaaacaagaaaaaaatcttaacaaataagtcactctctgtccagagggctgcggatttaaggacccaaacctctttttatcttgatggctttggatgacattatccctgacatgtcattgttatgtgacccaccctcttagacagaatctgaggccctgggcgccctcgttgtgctcagccgtgaggtccgtttcccctgtgcttagtggcctgggctgctatgtgccgcctgtgttgtccgtgcagaatacagccagggtgtctgtctggggcagtctctcttctagcgtcccatgtggctcatactgttctgcttttgaccatgagaagcgtgcatctgagtcctcaggttagcgcaggagttcatggacaggagctggggccgcctgctccctgcaaggcctctcctgctggctcctggccaagtcacagatgatctgtccctgcccaactccagcaccaagtcctgctggcctagctgctcccaggaagcagcaaaccccctggatgggatgtcccagcctctgctttctggccctgcagacccttcccacagctgtctctcttgaggctgacatcccaggtatacccaggctgtcccctctgtggcctgctagcccctagggcctgggatttgctgcagcttcgtcccctgggctcccctcctgtgatttgaggacatccacaccccctcttctccctccctggcatggtgtcctctattcctagcatgcctggggctggcttggggttccccttagggagtggtcccctcccactgtcagggagcccgtgctcagctcagctcaggccaggtggccgtgcccgcagcctgtcagcagcaggtctcacgtgcaggccagaggtgctgtttggatttaagctacttgactttgaagtttcccacaatcccggactgggcaggccctctcttcgtgttctgtagaaaggatgtctgtttttcatctgcaggactagggctccaaccttgggttccctgatccagcctttgacttcaacagtgcgcttccagagcctcagtctccccatctctggagtgaacatggttcccatcttgtagggcttttgcatggttggagttggtgtgcgacccctcctctgcctggaaggggtctcacaggtcaggaatgaggggaacccaggtgctggcagctgccaagtggaagttgcccgtccgtttagcattcattgtgagcacccactacttacacgcttgggaggtggacgaggccttcggcagcattcctggccaggggcagtgggtcctgaactggccactcatcctcagcctgtggtcagttcagatctgaggccgtgtctgtgctctcattggggtccgggagagttggtgggcaccgtgcaaatggggggatgctcagccagtgatgcccctcacccctgcccagagaaggagtgcgctgagttcattcattgtgagctgttgggtgagaggaaatgtcagaggaggccaggggagccggagaggtggccagtgggttggagccaccccaggtagggcttcattagggcctctccgggatttccagccattgtgagccaaggggccatttggtcctgaaggaggcattcatttgttcacttattccttcgtcagcattcacacccgcactcatcatgggcagggagaagaccagaaaggcttttctgagctacagctgctcctgatcccagttgacccccgggaccctctgttaccggtggagggtgtccaggttcttggcgctttgaacaaagaattgaacaaaacacacaaacaaagcaaggaaagaattaaggaacaaaagcagagatttattgaaaacgaaagcacactccccagggtgggagcaggcaagcagctcaagggccaggttacagaattttctggggttgaaataccctctagaggtttcccattacttggtgtacaccctatgtaaatgaagtagtggcccgcaatcagtgtgattggttgcagaaagcgaccaatcagaacctggaagtgaagcaccctatgcaaacatccgattggttgtggaaagtgacccatcagaagctgaagttacaaagttatactcctatgcaaatgaagacttggcccaaccaattgtggtaggggacgaatcagaggttcttgcagtttttcatctgccgtgtagaaaagaggggttgcaaaggaagtagcctccggtccttttgttacttgggcatggaacattggggtcttcctttggatttagttctaggaagtcagtgtgaattggccttagattccctgcctccagaccctactctcctgcctcacctcctgctgtatgttcacatggatctcaggccacagacaagggtgccgaggcccagacaggggaggggtctcgtccagagtcacatggcgtgctagcaagcaccggggcctgccctccagccctgacttgctgagcagacgccctcgggttcagcctcatgccttctatgaagaccctcccttctcacctggtgccctgctctctggcatcactgaaagtggccctgcaagtaatgcctgcggtaactttgagacagatgctgcgtggacgtggggatcactccatgaggttgaggtcacagcttggtccttggcggaccagaggacaggtcacggggacagtgggagaaggttggggggactgctggggcgggggctgcctcggggcaccattgtctgtgatcacagggtgaacctcagccttgttaatgccactgcgctgatttcacagttgtgcaagggaggaggttgggcctcaacgccagtcctgttactaagggaagctgctggccaggagcagggccaggctccagggctggaaccactcagctgcgctgttagcctgaacctcagcttccccatccatgaaatggggacactaacatcacctgtcaggtggctgtgaacggaggcctgtgactggcctgcctcagcactgcccacagagctgtgcaggaacgttagtattttgccctgtgcttccgtgcacctgcagtactgcccgagccccaggctccggtgatggccaggtgcagaagcaggagccacctccatcccagcacctgagtgccggttccctcagcccaggccacgtctctgggcttcacttagctcccagattccacaccccatggcatggtgggggcagccagccctgaactggggtccagcctacagcttctccaggaataaaaagtacagccaccccaaaagggcctctgaggactagatcatgcagtcactgtgtttggggggatggtatgtttattgcatctccaccagcacccccagatccatggttaagagagctgaccggagcaggaacaggagactttgtcaccctctgactcctggtggccaggggcacagtgaaaagggtaggcagcttgcaggaagcaagccttatttgggcttttttttcccagcatgttgcttttgaaaactccagccagtcctctctttgcaccacagtgcagggcttccaaaatgactacacattgaaactgtgtgatcctagtaaaccacggggaaaatgacaattgttccataatctttaaaaacttttctttttttttttttttgagacagagactcgctctgtcacccaggctggagtgcagtggtgcgatctcagcccgctgcaacctccgcctcccgagttcaagcaattcttctgtctcagactcccgaggagctgagattataggtgcccaccaccacgcccagctaatttttgcatttttagtagatggggtgtcaccatgttggccaggctggtttcgaactttggacctcaggtgatctgcccaccttggcctcccaaagtgatgggattacaggcatgagctactacacctggccaaagcttgtcagaacattgaaagctgttgtactgttggtctattggttataaacataaccaacgtattttactgtttggttataaccatacagagaaatgaaaaagattgtatagtaaaatgaatatttagtgcactataatttaaaacattggggccaggtgcagtggctcacgcctgtaatcccagcactttgggagtccgaggcaggtggatcacctcaggtcaggagtttgagaccagcctggccaacatggtgaaaccctgtctctactaaaaatacaaaaattagctgggcgtgatggtatgcgcctgtaatcccagctactggggaggctgaggcaggagattcacttgaacctgggaggtggaggttgcagtgagccaagatcgcaccactgcactccagcctgggtgacagagtgagattccatctccaaaaataaaaataaaaaataaaacagtgggaacatagtactttgagcagtgtttgcccgttcagaacatgatcatttttcattgatgtgctgcacttccatctgtgttggccagttgctttttcttgtatccatttttacagaatgccacatgggtttcacactggcagacaaggaggcaacacaggtcacaatttgctgtctgtgcatgaactgctgacagatacttagggaccaatcagagactgactttgaaagaagtgttgcaattggtcagtgatcattgtacacatctgttatctacattttgatttgtggactggagagcgggcagcagagcttgtacttaaccaggataactgaaacttgtatgtatcagaaccatgcaaagagaggactgcctataattcaggactgattagaaagttttcctaggccgggtgtggtggctcatacctgtaatcccaacactttgggaggccaaggcgggtggatcacttgaggtcaggagttcgagaccagcctggccaacatggtgaaaccccgtctctactaaaaatacaaaaattaactcggcctggtggcgcatgcctgtagtcccagctactcaggaggctgaggcaggagaatcgcttgaacccgggttcaccgcaacctctaggttgagattgtgccactgtactccagcctgggtgacaaagcaaaacttcgtctcaaaaagaaaaaaaaaaagttttcctaaagggaatagcaacctaaaaagtaagatttctgatgtatttggttcagaagactgttgggaggtcatatctggggcctcagcgctgacagtgcctgtgtactttcagcctggctggtgtggaatgtggtgctcccattctctcaggccctggaggtatgtagggagggaaggaggaattgtcagtgttgagtgccaaggtggaggttcagatctcagctctggcgtgtcccatgtggacctggtctggtgtcttgacctctgcgagcctctcttgcctcccctgtaataaaaggggaaccccggtgaatgcctgcggctgggttggtgaagactgaatgagcttctctggaataaagagtaaacacttgggaagaagctctgcaggcggagagaggaggagcccgtggcatccgggatttggacaggtggaaggcaggagcaaaccaagtgttgcaggcccagccctgccaggtgtctctccagaaggtgtgagacgcagaggccactgtcttccctctgaggaccccttggcttcctctgctatgacatgagtgcagggatctagttgatgagctgccactgcggaccatggaggccccggttgtgtggccgacccagcccctgcaggtctggacaggtgggacctgtccactacccatgtttttgggctggctgagcatgctgatctccccctgcccaggaggccccaccccagtccgtgggtcccccatgccagtgccgtgtggtctgggactcactcttgtctcacctcccacccacaggcagctgttgaagacagagctggggtccttcttcacggagtacctgcaggtaggtgggtcttgctccagccaggctgggcctgcctcatgagccagccagaaagcacaggggctcacctgcccccgggggtgtggagcgccggctcccccactgtctgcctgcagttccaaggacctgcctcgttccttatctagccacgtggaatgttgtggaggttaaatgataagatgaggtgaattcttttttgagatagtctcactctgtcatccaggctggagtgcaatggcgtgatcccagctcaccgcaacctccacctcctggcttcaagtgattctcacaccttagcctcctgattagctgggattacaggtgcccaccatcacgcctggctaatttttgttttttgtcttttgttttgttgttgttgttgttgttgttgagatggagtcttgctctgttgtccaggctggagtgcagtggcgcgatctcagctcactgcaacctctgcctcccgggttcaagcgattcccctgtttcagcctccccaggagctgggattacaggtacccaccatcttgcccagctaatttttgtatttttgtagagacaggatttcaccatgttggccaggctggtctcaaactcctgacctcgaggtgatctgcccgcctcagcctcccaaagtgctgggattacaggcgtgagccaccgcgcccgaccaattctgtacatttcatattggtggcataacacggcctgcggacttttgtctggactctttctcttagcatcaggttctttctcattggagcacaagccagtgcttcatttctttgtgtggagatgggctgcattttgtggtccatgctttcattggcgggtgcttgggttgctgagaccacacagcgtggttcttggccgagccaccccaggcagtgcgtccagggtccctgaggtaggatggcagctgacgggcccggcctttggtaatcagagtcacctcttgatgcaaagtcctttcttcactgtgggacatgccaggcttctgcctgcccagctgagcccagtgcaaggagctctaggccctgcccacctctcgggatgtccgtgtgaccacctcctgtctcgtgacaacccggggttgggtcagttaccctcctggatgaactgatgctcaggccctgcagcaggtggactgtgggacctcagtgagtctcctccccctttaagccttggctgctcactggtggatggactctcgggggccctgctggccaggacacccccgggcatccacaagggcggtgacagcccctctgtgtttaccttcagaaccagctgctgacaaaaggcatggtgatccttcgggacaagattcgcttctatgagggtgagtgtgggccccttggcggccactctgggccatgctgggtcctggctggctgctggactgctgggcctcgtgctgggggcctctgggtgcaaggtgtggctctctggtccggagggcttggaaggaacacgtatagccttagggcagcagggccgagatccttacccagagggaaccctgggagagggtctgccccccgaacttgctggagcccaggagggctatgagacatcggggaaaagccccctgcttcccctccctgcccacgggactttctggccctagtgagctctgtccccgcagcctgggagagcccctgtcctggtctttgggggtcagaggagaagtcggttagggctgaggtcaccgatactcacagaggaggggacagggtgggggactcagctgaattttctctgtcgaggctcacagccacccactgggaccttcaggttattgttcctgagtgggagagtacagtgatgataagtgatttgcccaaggctacagtgcacatcaggggtgggggcgggactcaaacccaggtctgcctgactttagggcacacaccctttgcccttctcacggcccggaggtccccgctggcctcactgtgcaggttgggcttcccgtggccgagagcctcgggcagcagcagcagcgtgcgcatccttgcaggagcgagctgccctgggagcggggtcaggtgagggggtccactcagttcccacggatgctgctttgctcgggctgtgctgggatcgggcctgcgctgtacccgtgtgttgagcacctgtgcactaggcaccgggtgtgtgcgtccctccgtgctggactgccccgagtgtttcacatctactaactcatttgatttccacaaccctgtgaagaagccaccgttgttagcactgaatgaatggggaaagtgaggcacggtgtcctgcccaggccacacagctgcaccgtggcaaggccagggtgccaagcaggccaccgggtcccgaacccatactcttcactctgctgccccaggctcctcctccaggtctccctctgaccctgggaaaaagagctactagcccactccacagagaaggacacaggcccggaggcctggcatgttccaggggaccttggagctgcgtgtcatggtccttcctcacgtccactgaacatgttgggtggggccagccaagacaggaacacaaagagaggccatgaaaaccatcagaccgtcggggagacatgggggttctgggaaggcttcctggaggaggcaacatctagactggcaggacagagctgtgagcatttggcacctgacgaagatggccacccacgcccctcgcttgatgcggcacattctggcggtgcctgtacctcccaccagatctggcctaggggagccggggctctcggagaagggagttttgtgtggcttgaaaggagctctgcgtgggacagccaggtctgccaggcctcccagcaggggtgcctgcccagcagaaggggcagaggacagccctgggaggcccagcatcctcttctgcctcgccagcccttcctggcctccccaggtctcagggacaggcactgggctctacgctgggagtctgaggccctggcctccagttcccatgtagctgcagacacagggtttcctctccagcctcagcacccctgtcttagcaatgtggggttgaacaggctctgtccacttgagtgttctctacatgtcaggcccaggtgacctctgggagcccagagatggaggagaacctggccctgcccttcagggactcacagcccaattggggacacagacacggacccgagggtgacagttgagtgtgattaatgtcattgtgaaggagtgtcctggggaagaaagggttcattccaccttggcagtcagagagggctgcatggaggcagtggcccttgagtagggcctcaaagtgtggtctgttcaggggaacttgtggtcccttttggccccatgcagtggggacatagccacctccacatcctgatgggcggcctcaggggcctcccccttcctgctccctacccctgcttgggttccactgggagctcttcactttgagcctgctccttgcagctgtccctacagagcctctaccagaggtgggtgatggccccctgtggggaagccccaggaccttgccccctgccccttctcagcctccagggaggccttggacttcagcccctgggcagagccggtcctggaagcggagagcctggaggagtggccttgaggtggagggctgcctccctaggaaggggaggaagactggaccgcggccggggttgtagtttgatggcctgtgtgtggcttaagggaatcggctccagctgcagccaagcaactccttggaagccagaaacttgggaactctgggcgggagctcctggtcctctgctgggccctgggatctgccgtcgctcatccaccagggaatccaaacccggtatgggtcacgtgacccagctgtgctgccttacacgcttgcctccatgcctgtgcctcggccgtccccgcgccagacacccttgacctggtccacccagcgcgtggcttttgtcactgccctgcgctcctcactgttcctgagtctcccgacgggctgaaacagggttgttggtttgcagggcctgcacagggccctcagcactcggataaagaaaggaaagacggacaccagcctgcgcccacagcgagaaccccagagtgggagccagcacggagccaaggctactgcggggccgctcgcctgcatcagcccctgctactgccaggctggagccaaggtacggcgcgcacacacccggccccgtcctgccggcagcaaacgcccagtgctgtttcatctcagctttcgacctgcccacgtggggacgtgtatcacgcccctttcatagaggatgccactgagtccgcctggaggaacttcctggggtcgccccatacctgcctccgactaaccctactgccccacagaggggcccccacaggacaggccccggcagagagccccaacagccgcgaggctgcccttcctggcctctcgtcaccgtgtggctccagctggggcctggattctgttttacaacatctgctttccgcagcatttccgccccgtgggctggagaacagcctgcgctgagcagaacgcaggcctggccggtgcccagagccaccccccggccagcccgggaactgagctgcctttcttcctgccgcggcggagggggactgaagggactttgtgtgtgggcacagttcggcggggcggtgagcatccatccgtccggggcattcctgctggcccccatcaccctcagagccaggtttgggctacccgggtgggcagagggctggccactgggctgggagccaaagatgggacccagtccagctcggccccagcccccagggctgcccctggcggggtcccactcctagtgccctcgaacctacatgaagctgggggcttccgggagtgggggcagggcccagagagtgagaaaaaggcaaaggtccctgttcagcctccgcattcccatggaaacctcaaagcagttctggccgggggcgcagcctgagagacagccggcaacgcttccctcttcactcagaggcgcccacaccaagatctctctcgccagttgttcgtctggcttccaggggacagcagaggccttggggacacgtccttggactgtgcatccctggacccagcagccctcatcccagctccgctcagtccaggcagaaaggccaagggttcttcacgttgcctctcccactggaacccagagccagcttgggcagctgtccccgtcccacaagggtcactcacctggtgcatggcaccgttcctctcaaggccagcagaaatcctacagagctggtcccgatgtctgctacctacgtatctgtttcagagactcacctgtcaagatgtgtccccataccactacgtctggcaagcccagctcctatagccagcttggatgctcttcctccaggaagccctccctgcctgaccctctgcaccctcttcttccttcgacgtggtgctgctattggaaggggtctccgtggatccccagacctgaccacaggcagagctggcctggccctgggtcctctgggccactgactgtggtgcaccctttcctcggaggctcagcctctgtctgcttggtggggggtcgatcacccctggctactgcccttatgatcctgctcagtgtcccacttccctgtcatgtgatggatgggcagctgtttggggctcagctgggtccccagtgcccagcatcagcgccagcacacagtaggtgttctgtgtttgttggaggggcagatagtgtgggggaaggagggaggaggtcggtgggtagaagaaatcaactgcttagccgggttgttaggaggatctgatgagactaggatgtgagttgaaactgctgtgccaggcacacctgtgtgggtctcacttgtgccaggcatacctgcgtgggtctcacctgtgtaggtctcacctgtgccaggtgtacctgtgtgggtcttacctgtgcaggtctcctgatgcaggtctcacctgtgccgagtgtacctacctgtgcgggtctcacctgtgtcaggcgtacgtgtaggggtctcacctgtgaacgtctcacctgtgccaggtgtatacctgtgtggctctcacttgtgtgggtctggtatgtgacaaaggcctgggaattggcagctgtcatctgccaggagcagaccctgagccaagttccctgtgccttaggctcatttcatgccctcagctctgggaggccaatccctttactgccacattttataaatggaagactgaggttaagcagtgggcccagggccatagaacagctgagctgtggagctggacatcgaccttgggcaggtgctgccaggggcctgagcccaggccctccactcccgcatcctctgatgacccatcctgggtgagtggaggcatctgcccgcgccagtcaggcccagtggtgatggcccccatgcccacaggacagaagctgctggactcactggcagagacctgggacttcttcttcagtgacgtgctgcccatgctgcaggccatcttctacccggtgcaggtgggcagcccagccctggggagggaagcccagtgcccctgctgtgcccaccctggcctcactctacagaggggggccgccaggcttggggacacacacacctgctctgctctgtgctgctctccttgggctacctgagttgctcagagcctgtttccaccccttcaagctgcagatatggacgcctccctccctgtgaatcccccagcagcgaggcacagcgtaggggctctgtgacagtaaccctttcactgccagaggaaactgaaggggccctctatccttgggacggggtcatctgaggagaacggggtggaggggcctgagggtcggcaggtctcttccccctgtggggtcccaggaccgggagaggggagatgaggacgcatgtgaccacagccggtggggtggggtgccttccgtccacagggcaaggagccatcggtgcgccagctggccctgctgcacttccggaatgccatcaccctcagtgtgaagctagaggatgcgctggcccgggcccatgcccgtgtgccccctgccatcgtgcagatgctgctggtgctgcaggtgggcacagtgggcagagggtcgggcatggggaccgtggggcagtaattgggctcaggtccccacaggcagagcatgagatgaggatttaggggcacgagacttaaggaagggcccgatcagaggagaagcctgtcagggccagggaccggggagcagctggtcagagctgtgggtgcaggagagctcaagctgcagacccgttcctcttgggcacagggctgggcctttacaccctgtgtcggccagcctggggctgtgcccacccccagcacgcacacgcacatacacactacacacatacttgtgcacacgcacatagtatgcacgtgcacatgcatacacaccacacacgtgtgcacgcacacgctacacacatgcctgtgtgcacgcacatactacatgtgcacacgcatacacactacacgtgtgcacgcacatactacacacgtgcacacacgtgcacacgcacatactacacactgcacacacacaccacacacgtgcacacgcatacacactacacacgtgcgcacgcacatactacacacgtgtgcacacatacgcgtgcacacgcatacacactacacacatacatgtgcgcgcacacatactacacacgtgcacatgcacatacacactacacacatacttgcatgcacgcacacatacacacagtgtcccagtcatttctgcccagagggcttttgtcagtgggtcagctctggggaagacactctgagagctgttagcccccctcacagcaggtggggagaggtgcctgccccagaaaggagtggggcccccagtggcatccaccgcaagccaggggtttctgcacacggcccttcccaggcaccacactttgcagttggccggctcatcacactgtcgcaggaccacacagtcactgccggccaccccattttacaggtaggggacccaagtcctgcttgctatgagctaataagggcgggagcccagcttcaccccggctctcgcaggtgcaaagccctctttatcgttctgaatccccgtgaagctcttttaaaattagggtctgtgaggacactcgggaccctcacagggcaaccagagcaaggaaggggcggccagtgtggagctgtgcaaggtgggggctgccctgggtggaagttgagagagtttaggtcaggcctggctgggttgaagcggggacccttgagggactttgctgtgtcagcttcagcttcccggtctttaacagagggaggcctcctccctggcaggataggtgaggacttggtcattcacaaccaagtcactgctcctacaggcagacaattccagggacacgtggggtcccctgtgttagtgtaggtgaccttactgtgggcacctgtggagtcccacctactcattgtaacacaggccaggacataggagcctgtaccagccccgaaaccccaagagttcaggcgactttgctcacccccagggacgtggcctggaccgtgcctcactccctgcctggagtggcctcccacagccatcccaagagtcctgggttagtcctcgcctctggctggctggattgtcacttacaattgtacctgggtgtggccgggtgcagtcactcatgcctgcaatcccagtactttgggaggccaaggcaggcagatcacaaggtcaggagattgagaccatcctggccaacatggcgaaaccccgtctctactaaaaatacaaaaattagccgggcatggtgatgcatgcctgtagtcccagctactcgggaggctgaggcaggagaatcacttgaacctgggaggcggaggttgcagtgagccaagatcgcaccactgcactccagcctggtgacagagcgaaactctgtctcaaaaaaaaaaattctacccccgtgtatcttgtccctgaaccccctgacagccccttgaggcctgctgtcttccattcattcacttatttaatgagtgcaagcactcgttataagtcagctttctcccagccctctttgctgggtgctgaggtcccagagcttttgtcccagctcagcgcacagctgggtgagcagcctcatctcccgggccttggctcaaatacacctggaggtagcggtgagcccttcagagctccggatgaggggagatgatggcgtgagccagtgatgggaagaagagagtggggcttgtgaggtggtccctgatggatgtggactgcacctggccccatggggcagggagccccaggtgagcagcttggccctccctgcgtggggtcagccagtgtctctggagagactgtccaaagcctctaggactcttgagtacagggcccctccgaggggtggaaggtgcagaacacccatctcatctggccacagggcctttttccagggcacaccatggtctcccagatcccgacgctgctgtgagcagcagagtgactcaggccacatgctctgagaggggctgggaggccaccgtgggccctgccatggggacagagagcctgtgggaatggggaggcgggaggcagaggacaggctgtctggtgggtgggacatatggttgagagcctggagccaccaagctcgggtgcatgaccccctaccccctgccccactctcctgcagggggtacatgagtccaggggcgtgactgaggactacctgcgcctggagacgctggtccagaaggtggtgtcgccatacctgggcacctacggcctccactccagcgaggggcccttcacccattcctgcatcctgggtaggggtccgcctgggccttgggctggggcaggggtgaccacgggccccatccattgtgaacaaatgggcaagccgaggccccacgacagaaccaggatctgactccagactggttctcagccgggcagcagcccccagcctgccatatgctggcctggacgtggggatccgtgagagtgggcacacaccctgagcggtgatgtggcaacaccttggagagctccaccagacctccgtgttccccaggaggccacattcatgtgcagtcttgaaagtcagaagtgggccaggcggagtgctcggaacatgcaaatgccgaagcttgaggactcctggctcagttaggggacccaggctgggagggactcggcctgggggtgggcaggctgagccctgtgggcagcatcccgggactgcttggcgcgtccagcacagctggccacgttgctcccttgacggagggcctctgggttccttcagcaatgtcccttgagtacctgttgtgccccatcccgagcccacgcccttcccctcccgcgggggaggccgaccagtgagtctcctccacgacccaccattagctggaagctgggagcatcccaggcagaggggacagagctggggcaaggcccgcttgggactatgccctcctcatccagaggggctccccgtccccacctgctggtgtaaaacctgcccactggtgtgtctcagctcaggcagtgccctggctgctggagaactttgagccacccaggcttggtgtagccctggatggcaggaccccagcccctgcctgatgggacccgcatcctctggtctgggaaaggcccctgagccgctcgtgtgtgtcgcccgccacctggtggccactcttgggattgcagggtcctgcatgggaacctgaaccctgccccccaaccagccttggccacctgtgccactgcctcccgcccagatgaaccaaggggcctcctccctgggtccccacgtctaccctcagcccccacagtctattactctccacgcagcggccagcgaggcccatttacaactgcctggctacaggctccccgcatccccaggatggaatccccgccttgaccttacatggagggcctgtccccatctgctcccatcacagccccacaacctggccccatggctcgcctctttgggcttcttggccctcccaccatccccttggacaccagctccagtggggcaggggctgcgcctgcctgggaaagtacaggtgtccagcaggtgccaaagtccatacacttccacaagtggggaaactgaggcacgggggtgaggtaacttacctaaggtcaaacagaggtcgctggcggggtgcaggttcaaacccaggcatttgacttgaggtcctgtgtgaccaggctgggcctaggctggagaagagagactggaacctgagctggtgtcagggcttgtggcggtgggacctgctgagccgggccccgggtcgggccttccctgcagctgcccctgcacagggacccagtgtgcagtgagcagcaggtgccaaggcgggcggggacccaggtggcctctggtgtgacagtgcccgtgtctctccccagaaaagcgcctcctccgccgctcccgctcgggggacgtgctggccaagaaccctgtggtgcgctccaagagctacaacacgcctctgctgaaccccgtgcaggagcacgaggcggagggcgcggcggccggcggtaccagcatccgcaggcactctgtgtcggagatgacgtcctgccccgagcctcagggcttctccgacccgcccggccagggccccaccgggaccttcaggtcctccccggcgccccactcagggccctgccccagcagactgtaccccacgacccagccccctgagcagggcttggatcccacccgcagctccctgccccgctccagcccggagaacctggtggaccagatcctggagtccgtggactcggattctgaagggattttcattgactttggccggggccggggctctggcatgtccgacttggagggctctgggggccggcagagtgtcgtgtgaggcctcacagctggccttgagtttttactgacacgtccctgtgtgcgggggtgtccatgtggcgtgtgtgtgagtgagacttttttactgcgtcccgtcccgccagccctatcggcctcgtcactggccttggtcactttgtatttctgtcttggttggaaataccatcagccttccttgctcggcccaggtctgtttcaggcatctgagtcggcgtttacccaggggccgggccagagacgggggtcggccgctcgctcccacgctcctcctgccccagccctctggtgtccacacctgcccacagagaatgtaaacccagtgggctctgcccacgccgggccccaaagtgaccagactccagcacacctgtctcctcctgcctggggtggccatggggatggaagggggtggaataaaacctgtcaacctggctcatgtctgcagtgcctgccctgggggcgccccttcagggtgctcaccctcaggccttcgctcccttctagggagcgcaggtttccagggtctgtgtggagggggcagacctgtgcctgttgtccaggcctccctactgctccaccgtccctgtccctgatgggaggaccgggaggttgtggaaggaagggctgggatgctagggagtggggctggccctgccgcacaggagtctggccctgactttgcccctggccttagcagggatggactcactgaagcctttgaaggagggaaggaggggtgggggcgggatctgccagctcctcccgtgctacagaagcgtccaggtggcctagggggtgggggtgacctgctgaaggccatccggcctgggaagcacaaactaacacctgctctgacctcccctgcagcctcactatccccagacaggctttccccgggccctcaggtgggcaggataccgcatcagccgtagcaggcagggctctttgttcccccgtcagtggggcccgagtgttactgagagccaaaggccagcccagcaccacgggcacccctactatcggggcaggagctgagcctggggcagccttccctagccacccccgccgttttaaagcatcgggtcagcgtggcctccatggggaggggtggaggggtctctaacggcgggcacctttccacaccccgttcacctgctgatctgccacccccgcagccttccacgcgctcgcctctcatggcgttttctcaaggtgggaaaggagtgctgagcaaatgaaggacaggcccagggcaggggaaccaggtgtgattggagggagagggtgggtgtgagccgggcgtgagcaggaggacgtcacctgacccctgagtcacggccggagctggcccaggctgtctcccagcagagccttctggatggaggagtttccctctctggtgggagaagcagacctggcgcccctgcttcagctcaggataggagggtgtaggggtgggggcagggggagctctggctttctgactctgctgagccgcagttttgtcatctgtgatacgggtgcataccaaccctgtggagctctctgaagctactcggaatgggtaatgtgccccaggcagggctcagctgggcaagtaggggagcaagagcagcctcgggacccaggcctgggggacaggtggtcgttgaacagaaagccagaacctggtctgagaaccactaagccaggctgatgaggccgagatccgtggaccaacctctttggctcccagctccatcatggagcccgaggtggcctgaggcggggagtagtgggtgaccattagcaacatgggcaggagggttcccagcggtcacctcaaggcaggaggaccaaagaccagaagccgtggcagggagttgctgtctgggctctgtccacaccagggtgctagaccctgtgttctgtcccctgagtggtgggggttccatcgtggggggtcgagcatccctggcccctggatgctgccgggcctggggtggcccagggactggtggcccctgctggctggcacttggacccttggcaaggcagtccctaagctctcagtcctcctgccctggggcaggaggggaggcccctgggcagcagccagcagcatccccaaccacagattggggggctgcagtccaggagggtgggtgctgggcctgggccctgcagcagctcacaggactcagtgggggccccaaggaggtgaggaggctgcactcccactcccagaaagcagcagcccaccaagagggtgtgtgtgtgtgtcctagccttgttcccaaagatgtcagaggtgatctgcattcagacatcttataaattggtaaacacctgtaatcccaacagagtctcgctctgtcacccaggctggagtgcagtggcgcaatctcatctcactgcaacctctgcctcctaggttcaagtgatactcctgcctcagcctcccgagtagctggggctataggcatgcatcaccatgcctggctaatttttctatttttagtagagacggggtttcaccatgttgaccaggttattcttgaactcctgacctcaggtgatccgcccacttcggcctcccaaagtgctggaattacaagcatgagccactgcacccggcccttatttatcttttaaggaatagagtgactcagggaagaggcgtgggagaccgtgtgctccatcctgtttggtcttcaaggcatcctcctggagagctgcgccttgtcacagtcagggctcgatgaaattatgttgacaacagaaatgagcagacacggcttcttaacatttgctgttctgtcttccacaccctaaggtttgttaaacgagtgaaatcggtggttaattagttagtggttggtctaccatcggcatcaccggggtgtccagtggggtggattcctctgcatctccagggctggggttctagaaactgctttatcgttgttgtcttttgtgtgcttgttgtaagttttgtgcaggattctcgtgaacgctctaccccttacctctcaaatgcacaatctcaggccctggccccatctgctgaccctaaatctgcatttcagccccgccttggggtccgtgggcctgccgggacatgtgagcctcacctgcactgtgacagcgtctggggtggaggtggcacttaggaaaacccagggtgggttacgataggcttcccagtgaccctgactgcacccctgctgagagctcagatttgtttgggcgtccgtgtgtgtgtgtgtgtgtgtgtgtgtaagtgggtaggtgtgtgtgtctgcacgcacgcacaagtgtttgggggtgtgtgtgtgcgcgcgcgcgagagtggatgggtgggtgtgtgtgtgtgtgtgtgtgtgtgtgtgtgcaagtatacaccacacagcagctaagccctggtaggaggtctcagaggcgggtccattggagtgctgatgcccaccccgcgtgccctctcaagcacccactttggaccccgtgatattcatctccagaaggaatagctccgtttcaggaaagtgctgctgggtgggctgtggcccaggaatcacgaggtagggggcaaacatgctctctggatgtgctggccctgggaagaggaagaggaggagtcccaaggtggagatgcctgcagccgaaggccctcccagagaagggaagactccagaagaagagagagggactgggaagcgtgtaggccaaaggggtgcccacaataagcgtgggcccatttgtcattttccatctgaccatgaaagtaatagcttacagccaggcacggtggctcacacctgtggacctagcactttgagagggcaaggtgggtggattgcttgagctcaggagttggaaaccagcctggacaacagggtgaaactctgtctctataaaaaatattttaaaaattagccaagtgtggtggcacgtgcctgtagtcccaatactctggaggccgatgtgggaggatcacttgagtctgggaggttgaggctgcagtgagtcgtgatcacgccactgcactgcagcctggccaaccgagtgagaccctgtccctgccacaaaaaaaaaagttggcctataattgagacttctgggtctatacccaaaagaattggaagcaggatctcaaagagatatttgcacacccatgttcatagcagcatgcttcacaaccgccaaaaggtagaaacaacaaagtgcccatcgttagctgaatggatatgcaacgtagtcatccatacaagggaatattcttcagcctcggaaaagaatgaagtccaaatgataataataatgaagtcctgatacatgctacaacatgaataagacttaaaaacctgatgtgaggccgggcgcagtggttcatgcctgtaatcccagcactttgggaggcagaggcgggcagatcacgaggtcagcagatcgagaccatcctggctaacacggtgaaaccccgtctctactaaaaatacaaaaaattagctgggcgtggtggcgggcacctgtagtcccagctactcgggaggctgaggcaggagaatggcgtgaacccgggaggcggagcttgcagtgagcagagatcgtgccactgcactccagcctgggtgacagagcgagactccgtctcagaaaaaaaaaaaaaaaaaaaaaacctgatgtgaggtgaaagaagccagccaggaaacaccacatactggatgattccattccgagatgttcagaataggcaaatccacggggacagaaagtagagtggtggtcgccagaccctgcgggagggggtttaaggagtcatcgatgggattcgagtttagttttgcaagataaatagagttctggagatcggctgctcagcgacatgaatgtgacttaacactactcaactgcccactttatggtgtgtattttaccacagtaaacacacaaggaaggggagaggaggggaggggaggggagccaaggagagagggaagggagggaaggaagcttccaccttttggctgttgtgaagaatgttgctatgaacacgggtgtacaaatatgtctttgagatcctgcttccaattcttttaggtatagacccagaagcctttttttttttttttttttttttttttttttttttttttgagacggagtctcactctgtcgcccaggctgctggagtgcagtctcacaatctcggctcactgcagcttccacctcccggtttcaaataattctcctgcctcagcctcccaggtagctgggattacaggcgtgcaccactacacccagctaatttttgtatttttagtagagacagggtttcaccatgttggccaggatggtctcaatctcttgacctcatgatccacctgcctgggcctcccaaagtgctggtttcacaggcgtgagccaccatgcccagccaacccagaagtcttaattataggccaactttgttttttgttttttgtttttgcagtggggacagggtctccctctgttgcccaggctacaatgcagtggcataatcacaatcatgtctcactgcagcctcaacctcccgactcaagtgatcctcccacctcagcctccagagtagttgggactacagacacatgccaccacacctggctaatttttttttaataaggaagggagggagggaggaaggaaggaaaggaaggaagggagggacgaagggaggaaggagaaagaaaggaaagaaaggaaagatagagaaggaaggaaaggagagaggaaaggactccttccttccttgcagtccctgtagctgctttcctcagggagcgtgaactgatcgtcttggcccctctactgagactggagtggagggacacagcactccatcgggggaccgtggtccccaactccaggactgtccagcagtaaagcaggcagtagcctcagaaacgctgggaggagtagggaggatgccaaggcacaggagcctctgccagggatgcaactgacacagactggagatgagcacctaagaattatgatgctctttccggtccccatgtagctgggggtggcgatatgaccagccctggccagtgagttctaagtggaagtgatgcggggtgctctagatctggaggatttcattgccagacacaggcccctccaggactgtccttccctctgccacggtggttggcagtgtcccaggcaagcctgctccagcaggtagacgtgtggcctggataagaaggccggctacggtggtggaggcccctgtgattgggagatgcttgtcgctcggcacaaccaggtttgacttgacgctacactccttcttcccagtaccctagaatcacgtagtccttgagtggggagaaggccagcatgggatatttcattgtatatatttatgtatgtcatacacccctcatgggcagagccaggacctccaggatctgatcgtaaattgggcactgtgtgatattgggcaggtcgccctgtcctcagtttcccgatctatagccaggatctccccagctatgaaatcagtgaccagcactgtttctttgcctgtctgtgcaccgtggactcacatgcagagcagggctgttagattgtaaactccagacaccagacatctctgacaaaggagctctgtgcagatgacaagcatcgggcagacgcgtacttaatggtttttgacctgaaggtgataatggcttaataataaacggatggttttacccccaagaacccttcttctcattgactgatgtgtttgcagagagctcagaactgctctcacaggctgtaaaaagctataaaaatgtaaactatcattgacatcatctgcaagaggaatttctcatactgacattcctcttctcacgatggggattcatgtcagcctgtgcttggtaggggaagaggccaggggagtgtaaaatatgaggatgcaggatcaggcgggctctgatttgcaagcagccgaggcagatgccaatgatcatgcagagaaggagtttattgaagaatgttgcgagctcctacagctgtgatgaggtgggtgagccaagcccacttccaggaacggtgtcccaaatcaccccacaggacagtgggcctgatgggaaaccggcagcattgcagccaccgaacggggaaggcacccatcatatggggatgctcccacagcacagagaggtgcccatcatatggagatgctcccactgcacagatactcccattgcacagatactcccacagcacagagaggtgcccatcatatggggatgctcccactgcacagatactcccattgcacagatactcccaccgcacagagaggcacccatgatatggggatgctcccactgcacagatgctcccacggcacagaaaggcacccatcatatggggatgctcccactgcacagatactcccattgcacagatactcccaccgcacagagaggcacccatcatatggggatgctcccactgcacagatgctcccacggcacagagaggcacccatcatatggggatgctcccactgcacagatactcccattgcacagatactcccaccgcacagagaggcacccatcatatggggatgctcccactgcacagatgctcccacggcacagagaggcacccatcatatggggatgatcccactgcacagatactcccattgcacagatgctcccaccacacagagaggcgcccatcatatggggatgctcccactgcacagatactcccattgcacagatgctcccaccgcacagagaggcacccatgatatggggatgctcccactgcacagatgctcccaccacacagagaggcgcccttcatatggggatgatcccactgcacagatgctcccactgcacagatgatctcattgcacagatgctcccactgacagagaggcacccatcatatggggatgctcccactgcacagatgctcccacggcacagagaggcgcccatcatatggggatgctcccactgcacagatactcccgttgcacagatgctcccaccgcacagagaggcgcccatcatatggggatgatcccactgcacagatactcccaccatgcagagaggctcccatgatatggggatgctcccactgcacaaatgttcccactgcacagatactcccaccacacagagaggcgcccatcatatggggatgatcccacggcacagatgatcccattgcacagatgctaccactgcacagagaggcacccatcatgtggggatactcttgctgcacagatgctccccacacacagagatgccccagttacgctggaccaaacccaactgccaccagcgccaatacccattgtgttccaggcacttcactttgtagccactgtgtcctccctcaccacccaagctgggcatcgctgggtgatgaattctagggcagcctcctctctcagggtggacatcacaatggtgcagtctgtcactgtctggtccctggtggcaaagggaccgggtaaacccgttgtcaggccaccttggggctgtgagatgtctgtaaggtcggtagtgccagtatggtaaaggcatttgaggggtgggcaggtcggtgcacaagatcagcgtccaccctgctgtcaaccagggcagcaggagcatggccacctcagctgcaaatcaggagggtttccattattggacccaaagatcgcagaaaacccagtggaggcagtttgcaggcggtactaaccacacaatgcatttgctctgacacaggaccagggcacgtagtagacgggcaggggtcagggaacctgcctggggttctgggccaggctacatagggataaagcaagccccttaaccgactggatcccaggatcctggcccataaagggagagggttggaagaagatcttccacatcccttttgccctaacctggcagtcatacacccaaactggggggtagtgttggctttgtggttttaataaggttaaaagcaggccaagtcttagctcaagaagctggcaggctgagttaattccggagaaaacaaacgggaagcccaagaccttggacatagatcttttattccctcctccttgaaattctccatccccaagcgcttattaatgtggaatttgctgcttgggggagaaccaactctccgacttcagaaacatttgtaagagcaaatttaataaagctaagaataataccattcagatgtaattcctttattttgcatgattattccttcttttctatcgcaaggcatttgaaatgcaaggagttattgagatagcaacaaaaggaaatggctaactggttgattactgattaaacagtgcttgggaaaaaacagaagaaagaacttgaaaggggaaccagcctgggttgtacagttcttttatatttctttttcctttgattatgaatggcagaacacacctgcattctttgccacacaatcattcggtattgttgctttattgtatgtatgttaatatcgctaagctatggggtgaaatttgtatgagattttcacaaaacacaaatgcaaggagggtggtatttcccctgacatctcttaatactgtgaaattattctgccagccgtaggccgactgcggggggagtttcccttactcccgtccaaagtcgctttttaaaacagaaaccctgcaaattgcccttctttcatgagggccggatcttacattggtaatataaaagatgtttacattccacaaaaggaaaagagaaccctgcacccagcgccagatgaaaacgatccagtgtgtgtacgttgctggaataagacattgtgacttccttgtcatgttttgagagcaatgaagtgttaccacttcaagtccttcgagagccgggaaagtataaaataataacacacaaattgtgttgtgttagttgaacaggccacaggctaggatggctacgaattctttgctcaggaataaggcagctgcttgagtgttgagagaatgaaatggaggttgtccgttcatgttgtcagagatgtttgaaccaaaacgactccatcttgaataggggctgggtagaatcaggctgggacctactgggctgcattcccaggaggttaggcattcttagtcacaggatgagataggaggtcagcacaagctacagatcacaaagaccttgctgataagatagcatgcagggccgggcatggtggctcacagctgtaatcccagcactttaacaagccgacacgggtggatcacctgaagtcaggagttcgagagcagcctggccaacatggtgaaaccccgtctctactaaaaatacaaaaattagctgggtgtggtggcagcgcgcctgtaatcccagctacttgggaggccgaggcaggagaatcgcttgaacccgtgaggcggcggtggcagggagccaagatggcgacactgcactccagcctgggtgacagagtgagactctatctcaaaaaaaaaaaatagcatgtggtaaagaagctggccaaatcccaccaaaaccaagatggcgatgaaagtgacctctggtcatccttactgctcattatatgccaattataattcattagcatgctaaaagacactcccaccagtgccataacagtttacaaatgccttagcaacatcaggaagttgcccaatatggtttaaaaaagggtggactctcagttccaggaattgcccacccctttcccggaaaacccatagataatgcaccccttgtgcctccctcagactcccaagtagctgggatcctcctgcctcagcctcccaagtatctgggattacaggcacccaccaccacgctcagctaatttttgcatttttagtagagacggggtttcaccatgttggccaggctgttcgcaaactcctgacctcaggtgatccacccacctcggcctcccaaagtgctaggattacaggcgtgagccaccacgcccggccagcttgggtcattctaatctcttctgaaatgaaggagaaaccactgcccgagagcctctggaaaggcctggtgggcagcaagggtgctgggggggggggtcccaactattcatgggggctatgtcttcatcagcagcgtgagaatggactcatacatcctctaatcagacccctctgcaattgtctggtcttcatcaaaccgaagcatagaaatacacattggccggttgctttgggccttcatttccttaggaaagttcctgtgtcacataaaacgtacattaaacacgtgtgtaggtttttctctgataaatctgtcttttgttataggggcctcagccatgaacccagccatggttgaggaaaagatctctttttatccgcaacaccagcactccccatgtgccaggctttgtcatcagggcttggagagagagaaagagagggcacaataagccccagccatccaggcaaagtccagttactctgacctgaactgctcactgtggccggaggaaggcctggggtgactggcacaggcccagttccttccagaacctgaaataatcattgtggcagggagtcgttgatccaaaggaaaaaaccgaggcaaaatcaatacaagtaagagtatatttgggggctgggcgcggtggctcagacctgtaatcccagcactttgggaggccgaggcaggcagatcacctgaggtctggagttcgagaccggcctgaccaacatggagaaaccccgtctctaccaaaaatacaaaattagctgggcgtgatggcgcatgcctgtaatcccagctacttgggaggctgagacaggagaatcacttggacccaggaggcggaggttgcagtgagccgagatcacgccattgcactccagcctgggcaacaagagcgaaactctgtctcaaaaaaaaaaaaaaaaaaaaagaatatatttgggtcaagtttgaggactgcaacctgggagtatacattcaagttgccctgaatattcactgtgattagcaacagttacaagtaggtttttgaaggaaaagaagaggcagttcctaaattgtttaccaagaatttacattaaaataacataaattggctaggtgcagtgactcatgcctgtaatcccagcactttgggaggccaaggtgggtggatcacctgaggtcaggagttcaagaccagcctggacaacatggtgaaaccctgtctctactaaaaatacaaaattagccgagcatggtggcgggtgcctgtaatcccagctacttgagagcctgaggcaggataattgcttgaacccggcaggcagaggttgcagtgagccaagattgagccattgcactccagcctgggcaacaagagcgaaactctgtctcaaaaaaaaacaaaaacaaacaaacaaaaaaaaagtaaattgttctaaagagcttctgcatagcaaaaagaaactatcaacagagtaaacagacaatctatagaatgagagaaaatatttgcaaactatgcagctgacaaaggactaatatacagaaacaataaggaacttaaatgaatcaacaagaataaaataatcctattaaaaagtgggcaaggggccaggcacggtggctcatgcctgtaatcctagcgctttgggaggcccaggcaggcagatcccttgaggtcagaagtttgagaccagcctggccaacatggtaaaccccatctctactacaagtacaaaaattagctgagtgtggtaccgtgtgtctgtaatcacagccacttgggaggctgaggcaggagaattgcttgaacccaggggaggaggttgcagtgagccgagatggcgccactgcactccagcctaggtgacagggcaagactctgtctcaaaaaaaacaaagaacaaaagacatgaacagacacttctcaaaagaagacatacacgcatacaagcagccaacaaacatgaaaaaatgcccaacatcactaatcatcagagaaatgcaaatcaaaaccacgaggagaaaccatttcacatcagtcaatggctattattattattattttttctgccagcatcttgattttggacagaatggctgttattaaaaagtcaaaaaataggagatattggcaaggctgcaaagaatggggaatacttatacactgttggtgggaatgtaaattagttcagccactgtggaaagcagcttggagatttctcaaagaacttaaaatagaactacccttcaacccagcaatcccgttagtgggtacacacccaaaagaaaagaaatctttctaccaaaaagccatctgcactcatatgtgcatagcagcactattcactataggttagatatggggtcaactgaggtgcccatcaatagtggattggataaagaaaatgtggtacatttccaacatggaatactatgcagtcatgaaaaagaatgaaatcttgtcctttgcagcaacatagatgcagctggaagccattatcctaagtgaattcatgcagaaacagaaaaccaaatatgacatgtctcacttctaagggggagctaaaccttgggtacccacagatataaagatgggaacaaaagacattggggactccagaagggtggggggagtagggcaagggctgaaaaacttcctattgggtactgtgctcactacctgggtaaggagatcaacagaaaaccaaacctcagtgtcacccaatatatcccctaacaaacctgcacatgtaccccttgaatctaaaataaaaataaaaataataagttgttgattggctacacatttttctctgtatcacaagttgcaggaacatgcagataatgggtgaggcagtgagtcaggaacaaaatgcctttaaaccatggcccccacggccgggtgcggtagctcatgcctgtaatcccagcactttgggaggccgaggtgagtggatcacttgaggtcaggagttcaagactagcctggcaaacatggtgaaaccccgtctctaccaaaaatacaaaaaattagctggacatggtggcaggcccctgtaatcccagctacttgggaggctgaggcaggagaattgcctgaacccaggaggtggaggttgcagtgagctgagatcgcgccattgcactctcagcctgggtaacaaagcaagactctaaaaacaaaaacaaaaaacaaacaaacaaacaaaaaactatggccccccaagcactgcagggggacctggactgaagtcctatactactgtttctctgggcctgatatattttgttgtatctaagctgctttcctcagatacaaatccttcaacaaaccctagggaaaatttcctctcaagtccctccaattctcccagttctgccacgctttgtacacccctaacgaaaggggccaggtgcagtagctcaggcacgtaatcccaacactttgagaggctgaggagggtggatcacttgagcccaggagttccagaccagcctggacaacatggcaagactcctgtctctacaaaaactacaaaaattagctgggtatggtggtgcacacctgcggtcccagctactcgggaagctgaggccggaggatcgcctgaatccaggaggtagaggctgcagtgaaccaagttcaagacactgcactccagcctgaacagagcgagacccctgtctcaaaaaagtaaaattaaaaatggggcccggcgcagtggctcacgcctgtaatttcaacactttgggaggtggaggcgggaggatcgtttgaggttgggagttcgagaccagcctggccaacatggtgaaacccggtctccactaaaaatacaaaacttagccgggcttggcggcgcacgtctgtaatcccatctactatgaaggctgaggtgggaggatcgcttgaactcgggaggttgaagctgcagtaagccgagatcgcgccactgcactccagcctgggcgacagcgcgagactccgtctcaaaataaataaataaatacatacatacataaagtaaaataatgaataaataaaataagaaatggggaaatggatcagcaagaaagtgcccgccccaggcatgggtgccgtgcgggacggggacgcggcccagccgggaatcggggtgcccagggtgcgatgtgcgaggggctcctgagcgcgtgtgctccgcccgaccccgccctgtccccccgacacacaggtggacccagggtcagctcgtgcacctgggaaatggctcccgccgggtagcaggggcggaggggcggggctgggcggaggggcgggggggcggggcctgcccgggagccacgtccggggaggggccaggtgagcggcagacccggcacgcaggtgggggccggcggggtccgtggccaggtaaggcgggcggcggcgggagggagcgcgcagggaggaggccgtgctcggggtgggggggtgcgccgcgggggctcccagggcgtgtacggggacaaggggccgctggccgggtagggacgcccaggcgggcgcgacgccacgtgcggccggggggagaccctccggccggcgcgcagcctccgggtcccctgtgggttctagactccctctcccttcacctcctttctttcccgcccccccacactcccctcctctgctttttcccctgtcctgttccttctcaccccgcaccgccttccccgccctcgcctctctcagcctgcgttttggtctggtctggccggacggtgtcagctcaaatgttccttttttgcttccgtcctggggtctcaggttaggtcgggtcagcgcctgggggaggcacctcccccgcccccacacaccccaaacctacaaggtgggtgaggtcattcccgtttcatagatgagaaaacggaggccggggcaggtgctgcgctgattcaaactcagggggtggggggctggccggttcaacacacagcggtggaaccccccgggagttaaaagcagaaacttttttttttttttttgacaccgagtcttgctctgtccccaggctggattgcagtgttgcatctctgctcactgcaacctccgcctcctgggttcaagcgattcttgtgcctcagcctcccgagtagctgggattacagggactgacaccatgccagctaattttttgtatttttagtacagacagggtttcaccatgttgtccaggctggtctcgaccacctgacctcaggtgatccgtcttcctgggcctcccaaagtgctgggattacagtcgtgagacaccgcgcccggcctaaaagcccaaagtttaaaccaatccgctagcagcctcggaggtcgtcaggaaggcagggaggccctgcctttcactttccctcaatcctgtggggggtgggggggctcctgagaatccctcgggctctgccacaccctgacttggaaatttctccgctgccttgggaggagtgtgaaggccccggagaaggaaccgcagagtccacccgggaaggagggtgggattgtttggcgggatggggacagcaccttggccaccgacttcagggttttgtgacagaggctgtgtagattccagagagctctgtgccgtccctcgcttgcctgtgaaatgcagtgttggcatttgtccagctgagaactcaatgcttaagactcagccgtttcagaagtcgatgtcctttggttggcctctctgttggcagctttaggatcatgtttgtggactcctcattcgattcactgactaaccattccccaaaccaacgccagagttgggggtagggcgaagagggacatgggatgtgggcctgagcccagctgattcttgtggacagccagctgcctggtccctgccctcaggggcccagagtctggcttctgtgtagagagaatccaagggtttgtgggagcttaggaagggcttcctggaggaggtggccattgagctggaaggtggatgggaggtggatggggaagagaatggcacctactggctagggatacttcgcttgtgaggtacgggtggaaaagtccatggagtgcctgacggggtgggccaatttacttggataacatcattgggtcattgaaactttgtgtgtgtgtgtgtgtgtgtgtgtgtgtgtgtgtgacgcagttttcgctcttgtcgcccaggctggagtgcaatggcacgatctcagctcactgcaacctctgcctccttggttcaagtgcttctcgtgcctcagcatccagagtagctaggattacaggcgcccaccaccacacccagctaatttttgtatttttagtagaagtggggtttcaccatgttaggcaggctggtctcaaactcctgacctcagacgatttgtctgccttggccttccaaagtgcttggagtgctgggattacaggcatgagccaccacacccggccgagtcattgaaacttacttgacttaaacatgcctgggacatcatgccatctgcctaacaagccagttctaggctgagctattcatgggcacactgtaaacgatggagttaaaggcggcttcggttaaagagacgagagcaaggaactcaggtcctggaggtgcctgacagtatgtttcaccacattaaaaaaaacccatcccattccctgattttaccctcatttcactgatagggaaactgaggcacaggcagcatgagggtgagaaagagatggagaaggagtcagcagacctggtttttaggcaggtcactctccttctggggcactcagcctcctcatctgcaaaaggagctattggctgtccttccccactgcgatggtggtcaccaaatggccatgaaaccctcactgcacacttggctgcctgactccttgctcacatcaggaggcacggactgttactgccccgttcacagatgaggaaacagacaaggaaggttaaggtcccatggctagtgattagagagccaggcttggaagccagcggtgctgcagctacagtgttccccgtgtccccaccttcctcccacacacactgtgctgagccacctccctgggcactgaggtgtgcctcccacatgggagctggtgtctggtgtaagatggagccattcggagcctgccggtgactacccttcaaatctatgtgaaattagcatggggagagaaaatagacgttttccatttctttccaaattatttaacttttaccccttggtcctttaattaaaactgatgctcaaggaagatgcatcacgtgtgtccagatgcttcccaggcctccctggggtgcatttgaggggagagcctctgggccctgcactgtgggacttagctgcaggagagcgcgctgctccggagtcctgccccagctgccttcacagggcgtctccctggagcttctggcagcctgttgtgtccagatttctgtgtccctggaaggcagaggacctggctgagtgactctctctccaagttaggtctttgggcccccattttctcacctctcagatgggtgtcataaaccatcggtttgtcttgaggctggggaagtggggggtggggataatgtcagggctcaggagaggcaggcgctgcaatggttaacaaccgggatggggcctgccttcctctctcttgacctggagtcagttgctgtccactctgcttggtttcctcgtctgcaaaataggggccatgtcattaccgactcataggaccattaggagaactaaatgagttaatgcatgagaagcgcaggtgttcctgtttattggtcttggttctgtctcctgaccttgggggaagatcttgcttggggagaagaatgcgctttgtttagagcctgctccttccacgctgaaggccaaggccaaacagttctttcttcagtggcctggactttgcaggggaggagagtggagccggtgactgtccagaaggaactggttgggcaggtctgaattcctgaaactcctgggtagctccccgctcccttcccctacctggccgtaaaatgaaaacaagcaaaggaaactcagacggggcagtgggtttttctgggctgcaagtttgttatcacaggaaaggttgaccccgtgtggcactcgggtggggctccctgaaggtacctctgaggcccctgcagctgggactcccacctgactctccaaagcggaccccacgctgttgtaattccttgcattttgtataagagggtttattttttcatttcagttctttttatttgtggagaattttagacactcaaatgatgtacaatgagccgccatctcccagcgtcaactatagccaccctgcagccaacctggcctgtgctcaccccacaccccgcccccccaccccatacacctacccccacccttcctgcaactcacccttccaccctctcaccccttctctcccctccctattccccatatcattttagagtagctcccagacctcatgctccataaatactgtaagttgaatcccttttctaaaaaattattttttcctccagctttatttaggcataattggcaaacaaaaatagtacacatttacagtgatcaatgtgatgttttgatatatgtatgcattgtgatgttaaatcaagcttgaatccatccctcacttttttttccgcattactgcaatactattatgtttaaaacgattagcaacaattttttattttttccttttattgagataggatcttgctctgttgctcagactagagtgtgattatagctcactgcggcctcgaactcctgggcttaaaggatcctcccacctgagccttcccgagtagctcagactacaggtgcacaccaccctgcctggttaatttttaaatttttgtagagacgaggtcttgctttgttgcccaggctggtcttgagctcctgggcttaagcgatcctcccatcttggccccccaaagtgctgggattacaggtgtgagccactgtgcccggcagcaacaagttcttaatatcagccaatgctcagtgttcaaattcctaattgcctcaaatatttaatttttttttttttttgagacagagtttcgctcttgttgcccaggctagagtgcaatgatgccatctcagctcactgcaacctccgcgtcccgggttcaagctattctcctgcctcagcctcccaagtagctgaaattacaggcatgcgccaccacacctggctaattttgtatttttaatagagacaaggttttaccatgttggccatgctggtctcaaactactgacctcaggtgatccgcccgccttggcgtcccaaagtgctgggattgcaggcgtgagccaccatgcctggccctttgatctttcttttaaattccttccaaactttaaccccctgctcctttggagtgtttttgttgttttgttttgtttttgacctggagtctcactccatcacccaggctggagtgtagtggcgtgatctcagctgactgcaacctccgcctcctgggctcaaatgattctcgtgcctcagcctccggagtagctgggattacaggcacctgtcaccatgcctggctaattttttttttttttttttttgtatttttagtagagatagggtttcaccatgttggccaggctagtttcgaactcctgacctcaagtgatctgcccaccctaggcttcccaaattgcagggattacaggcatgacccaccgcccccaggctgtgctgctttttcatagcagccagtggtctccacctcagaggtacagagggggatccctggatggggtcacagagggagtcggaacaggtgggaggcacagggctgcctgaacttctccagggacccatggcagtttcctctggctgcagggagggcaggtctctttagcctggctaaagagtaaccagatctttctgtgaagaggcatctgaggccgggcacggtggctcacacctgtgatcccaacactttgggaggccgaggcaggcagatcacaaggtcaggagattgagaccatcctggccaacatggtgaattagctacttgtggtggcgtgcacctgtaaacccagctactcgggaggctgaggcaggagaatcgcttgaatccgtgtggcagaggttgcagtgagccaagattgtgccactgtactccagcctgggtgacagagtgagattctgtctcaaagaaaggaggcatctgaaggccaaggctgggtgtatgggggctccgtgaatccccactttaatttcccaggcagccggtgaggaggtagatttgaattgagactgagtcattgaattggactttagccaatgatgataatagaaaccatctgtggctcacttactttgtgcagggctgtgcgttccaggtagtggggagggggggaacatagcgtgtgcaaaggccgtgaggtggcagtggggggtgtatttgaggggcagccgggaggccggtgtgccagggcaaaggcagtggggtgggagtgaatgacatgagctctggagggcagcaggtccaaaccacaggctctttcaggcttgtgcaggggtttgaatgttattccaagaatgacaggaagcccttgacagagggttgtcatggaaggtgttgaataggcagtttggatattcaagtttgagttgggagagaggtcggtcctgagatctgggtttaggagtggaggacacggatttaccatttttttaggcgggagaagagaaagcccagtgtgaacccagcaggcacaagtgtggatggtagggatcatggcagaggccccagctgcatccacttcagggacagcctggaatggcagagaaagaggtgaacgaggtggatggtggggtgaccctggagtgtgggtggaaccaggccacgctgggccttggatcccggggtctgtcccaagccctctgcttgttcttttattcaacagacctcccaagtccctgctcgtgtccccagccccgggttggctgagtgcagagactcagacgtgagtcagacatggccctgctgtcagggcacacacagtgatgggtcaagaagagcatacaggtacatggtgcagactgatgagggctgtgatggacctgggggctgccagagcccacaggaagcccctctcccaatctggggtaggcagggcacctggagcatcaggacgcttttggctgtaattaacagaaaacacaactctgaaccggcccaaagtcaaggggggtgcattagcccatgtagctgcaaaggtctggggatagtatggagatcaggtgtggcttgatcaggggttagctattcccttcattctctgtgggctgctgggtctgcagaggggcggcaagttggctgcagccctccgggtctcatctgcatacccagctgcgcagagactctcacagtggttctgtcttgagaaacaggatcttctgtctcagaagtatcctggagcctcaggggcctgaagggagatggtcagggagattgtcagggagattgcctcgtgctgattagctctggcttgggtttctgaattaacctttgaaaagggagatatgattactcttagcctaactgggcgggccctgggaggcgggacagcctcacctcttgcagctggagggtgtgcaggtgagagttgcgcacccgaatgatcacctgggtgcccttgcgcagggcagcagagatgcttggtgttccctaaaggctgtgtgaggagccctgagtcttgacccacaggagagggggtgaccccagcagccctttagagacccccttgccctttcagggtgctgaaggtttcctgcggtttgtgggcaggcctctgacaaggtcctgatgcaggtcacagtcagcttgtttggacttcgctgccgccaccttcgggggtctcatgtatctgctacctggacaaatggccttgcgcatgccgtcttgccagcgttggggacccagtggtggttgtgatgaagactgggtagtgagggtctgtattaacgaattcatgcatagctgagacaaaagagtggaagttactttttatgggatgccactgggggaccctggaatcccagctcagtagtgacccccattcagccatgagcaagatctcctgcccccatcattcctggactttcccaggagtcgctggccagtgtctgcctcaggtatgactgtgtgcaagcttctttgtctctgggtcttggaagcttaggcctgggtggcatcaaactcattgcctccttctcccaagagccctttatcagaacacccagttccaaaacgagagcctgcattgtgcaaataccacagcgagctcttcctctgtatgccctgcacatcggacttgccactcaaattaagtttggtgctaatttgcccgaggtaagtaggtgttaatttgtagctacagcattaagataattgctgtgagggtctatttgtgtaatgtgcaaatatatttttacagcaacaaaccattttgctatgaattataaatagaacagttgggtgatttgaattttcctttgcataacatccactctgccagcatgcctgttcgggtccatgtctaatgaggggctgcagctggcccagccccacagatgctgatggtgcctctgtgtccttgtccccgaccctgggggggatccgagagaaagggcttgtcagggagggtcgggagggagttgaggcatgtgcggactcacatgcagggcgaggcaggctttgggggatggagcttctgctctgaagcccactggccaggagaaagggcccacttgtaatgtctggtttattttcacttcattttgatgattacgaaggacctgcatgtaccaggccctgtactaggcaccacggatactgtttgagcaaatccaggcatgggcttggtcctcgtgaaactttgatctgctaagggaggcccatgttaacattagcaaaaggatcacggaaataagtgccatcagccctccgtattggtggcctctgtattcgtgggctctgcatccgtggcctctgtaaccgtggactctgtatccatgggctccatattatgggttcctcatctgtggattcaaccaaccgcggatttagtgtattgggaaaagaaaataaatggttgtgtgtactgaatttatacagacttttctccttattccctaaacaacacaatgtaagaactatttacaggcatttacattgtgttaagtgttacaggtaatctagagatgatttaaagcatacagaaggatatgcataagttatatgcaaatactacaccatatttcagcaggggcttgagcatctgtggattttggtatctgccaggagtcctggaatgaattccccaagggacgtctgtaaacttgcacctggttgagagctatgagtaatggatacagggagctaagagtatatggagaggggcctgccatgctcctgtttggaaagagagaatatgttagtcaatttttacgctgctgataaagacacacccgagactgggtaatttataaaggaaagaggtttaattgacttacagttccatgtggctggggaggcttcacaatcatggtggaagtgaaggaagagcaaaggaacatcttacatggtggccagcaaagacagagtgagaaccaagcaaaaggggtttccccttataaaaccatcagatctcatgagacttattcactaccatgagaacagtgtgggggaaccccccccaactcataattcagttacctcccaccaggtccctcccataatgtgagaattatgggagctacaattcaagatgagatttgggtgggaacacagccaaaccatatcagagaattgtcttaacagagatcagaaggacagacaggagctgacctgcaggtgggggctgtggtataatgaatcttagctgagcacagtggtttgtgcctgtgatcccagtgagccggaaggctgagatgggaggatcacttgaggccaggagtttgagaccagtttgggcaatatagtgagacccagtctctacaaaatacatgaaaaagccaggtacagtggtgtgcacctgtagtctcagctactcgggaggctgaggtgggaggatcgcttgagcccaggagttcaaggctgtagtgagctatgatcataccactgtactccaacctgggcaacagcatgagaccccatctctaaaacaaaaaaaaatctttgttaggtctttgtccctggttcctggcagagctcctaaaacccttggaagagcatcttttgttactcattatgaactctctctctctcttttttttttttttttttgagatggagtctcactttgtcacccagactgcagtgcagtggcacagtctcggctcactgcagcgtccacctctcgggttcaagcgattctcctgcctcagccttctgagtagctgggattacaggcgcccaccacccctcctggctaatttttgtatttttattagagatgaggtctcaccatgttggccaggttggtctcgaactcctgaccttaggtaatccacctgcctcagcctcccaaagtgctgggattacaggcatgagccaccgttcccagcgattatgagctctcttgaccgtacctgagtttgtactgtaatgaggtgactcaaggaggggcctagatagcttcaggatgggggctgtcccagaggaaccagccatgagattacaagttggagctatcagtccctcacaacctttggggaggggagagagactggagggtgagcggatcaccaatggccagtgatttatccaatgacgcctacataacaaaacttgggtccaaattgtgaaacaacaaggctaagagtctgttttcatgctggttgggaaggtggggagaaaaacgactttccttttttcagtgcctgctcattcaatgggcttggttcccagagcaaacttagagcaaaagataattttcaggctgggtgtggtggctcacacctgtaatcctaacactttgggaggccaaggcgggtggatcacttgaggccaggagttcgagaccaacctggccaacatggtgaaaccccatctctactaaaaatataaaaatcagccaggcgtagtggtgcgtgcctgtaatcacagctactcgggaggctgagacacaagaatcacttgaacctgggaggcagaggttgcaccgagatcacgccactgcattccagcccgggtgacaaagcgagactctgtctcaaaaaaaaaaaaaaaaaaaaagatacttttcagaagagggtaaaatcatgactgtcatacagatgtaaaaatgaacgcattaaagattttatttagctcatgagagaatcaggcagatgttagcgactgaaaagggaatcggaaggacagggcatttgtagatcagggtattgaaatggaagtgcaaatggaggcaaattcggggagttttggcaggagaaggggaggaagggagagaaggcaattgcacttccaccagacaaggcggaatcggtgtgtttattggtgagaatgattttctttttcttttcttttttttttttttttgagacggagtctcaaaaaaagtacaaactcaggtatggctggagtgcagtggcacaatctcggcttactgcaagctccacctcctgggttcacgccattctgctgtctcagcctccccagcagctgggagtacaggtgcccgccaccacgcctggctaattttttttgtatttttagtagagacggggtttcaccgtgttagccaggatggtctcgatctcctgacctcatgatccgcccacctcggcctcccaaagtgctgggattacaggcgtgagccaccgcgcccggccatgattttcactgctataagttatccacagcttgcagagttgtaaaacaactcccgaagagtcagagtcagagaacctggaggagcgttctctggtcttcatgatgcaagcgtgttctgttgaggcccacatttgtcactacaattacagggaagcccctgcagggactggtagcaaatgctggaaaaatggatttgtggcatgagatctaaataatagttcaagacaaccgatgaggaagaggagaggggtcccatggcaaagacaggcctgagagtgacagccacgtcctggtgccatacagagcagcccctcgaaaggcaggaaagggtcggctgcggtggtccggggtggtggcgcgtgcgacggtggttcttcctgctcacgttccttcatgtgtttgacattccctgcatgttctgagtcatgcaggttctctgctggagccgagagacctgggctgcagacgcagctctctgccaacttgctgtgtgcctttgggcaagccctcaccctctctgggcctctgtgttcctcctttacagtgtcagttgacgacacaagatgctcgctggggtggtcctggtgccactctctggaattctggcagttcacgggaaagagaaacctgagtgtgcggaaaagtcctgcgtcagtcagtgttctccaggccaacagaatcaatagcagttacgtgtgcgcattacgtgtccctgcgagagggagctgagagtgctgtcaactgtaggactgagagaggggagaggggctcccggggctcaccctggcacactcccctcctggctgttgctacacaaggcccggattatgtggtgctcacattgagtgaggaaacttcaaaacaaatcatcccatcagtggtttttgaggtaggggaaggggtgaaaggctttgtccttgtttggatgatgcagaggctggaggaaaaaacaaagccttcttggcttcagaggtgctgggctctgggcaggctcctcagccctgtgacctgagagtggccctggggccacagctggcccggggcctgcactggggtttgcatgtgacagggaagaggaagagacccagggccgttttggctgttccgtctcgtgtcactgtctcctgcaaggctttgaagcaagaatgctgtagctgtgtccctgtgccctgggaggggtgcatacctcaggaggtgcccctgcattgccagggagggggatgtgtccaggtgggacctggtgcccccagaagtttgcttcccagctgtttgcttggcttgtaacaggtttgtcacggaggctgtgtcgctagtgagggccgggtttcctggccagcccacaaggggggtgtaatcgggaccctaggggccctggggaggggtgggacagagctggaggggcctagagcctgggctgcagtgaggtccaagtggtgggagtgaggacaggtcgggtctgtccccggctggaagctgccctcctcccatcatcaagcatcgggaccccctcctgcctgtcatgaggtttgagtggcatgacagggtggcagggagtccccccgggccaaggacaggagcagccctcgtcacctctgcatctggaagccagggcttgttgggcggccaagggacacatgaccagcatgtgccaagttctcagctcgccaggcggcccttcttcctgaccagctgcctgcggtttggccggagctgtgggtgtagatgattgagtttcttttctcacttttccagcaggcaaggggcagctccccgaagggtgtgaacacagggtcccagcctgggtctcgctcctgtgcccctctccaggccctagcaagctgctccctggcgcagggaggactgggaagaggcactggggctccgcctggagaaggcaggcccaggggcctcggctgggacacgctgggcctcccctgcttggcacccggggtcctgcaccctgccagggaggccaacctgatcctgggtctgcatgcgaggccctgccagctggctccaccacctccacccatctgcctcctgccctcagaagccgtggtctggtctccgggatcaggtgattgtggaaaaacagaggaccaaagcccggggaggctgtggggcggggcgggcagcaggtcatgtacctggtgtgagaggttgtgcgtccctggagggtgctctggaatcagttgtctatactggaggaggaaggagtgtccttgaggaacttgctggagtctgacggcccagaactgcaggtgcggaggagtcagagtgtgtgtgggcacgtgtgtgtgtgcatgtctgtgcacacgtgtgtctttgtgcatatgtgtgtctctgtgtacgtgtctctgtgcatatgtgtgtctctgtgtacgtgtgtctctgtgcatgtctgtgtgcgtgtgtctgtaggcatgtgtgtctgcatgtgggcatgcgtgtctgggtgcatgtatgtgcatgtgtgtctctgtgtgtaagatatgtggaaagtacgcacatgattccaagaccccgcctgcctgtcttcctggggacccttccgggggctctctctgggggtctttgctgccctttcttccttcctctccccagtcctgggctctggcaatgctctggaatccctcaggtgcttggcaccaagtcggtgagtagtggggcagggttcttgctccatctcacagcccagagagagcaaaactcctggccaaggccacacagcagtctggcagcagaatgcagcctgagggagcagatgacaggggctttggggaggccttggggtgggggtggggctgccgcaggtggagtgaggaggctggttgaaaatggatatcaagtctgggaaaatggccactgcttggctccaaaaccaaaaagtctgggcttacctgtgtcaaggtaaaagaaaatgcagagccgggagttacaggagccatcctcaggctggtttgctgtgtgaccttgaataagtgtctgcccttgaacaaatgtctgtaacttcaccggcctttgtttgattctctgataagtggggaagttggatgtatcacggtaatggagctgtggaagggtttccttccttctctgctccctccctccttcccgctttcccgtgactacagaaacatttcagaaatattgctgagaacacacatacactccttatcttgattcagaagttggtattgttcatttcggatgctctttctccccctctctctctctcttttagctgaactattggagagtaagctgcagacccccagcagtccctgctgaacatgttagctgcccctcctgaacagaaagatattctcccgtatagcctgataccattatcacactaagaaaattaccagcaattccttaatgtgatcgactatgcaggccacattcaaatcccgcagttgtccccagaatggttgcagcactcttttataaaccagaacccaccgaggctcccacgctgcctttaactgttgtgtctctttagcttctttcctttggaaaacaaccccctaccacctccctccttttaaaaactgacatcccagcctggccaacatcgtgaaaccgcgtttttactaaaaataaaaaaattagccgggcgcagaggtgcgtgcctgtaatcccaggtactcaggaggctgaggcaggagaatcacttgaacccaggagatggaggttgcaatgagccgagaccgagccactgcactccagcctgggcgacagagtgagaccccatctcaaaaaaaaaaaaaagaaaatttaaaaatgacatcaacatttaaagcaaccaggccaattgtcctgtagaatgtctctcctagatttgtcagatttcctccccgcatgatgtctttttttttttttttttttttttttttttttgtgagacagagtcttgctctgtcacccaggctggagtgcagtggcacgatctcggctcactgcaacctccacctcccgagttcaagcaattctgcctcagcctcctgagtaactggtattataggcgcccaccaccacgcccggctaatttttgtatttttagtagagacagggtttcaccatgttggtcaggctggtctcgaactcctgacctcgtgatccacccgcctcagcctcccaaagtgctgggattacaggcgtgagccaccgcgtgcggcctcatttctttttttgttgtttttgagacagcgtctcactctttcacccaggctgaagggcagtggcgcaatcagcctcagctgcagcctcaacctcctgggctcaagcaatcctcccacctcagcctcctgagtagctgagactacaggtgcacaccaccacacttggctaatttttttttttttttatcttgtagagacaggggtcttgcttcattacccaggctggtctctaactcctggggtccagcacttctcccgcctcagcctcccaaagcactgggattttgggcatgagccaccgcacctgttcttgatgtcttttctcttgttcttggacctaggggtatttcctgtaaaccgaacattagcaccgaaggcttaattagattcagatgaagccttttgggcaagagttccttacagccctgtgtccttcctgttgcaggaaggtatgacatcaggtcgcccttctgtcatgacgccagatgagcttcttggctgaggtggtggctgccagagtccctgtcgtggaggtgtgtttttctttttttttttttttcaagacagagtctctgttgcccaggctggagtgcaatggcgcgatctcggctcaccgcaacccgcttctcctgggcccaagtgattttcctgcctcagcctcccaagtagctgggattacacgtgtgcaccatcatgcctggctaatttttgtatttttagtagagatggggtttcaccatgttggccaggctggtcttgaactccagacctcaggtgatccgcctgccttggcctcccaaagtgctgggattacaggcatgaggcaccgtgcccggcctaagccactgctctgggctgtgtttttccctttgagcagccctgggctttggtgagcatcctgttctccatcatctttcacctgaggctccatcatctgcccacaatcttgccctgaaacacttctcgaaaatcagctgaacatatatgtggtctattcgagactttctgttccattccactgacctgtatgtctctctatgccaacctcatgctgtcctgattagtgtagctttataataggtcttgagatcagaaattcttccaactttcttcttttttgcaattgtttttgccattctgggccctttttagtttcagataaattttggaatcagtttattaatttctgtgaaaaagcctgctgggattttgattgggattgtgtttgaatctagagattaatttgagaagagttgatatcgttaacaatattgtgtcttttaatccaggagtgtgatatatttccctgtatacttagatccctttactttttttcaacaatgttttgtagttttctgtgtaaaggttaggcacttcttttgttctctctctcagtattttgtaattattggtgctattgtaattgtctgatggattcttcctgcctgctacacagaaaacccaattcattgagaccgcaggattgcggtaaagaaacagtttcattgattcaaggccagcccacacaggagaactggagttatgactcaaatccgtctccttgaaaattcagaggctagggtttctcaaggatattttggcaggcagagggctagggaatgggtgctgttgattggttcaggatgcagtcacaggactgtagaaaatgattggcgcagtggctcaagcctgtaatgccagcactttgggaggccgaggcaggtggatcacgaggtcaggagtttgagaccatcctggccaacatggtgaaaccccatctctactaaaaacacaaaaattagccaggcatggtggtgtgcacctgtaatcccagctactctggagactgaggcaggagaattgcttaaacccaggaggcggaggttaccgtgagccaagatcatgccactgcactccagcctgggcaacagagcgagactccatctcaaaaaacaaacaaaaacaaacaaaaaaaacaaaaagaaaattctccttgtctgctgagtccacttctgggtgggggctacaggaccagagtcaggagtcttgggtgcaggtggagtcatctgccaggaatgcaaaagtctgaaaaggccaaccttagattctttttttttttttctttttgagacagtgtctctctgtatcacccaggctggagtgcagtgatgccatctcggctcattgcaacttctaccttctgggttcaagcagtcctcctgcctcagcctcctgagtagctgggattacaggtgtctgccaccatgtctggctaatttttgtatttttagtagagaccaggttttaccatgatgcccaggctggtctcacacttctgacctcaggtgatcgacccactttggcctcccaaagtgctgggattacaggcatgtgccactatgcccagcctaatcttgggttctacagtagtgatgttatctatgggagtaattggggaagatataaatcttgtgacctccaggacaatggctggtgactacacctaggtctttgcagaattcagacccctctcattaatcctcaccttgtagccttgtattcgttttataaagatggtttagttttgggaagggctattatcatttaaactgtaaactaaacttccccagagtcagcttggcccatgcccaggaatggccaaaggcagtttggaagttaaaggcaagatggagttggtcagatcaaatctctttcactgtcataattttttcactgttataaatttggcaaaggtggtttcactgttgttgatggatttttaagttttaattttcagtttgttctttgttggcatatagaaatagaattgatttttgtatattaagttttttccaaaactttgctaattttgtttattggttctggtagttcctttgtagattccttaggatttttacttagatgatcatgtagtttgcaagtaaattttttttttttttttttttttgagacggattcttgctctgtcgcccaggctggagtgcaatgccatgatctcggctcactgcaacctctggctccctggttcaagcaattctcctgcctcagcctcccaagtagctgggactacaggcgcccgccaccacgcccagctaatttttgtgattttagtagagatgtggtttcaccatgttggccaggctggtctcgaactcctgacctcaggtgatccacccgcctcggcctcccaaagtgctgggattacaggtgtgagccaccctgcctggctttttttttattttttatttttttttgagacaaagtcttgctcttgtcccccaggctgcagtgcaatggcgcaatctcagctcgctgcaacctctgccttccgggttcaagcgattctcctgcctcagactcccgagtagctgggattacaggcacctgccaacacgcctggctaatttttgtgtttttagtagagatagggtttcaccatgctggccaggctggtctcgaactcctgacctcaggtgatccacccgcctcggcctcccaaagtgctgggattacaggcatgagccaccacgcctggcctgcaaataaatttttattgctctttccaatctttatgcctttttcttccttgtcttattacagtgggtgggacctccagtatactgtcaaatagaggtgctgagaagggctatcactgttcattgttctgagcgctttcagtctttcagtctttcactgttctgtatgatgttagctgtagattttttgtagttgctctctacatggtttaagaagttttcttctgttcttattttgctagtttttattatgagtgagtcttgaatgttgtgaaatccttttttccttttctgtatctgtttttttcctcatttttttccttttctgttttactatgtttttatgtttctgttttactactgttttgccttttttttttttttttttttttttttttttcaagactgagtctctgttgcccaggctggagtgcagtggcatgatctcagctcactgcaaactacactgattgactttttttttgtattttcttttttcttttttttttttttttaagtagagacagggtttcgctatgttgaccaggttggtctcggactcctgacctcaagtgatccgcccgccttggcctcccaaagtgctgagattacaggcatgagccaccgtgctggctgatttttgaatattaaaacaactctgcaaagctgaaacaaacccttgttggtcatgataggttgtactttttatatattgctgggtttgatttgttaatattttgttaagattgtttatgtctctgttcctaaggcagatgaagctttcttttcttgtattgtctttggttttggcataagggtaatgctggccccataaaataagttagaaggtatttccttatcttctattttctggcagagttagtggagaattggtattatttctgatgtaacatgtagcaccagagttttctttgaatttattttctctctcccacttttttttttttttttttttgagacacggtctcttcccatctcccaggtctcccgtgattgtgccgtggtgcaatcatgtctcattgcagccctgacctcctgggttcaagcggtcctcctacttcagcctcccaagtagctggaactacaagtgtgcactaccatgcccagctaatctttattttttgtagatatgaggtctcatatgttgcccaggccagtcttaaacctctgggcttaagttaccttcctgctttggcctcccaaagtgctgggattataggtgcaagccaccaagcctggccaggaagcttttcttaacaaatttgacttacgtactagatagtgggctattcaggttatcagtttcttcttgaatgagctttggtagcttgtgtctttcaggaaatgtgtcaaatttatctagattgttgaatgtattgtcataagggcatttgtaatattctctcattatccttttaatgtctgtagtatctgtagtgatgtctcctgtctcaagatgtagatttagcttcacctttgtattttaagacatttactttgtaaactttactgtgttctgattggtgaattgaaacatacatgcatttatatagtaataacacctttcccaaaagaccctaaatagcttggtttttactaattacactgtgtgttagcagaacattaacatacttcacaggacagatgttttatgacaccaggatggtatgggatttgtaaaactatgtgaaatgtagaatttttcttttttctctcttttttcttgagacagggtttcattcctgttgcccaggctgggatgcaatgacatgatcttggctcactgcatcctccgcctcccagactcaagtgattctcctgcctcaatctcccgagtagctaggactaaaggtgtacaccaccacatgtagctaatttttgtatttttagtagagatagggttttgccatgttgcccaggttggtcttgaactcctggcctcaagtgatccacctgctttggccccccaaagtgctgggattgcaggcatgacccaccacacccagcaaaatgtagacttattaatatgccatttatactatagtgatgatggttgtgaacatttactgcataccagtcacataccaggtaccatgctgggcaattgactgcattatctcgctaaatccttatattctctctatgaggaaggtgctgttgttgtctatattttataaactaagaaatggagacacgggttgagacaggtgccaaaggctctccaggtagtctggctgcaggatgcacactcattctgctctagggtcttaaatttatgcctttctaactccaagtcttatgcctttccttcaacaccaggctggttttcaacagtcacggggttaaagttaaggatgaactgttgatagagatggattttagtcttggtgaaaggaagaacgttttagcagtcatttccgagccaagatgtagtgaacttcctgagaaggtagtgagtgtcctatcactgccgatgtctgtgccaaggctgacacagctgcagtgataggacattgtagtttgaatataagttatccaatcaacaacatcaacaaaaaaatgcctttataattagtgtctttatggtagcagagactgtatgacatttgactattttcttgtttattggtatttctttgggagatttttttttttttttttttttgagatggagtttcgttcttgttgcccaggctggagtgcaatggcacagtcttggctaattgcaacctctgcctcccgggttcaagtgattctcctgcctcagcctcctaagtagctgggattacaggcacccgccaccacacctggctaatttttgtgtttttagtagagacggattttaccgtgttggccaggctggtctcaaactcctgacctcaggtgctccacccacctcagcctcccaaagtgttggaattacaggcgtgagccaccgtgcctggcctttttttggaggggtgggggcggggggcggatggagtctcactctgtcacccgggctggagtgcagtggagcaatcgtggctcactgcaacctctgcttcctgggttcaagtgattctcctacctcagcctcccgagtagctgggacaacaggcactcaccaccatgcctggctaactttttgtatttttagtagagacagagttttgccattttggccaggctggtctcgaactcctgacttcagttgatccacctgcctcggcttcccaaagtgctgggattataggcacgagccacggtgtgcagccttggggaatattttttaatagaaattccaagaggcaaaggtttcctgggcagcacaacacataaactgaaaggagaatgagcactctgaatttttcatactcagcaccagcgttttatgtaccatatgagctggcctgggcctatgggtcagcagagatggcgagagtctggctgcctggatatcagcctctggtggacttggctgcttctcccctcacggcctcctgggtggtagcttggccatctgcaggcagcctttccctgacctgtggacaactccagcagggctgtcataaccctgaggggacataattctttctctttttttttttgagacggagtttcgctcttgttgcccaggctggagtgcaatggcacagtcttggctcactgcaacctctgcctcccgggttcaagcgattctcctgcctcagcctcccaagtagctgggattacaggcatgtgccaccacgcccggctaatttttttgtattattagtagagatggggtttcatcatgtcggctgggctggtctcaaactcctgacctcaggttatccacccacctcggcctcccaaagtgctaagattataggtgtgagccaccgcacctggcccataactctttaagggaaatttttagtacctgaattctattttttagcacaaatcgtatctcatttttaatcagtttatctatattatgtagctacttagcattctggaaaaattagcttccctggtaatagaaggactccttcagtcacctagattggcccacatttccaaatttgcttgatgtttcaactcgagctttgcctcattcagaaaccagtagccttcctgattctggtcactcatggagtgagtcctcctctcccaggtaagtcagaagcgagtgagtcacctccagatttcaggtcccagctgccaagctgtagtctaaaacttcacggcacttcccatcccctgaagatgtcacaagtacaagctgcttccagaggcttctgtaaccctcattaatatgtaggcatccagccaggcgcagtggctcacacctgtaatctcagcacttttggaggctgaggcgggtggatcacctgagttcaggagtttgagacctacctgaccaaaatggtgaaacccagtctctactaaaaatacaaaaaattagccgagcatggtggcgggtacctgtaatcccagctactcgggaggccgaggcaggagaatcccttgaacctgggaggcggacattgcagtgagctgaggtcgcgccattgcactccagcctggacaataagagtgaaactccgtctcaaaaaaaaagaaaaaaaaaagtaggcatccttgtacttgttaaaattattcctgtgtctccactgtggtgaggcctgtggtaagcaacatctcctgaagtgccacctgccttgtttgagagtcataaaacgctgtcttcttaataggctcctggagttcagatttttcattaatgtaaatgggccctccctgtgttgccctttattctgagttactgaggcttcacttgccggttcccagcactgggcactccgggaggatttggtaattaactgaaagccttgcttcagcgggtggcgtcagagcagaattaatggcgctgcgcactgtaggtggcctggtggcgggggtaggggtgcatgggaagaggtgtttgctgttgcttgtaactcacccctccttccactgggagcctctccctgtatcccccctgcctcaaggcccactgtgccctgcctgctctgtccatcaccctcgctgtctatgcagcttgggacatgtcccaagcacctgctcctcctgcaatgctgttcctgctgtttctgggaccggctttttgccctcaggctcctgagctattgtaggttctagaagcctctgctgaccttctcaggcactcctctgctcaagaacctgctgtgtctccctagcacgtgttcctcaagtctgaatcattccactcccgtaacactctgctattcttcaacaggcatactctaccacctcccgctgggcccaggccttccccttggcacagttggagcagcctctgttatggtatgtgcctgtctcacgctaggggccagggctgggctcagaccctggcggctgactccccatgttgtgcttaaacgttcgtctcaattttgaacatttctcccaacactttttaaataaaatccctgagctcttctgcttggagaaagtcctggcaaatcattcccaacaataaaatctcatgatcagaatgtagtagcacttttctcactagccaggtaggttcatgtcattaaaaggtggctttaaacacttttctcttggcagaaattcaaagactttcgcccctgagcagggtcactctgttgggcctgaagtctcctccctactgctcgttacccatttaacagctgctgtcagacacccagtggctttacttctgcagctgcttttttttttctcccttctgaattcttaacttgtatttgagcccacccagtggtgattgttttgttttattttatttagttagttgttaattttgagacagagttttgttcttgtcacccaggctggagtgtaatggcacaatcttggctcactgcaacctccgcctcccgggctcaagcggttctcctgcctgaccctcccaagtagctgggattacaggtgtccgccaccatgcccagctaatttttgtatttttagtagagacggggttttaccatgttggctagtctgttctcaaactcctgacctcaggtgatccacctgcctcagcctcccaaagtgctgggattacaggcatgagccactgtgcctggactattttatttatttatttatttatttatttatttatttatttatttatttccataggttattggggaacaggtggtgtggctacatgagtacgttctttagtgttgatttgtgagatttgggtgcacccatcacctgagcagtatacattgcattcaatgtgtagtcttttatccctcacccccttcccaccctttccctctaagtccccaaagtccattgtgtttttcttatgcctttgcatcctcatagcttagctcccacttatgagaacgtaacaatgtttggttttccatttctgagttacttcacttagaataacagtctccaatctcatccaagttgctatgaatgccattaattcattcctttttatggctgagtagtattccatcgtatgtctatatcacagtttctttatcctctcgttgattaatgggcatttgggctggttccacatttttgcgattgcgaattgtgctgctataaacatgggtgtgcaaggatcttttttgtataatgacttattttcctctgggtagacacccagtagcgggattgctggatcaaatggtagttctacgtttagttctttaaggaatctccacactgttttccatagtggttgtgctagtttatattcctgccagctgtgtagaagtgttccctgttcaccgcagccacgccaatatctattattttatgattttttgattatggccattcttccttctgtaacttcttcaggtggtcaggctaaaatcagttttctgtgccctgggacgatagcaaaacagcagaaataacggcctcacccttgattcatttctgcccccagttctaatggtcagccctcctctctctctaaccccacattaaaaggtaacttccaggaaatggaaaatcagaactctcacacagatataaaacaaacatgttaatgattttctttcacccataatgagtgaaccaggcagcagctaccatcagttcaaaagatggtctgcaaaacacacccacaaatagatcaggaatcttggaatggatacgtaacgaaaagcagaaagtggaattgcacagtgactgactttttggtctctgacttttttttttttttttttttgagacagagtctcactctgtcacccaggctggagtgcagtggcgcgatcttggctcactgcaacctccgcctcttgggttcaagcgattctcctgcctcagcctccctagtagctgggattacaggtccccaccatccacgcctggctaatttttgtatttttagtagagatggggtttcaccatgttgaccaggctggtctcgaactcctgacctcaggtgatttgcctgcctcagcctcccaaagttcttggattgcaagcatgagctactgcgcccggccggtgtctgactttttgttcaacatattgcgagaccactcacgtcggtacgcgtggctatagtggcctgtccacctggcatgtaacatcccgctgtaggacatctgccatttacatctcctttgcctgctgtggagatttacatgggcggtttccagtttgaggatttttttttttttttgagttggagtcttgctctgtcacccaggctggagtgcagtggggtgatctcggctcactgcaacctctgcctaccaggttcaagcaattcttctgcctcagtttcccgagtagccgggattacaggtgtgagccatgggccaccacgcccagctaatttttgtatttttagtagagatggggtttcactgtattggccaggctggtctcgaactcctgaccccggttgatccacctgcctcggcctccaaagtgctaggattacaggcatgagccaccacgctcggcctttttcttcattttagacaaaacaacaggggggtcccttgaagggcatttcctcaaaccctgcgggcttgtgtgaaacacgcctctgtgttctgtgtgcttctccctcagggtgtcagagggagggacccccaggctgggaccccaagaggtggcagcaggtgtcccatctgccaggtgagcgtgtccgggctggactttgaggagctggccggcatagctaatgtatgttctccctccagcctggtcctgggagaagatcattggtatacatttagtttttgagtagataatatattcatgtggctcaaaaaaaatctaactttataaaaatacactcagtgggccggcacagtggtgcacagctgtggtctcagctactcaggaggctgaggcaagaggatctcttgagcccaggaggccaaggctgcagtgagctgtgattgcgccactgcactccagcctgggctacagagcaagatcctatctcttaaaaaataaaataaaaaacaggctgggcacagtggctcatgcctgtaatccctgcaccttgggatgccaaggcgggtggaccatctgaggtcaggagtttaagaccaacctggtcaacatggtgaaaacccatatctattaaaaacacaaaaaattagccggacatggtggcgggcgcctgtagtcccagctactcaggaggctgaggcaggagaatctactgaaccagggaggcggaggttgcattgagccgagatcgcaccactgcactccagcctgggcaacggagcaagactccatctcaaaataaaataaaataggtattcagtgaaaagtctttcttccaccccatcctcaggccctgccctcacccccaccactggccaatgccattagtccatgttttatctttgtagacttgctttatgcagatttaaataaagccctggggatgaggatcatcctcctgggttgtgaggctttagtgagataacaccctcattcacggtagagctaccctataaggtgctaggttctgtttcccattttacagaaaaataaactgaggctcagaggcactgaagagcatgcctgaggaaaccaggcgacaaaggccaagctgggaggagagcctcgcttccaggtatcccctgggttccacagactcccgtgcacgtgtgtccaagtgaggggcagtggctgtcactatcatgtgcgctgccggcggctgccgggcagatttctcttctgggtttgaaataaccagaggcgatcttaagaacctactgacgacccgccgctctggaagaaatcattttccattctgcatctagcatcagcatttcacatccagatgcaggaagtcttcgtggaattttacatacattgcttggtttgcttccaagaactcatgattttgccttctggtttactctccttactgcttcaggcttgcagcgataggaacccatttctcccttgggttgctgtggcagcgtgacggtaatgcagattcaggagattgcagtatgaggttcaagtgtgggctgcgttcagatggggtcccttgacctgcctcatcctgtttccttaccatagtgcttcccatgtactgtagcatttttttctttttaaaatgatttatattatattattttattttttaaatgtttatttatttttgagacagagtttcactcttgttgcccaagctggagtgcgatggcgcgatctcagctcactgcagcctccggctcccaggttcaagggattctcctgcctcagcccccaagtagctgggattacaggtgcgtgccaccacgcccggctaatttttttgtatttttagtagaaacagggattcaccatgttagccaggctggtcttgaactcctgacctcaggtgatccacatgcctcagccacccgaagtgctgggattgcaggcgtgagccaccgtgcctggcctattttatttatttttattttatttttagagacaggatcttgctgtgttgcccaggctggagtgcagtgatgtgaaattggctcactgcagccctgacctcctgggctcagtcgatcctcccacctcagcctcctgagtagatgggattacaggcatgcaccaccgtgtctagcccttctcttttaaattggactgaaattcgtgtaacattaaattaaccactttagggccgggtgtggtggctcacgcctataatcccagcactttgggaggctgaggcgggcagatcacttgaggtcaggagtttgagaccagcctggccaatgtggtgaaaccccatctctactaaaaatacaaaaaaattagcttggcatggtggcacatgcctgtagtcccaggtactcagggggctgaggcaggagaatcgcttgaaccggagaggaggagattacagtgagccaagatcgcaccagtgcactccagcctgggcgacaaagtgagactccatctcaaaaaataaaaaataaatgaaaagaataaattaatcactttaaagcacacaattcagggctgtcgagtccactcacagtgctgtgtacccaccgctgctagttagttccagaacgttttcatcaccccagtgggaaactcccattaagcagccactcccctgccctccctccctccattcctggcatccacccatctgctttctgtctctgtggatttgcctattcgggacgcttcatgtaaatgggatcataccgtgtgtgcttttttgtgcctggtttctttcactgaatagagcggtttcaagttcctctatgttgggtcataggccagaacttcatcctgttacggctgagtaatatttcaccatatggctggaccgcacgtggcttatccatccatccactggtggacatctgggcagttgccaccctttggctgttgtgagcagtgctgctctgagcatgcgtgtacgtgtatttgctcagtccccgtctccagctttcctgggcttctccttggctgggtcgtaggtttggctttctggggagctgccacgctgttttccacggcacgctttagcactgaaacatcaggaggcctccacttgtgcagtgatgggggtgtccacgtggctaacgtgtagggccacgggggtttccaggatggttcccgcagtgggcctgggccagcccagctccagcccgatacacacgctcccctccctccctccctccctccctctgggccaggctgccccactccatgtttctgctcaatcttctcagggcccaggaggtttcaccacgttggcagggctggtctcgaactcctgaccttgcatgaagcccaagtcctccccacgttcaaggttccatggtctggcctggctctcccatagccacgctgaccttggaggccctcccctgcctgcagggctttgccactctctgagtgccccctccccacccccgcagcggtccatccccgagctgtccacacagaggcaggcgggcagtccatttcactgccactcagggccagcaccagccaggacccacacccggagcttgtcattgaagagctcggcccccacaggcctcctgctcccccttctctgcagccagagggatcctggaagccccatcaggcaggctcgactcaggacatccagccgctctgtcacacttggggtgaaggtccctggaggcccacctcctgcacccacctcccctaggtctctctcctttccctgttcatgcctctgctccaccgcactagaaccggcatccctgaggccagagctgtgcaagcttccagtggctgccgcagcaggtccccaccccgtcagcggcacaaatagcacagagaccttagcttcccgacctgtccgaaaggtgtttcctgggctgaggtcaaggcgttggcggccggctgtacctccggaggctccagggaggctttgtttcctgccctttgctgcccacattcctgggctcgggcccatcctgcctccagccgcagagcctgtccccatcattctctctgcctccacccatggtcatggctgcttccttgactcagcccttcctgcctcattcttgtaaggaccccctgcaattatactcaacctctgcacccacgggttctgtatccaaggatgcaaccagctgcaaatcaaaaatacttcataacataatacataaaaaatacaataataaaagcaatgcaaaaatcttaataccacaataaaaccatgcaaattaaaaataaaaaaaaagtacactgccagccacggtgactcacacctgtaatcccagcactttgggaggtcaaggaaggcagatcacttgaggccaggggttcgagaccagtctggccaacatggtgaaaccctgtctctactaaaaagacaaaaattagctgagcgtggtggtgcatgcctgtaattccagctactcaggaggctgaggcaggagaattgcttgaatccaggtggtggaggttgcagtgagcagagatcatgccactgcactccagcctgggcgagggagtgagactcggtctcaaacaaaacaaaacaacaacaaacagtataaaaattccttacatagcatttacattgtatttggtattataagtaatctagaggtgatttgaacaatacgggagaatgtgtgtaggttccttgcaaacactatgccattttctatcagggatttgagcttccaaagattttggtatccctggggggtcctggaaccaatccctccaggatactgagagacaactgtactttgggcccaactggataatccacgataacccactcatctcaggatccttaacttaatcccctctgcagaatcgcttttgccacagacagtcacatgcacagggtccagggagcgggatgtggacctcactgggaggcctctgttctgcccgacgcaggggctttgcctgtgtggctgctgggtcctcactgccggaaagtgttcttggcacatagtaggtactcaatgcatatttgttgactgactggaaggaggggtgtcctgtggcaccccctactcaccccaccctgggaccctcacacctgttgatgaacaggggccttggccccatcccccgccccattcctgcacagagtggtgctgagtaaataccaggtaaacaccccaaggactggggtagaccgggactgagtgggcagggaggtgtgggaagcagcttccagcccatgtgaggcagccctcaggccccgcctcacgctccctcctcgatggggtgttggtctggatgagtgaatctcaaacctgactttgcatcagaatcacctccagaaattgttagaaaagccagtgctttctcctcgggcaccctcaccagcctcgtcatgccctaggcctcctaactccatgggacctgaatctacccatctcctcgggccgccagcaaagtgccacaacctggcggcttaagacaacaggtcactgtctcagttctggaggccaccagtccaaagtcaaggtgtctgcagagctgcactttcccgaaggctccaggggagggtcttttttgcatcttctggtggttcctggtgtcccttggcttgcggccgcatcacactagtctgtgactccgtcctcacacaccctccccttgtatctcctgagtcattggattcagggcccaccttgatccagttgaccacatcttaactacttacatctccaaagacccgacttccaaataaggtcacattccgagctccaggaggaatactggggtggggaggggatagtcttcaaccccctacacctgggatcctacatctgctctaaccttgaaattcaaaattcctgttcttttttgcagctgaaaacatttctctaagaaccctgattggttttgcatgagaacctcccctgctaagattcaacttaggagggcagccttttctttcttcctcatatggcagtgaccccagtgcctgccctcaaccccagcccaccttggtgctttcggcagcactggcttcctgctggctgccagtgtcagggtctttcatggaggcctggctcagaatttggagctggaggttcaaggttaagtccacaccttgctgccagttagcaagtcactctccctctctgagccttagttgccacccctgtcaatgtggacagtatctgacccttaggtcttatttttctccctccatggtgctggacactggatgggcacttggtgtacaaccgaggtagagtacacagtgggtgcatggctgaggtaggtcgcatagtgggtgctcggctgatgtcgagtgcataatgggtgctcggctgaggtagggcgtatagtgggtgctcgactgatgtagagtgtataatgggtgctcggctgagggagggcgcgtactgggtgctcggctgaggcagggcgcctagtgggtgctcggctgaggcagggcgcgtagtgggtgcacggctgaggtagggcgcgtagtgggtgtgcagcagaggtgggtgactgtcttatgaaaggcatcaggaggctccctcattccccgccttactggagaatgcactgacttcctttaatcttctttgccgcagagctgcagagagacaaggcggcggcggctgctgtgctgggtgcagtgaggaagaggccctcggtggtgcccatggctggccaggatcctgcgctgagcacgagtcacccgttctacgacgtggccagacatggcattctgcaggtggcaggtagggccccagctgggcagtctgcaggaccatgggcagagcagccttcctctcggcaactttgaggcaaagtgggctcgtcaggggctgcctcactgcagctgggcaagattgaaatctaattagagccaggtgcagtggctcatacctttaatcctagcactttgtgaggccaaagtgggcagattgcttcagcccacgaattcgagaccagcctgggcaatgtagtgagaccccatctctacaaaaaaaatacaaaaatcagccgagcatggtgttgcatgcctgtattcccagctacttgcggggctgaggtgggaagattgcttcagcccgggaggcagaggttgcacagtgagccaagatcacaccactgcactccagcctgggtgacagagtgacagagtggtgagaccctgtctcaaaaaaacaaaaaaaaaaaaaagaaagaagtaaaactaattggaaaaggagggcctgctagtgtgtttggagaaataaattacacacttgtcaaagcattgcccaggtgctccgagaagccaacgggcagtgtcctgctaggctttaaagagcagaggctgaaatttaatgaattgttttattaatcaagggcactgttatgtctcatccaaagcaacaaacatctgcaaaaacgtagacaacaaacaactccgtgcccagcagttggtcagaggaaaacatcttgcgttgctttgttttgttttgttttgttttgttttgttttgttttgtttgagacagggtttcgctctgtcgcccaggctggagtgcagtagtacgatcccagctcacagcaacctctgcctcccgggttcaagagattctcctcctcagcctcccaagtagctgggattacaggcgctcacccccacactcagctaatttttgtatttttagtagagacggggtttcgccattttggtcaggctggtcttgaactcctgacctcaagtgatccacctgtctcggtctcccagaatgctgggattataggcgtgagccaccgtgcccggccttgcattgctttaatttaggtctgagcatgcatttctcccatgggcagtgagtccaaccctcacgttgatgtcccctgcactgagctccataatcattagctgtcatctctgaggggcctggaatcttgtcaaggtaataataaaaagaggccagttctcaaacagttaaagaccccagaaacatgataaacactttagtgcacactgtgtacaggagggacagcaagagggcaggacttgacaggcactcagtcatttgaagccccaaatgtcctttttttttttttttttttttccccccaaatgtccttttaagaaaacttctaggatttaggtagagggaacactggaccgagtgtgaggaatgcagatcccctggccaggtgccaacagaaggaaggcaggaaatatatatttttaatttatatagtgtttaaaatttttattatatgttattattattattattattattttattattgttattttgagatggagtttcattttgtcacccagactggagtgcaatggcacggtcttggcttactctaaactccacctcccgtgttcaagtgattctcctgtctcagcctcccaagtagctgggattacaggcgcctgccaccacacccagctaatttttgtgtttttagtagagacagggttttgccatgttggtcaggctggtctcgaactcctgacctcaggtgatcaacctgccttggcctcccaaagtgctgggattataggcatgagccaccatccctggactttaattttattttttgagacagggtgtcactctgttgcggagtgcagtggtgccatcttggctcactgcagcctcaccctcccaagtgcaagtcctcctgagaagctgggattataggcatataccaccatgcctggctaatttttatatctttagtagagacagggttttgtcacgttggccaggctggtctcgaactcctgacctcaagtgatccgcctacctctgcctcccaaagtgctggagtttataggtgtgagccaccatgctggccggttattattattttaaatgaataaatatttttgaattttctgttttagttttctaatatggtaaatatatatggatacaatccgcttaaaaagataaagctcttcgaagtccttaataataaccttaggaatactgatgggttctgagacctgaaagtttgagaactagtacacttgcctatgatctgtctaggtaaataaatgtttcctgtgcacgtggaaagaatgtatgttatgcgttgttgggcagaatgctctatgtatttcagttaggttaagttgattaatgattaagttgtgttcacatctcctacatccttatgcatattctgtctgctctcagttactaatggaagagtgttcacagctcccaaaattggactttgtaaatttcttcctttagttcagtccgtttttgcttcctgtgttttgatgctttttggtttttttgtttgtttgttttttgtttttttggaatgaagtcttgctctgttgcccaggctggagtacagtggtgcgatctcagctcactgcaacctccagctccctggtttcaagtgattctcctgtctcagcctcccaagtagctgggattacaggcacccgccaccaagccccgataatttttgtatctttagcagagacagggttttgccatgttggccaggctggtctcaaactcctgacctcaggtgatccgcccgcctcagcctcccaaagtgctgggattacaggtgtgagccactgcgcccggccgatgctttgttactaggagcatatatacttaggattgttatgacttcttgatgtattgacctttttttgagacaaggtctcactttgttgcccaggctgtgcagtggcgctgtctcggctcactacagcctctacctccctcggctcaggcagtcctcccacctcagcttcttatgtagctgggactacaggcacaggccaccacgcctggctaattttcttggtttttttgtagagacagggttttgtcatgttacccaggctggtcttgaactcctgggctgaagcaatcggcctgtcttggcctcccaaagtgctgggattataggtgtattttttaccattattaagtgaccttctttatgtctggtgatactgcttgtcttaaagtccgatttttctgatactaatatagccaagacagctctaccagctttctcatcactggtgttggtaaggtgtgcctcttccatcctttttcctttcagtctgtctcagtctgcacagaaagtgcatctgttacaaacagcttatcactaaacgttttttaaaaactttaattgcaagatggacatatagcagaaatcacattgtcaaagcctgggagggtcagcagaggaatttgcatttggtcatggtggctctggggcacattaaacataggacggatgtaatcagatgtataatttagaagtctctggggttggagaatgatgacggcagctactggagtcagggaggccagtaagagcaagaatagaggtttgagttaatgtcgtggcagtgggatgcagaggagggcatggatttgagagatgtttttaaaaacgtccagctggtggcctagctgaaaccaaaaactgggggtgagggttgtcacatgggatgaggtttccaggggtgtaaaggaagagtttaaattaagagaagaggtggccaggccacctacaggccatggttcatgcctgtaatcccagtactttagaagcccaaggaaggcgggtcacctgaggtcagaagttcgagaccagcctgcccaacatggtgaaaccccgtctctactaaaaatacaaaaattagccaggtgtggtggcacatatctgtaatcccagctacttgggaggctgaaacaggagaatcgcttgaacccgggagaccgaggttgcagtgagccaagatcacaccattgcactccagcctggacaacaagagcaaaactctgtctcaaaaaaaaaaaaaaaaaaaaaaagagaagggggagccctgggaaagaacctggccgtttttttttttttttttggagacggagtcttgcactctctcccaggctggagtgcagtggcatgatcttggctcactgcaatgtccgcctcccgggttcaagggattctcttgcctcagcctcccgagtagctgggactacaggcacgtgccgccatgcccaactaattttttgtattttagtagagacagggtttcaccgtgttgcccaggctggtctcaaactcctgagctcaggcaatccaccctcattggcctcccaaagtgccaggattacaggcgtgagccaccgcacctggaacttggccttcttcttcaatgtgcctccctccacttgctctcccggtgggtaccccggggactgggaaccttccagattattcatccttctcccagcaaaaagaaaactaattggaacaagaggacctgccagggtttagcctgggagggatgttgttgtgggatttcagtgcagtctactgtggtccttccgtgtcattagggggctgtgcgctgtgctggggtgtgtgctcctcccggggagtatatgaagttgtcagagtcgacacttgagccagggcctcgatgctgcagacttccttgggagatgatggcacaggaagcagtcttcagcttttagatagttctcttgtgttggagcagagttttcacttatttaaaacccagcttcgccgggcgcagtggctcgtgcctgtaatcccagcactttggggggatgagtcaggtggatcacctgagatcaggagttcgagaccagcctgaccaatatggtgaaaccccgtatgtactaaaaatacacaaattagccgggcgtgatggtgggcacctgtaatccccgctacttgggaggctgaggcgggagaatggcttgaacccaggaggcggaggttgcagtgagccgagattgcatcattgcactccagcctgggtaataagagcaaaactccatctcaaaaaacaaacaaacaaaaatacccccagcttcttgagaaacttaaccatatcaagagaccatatgagggcctcagccatcctgaaaagatgccggccttaaccagcagtcatcaggaacaacaaggatggaggtgcctggagaagagcttagtggaagccactctccacttgggtgaaatagagtttacagtcaaagcaccaaagcaagaaaaatctaaacattccaatgcaggtgcattggatacagagaaaattattacagcaaaacttccaattgccagcagctttttcttctttttcttctttctttctttcttttttttttagatggagtcttgctctgttgcccaggctggagtgcagtggtgcgatctcagctcactgcaacctccacctcccaggttcaagcgattctctgcctcagcctcccgagtagctgagattacaggcacccaccaccacgcctggctaatttttgtatttttagtagagatggggtttcatcatgttggtcaggctggtcttgaactcctgacctcatgatccacctgcctcggcctcccaaagtgctgggattacaggcgtgagccactgcacccggcctccagttgctttttcagttgggacaaccagcagagaacatccccagatggcccctcactgaggactgttcttggcagaacagaggcctctccccttcctcctcctgggcctcaccttggcatcagcttcgttctctcgtaccctaagtgcagttcatgcacctgagttttctgtgggcccagggggacagttcaggaccaggaaccccctgccctcctgctcctccagggcgtggcatggacccctccaggacttcttcggccaagggctctcctgcgtccttcaggtgtgactagatgtcactccccaccaacgcatttctgaatttttctgtcccagctgctgcttcccccatgaccaacatctggaaccacagccagaaaccagactcctgtcaaaaggaattttgaatgatctctccctacttgagtgaccatatgcttggccaaatggaagctttgtagaattttgacactaacgacagtggtggtggtggtggtggttttttttgtttttttggttttttttttttgagatgaagtcttactctgttgctcaggctggagtgcagtggcgcaatctcggctcactgcaacttctgcctcccaggttcaagtgattctcctgcctcagcctcctgagtagctgggattataggtgcctgccaccatgcccagctaatttttgtatttttagtaaagatgaggtttcatcatgttggccaggttagtctcgaaatcctgacctcgggatcctcccaccttagcctcccaaagtcctgagattataggcatgagccaccgcacctggccagaatagtgttttgtaaataaagttgacttcagtatcttaagaagtggtcattgtggggctgagcatgtgtttcagagtctgaagctctggtctggggctgaggctgggagctcagagtggagatccatcaggtggtgtgaagcagggtgggggatggaaggttccaggtctgaggaccagaagaggtagaggtagacgctcagagacgtggagggtggtgagtggcaggggagagggagagaagtccacgccggacctggccctgcaggacaacacacatccaccgccctgggttcggatcttttggcacacaacccattccgttgccggctgggctttcctgcagcacgcaggcctaaaggggtcttcagctctccttccacttttgcaaaaatggttggcaacttcaaacaaaaaccatagcaaacttgcgactccctcccgatagattgctactgcctttatgatgcgttttaatcgccgtccgctgggagagaatgatgactcgccccacgcaccctgtgggtaatggctgtgggaatcgtttctttattcataaaccaggcttctcctattgcagagacagtgagtgatgtggtgttgtaaacagcgaggggagaaacaggggtcatgaattcatctgatgccttgcagaatttgcattttattgatagttttcatttccttccatattatatcatattgaagcctggttttgatgtgctggcctgtgttcccagagaacagcgaagggtatttactcatattgactgatggcatcaacacagatgcggcattgatggcttaataagtgggaaggttgaaggttccggggattcctctcagctgctggggagaccgagggagcgagggaggccggcctcagtgcggggcatgcgcagggcagaggaaggcgcggaggcttggctgggagtcagcctcggccagctgctcgcgtcaacccaccctgacgctcacttggcctctgggcctcagttttctcacctgtaaatgagaagatgggacacagcacttctggaagcacccagcatcctacctggtccgtggtaacagctcacagtgcacttactgtgttctggggccgtgccaagacttcatgcaggttattgatttaacccttcctgtaaccctccaagtcagtttcattattatttccgtattgcagatgaccaaagaggcgccagcccagctcagccagggattgggcagaggaagagattctaccctggcaggctgggtacagccctttgctttttttctctctctctcttttaaactttttattggccaggcacggtggctcacacctgtaatcccagcactttgggaggccgaggcaggcagatcatgaagtcaggagttcgagaccagcctggccaacatggcgaaacctcatctctactaaaaatacaaaaaattagccaggcatggtggtgcgcacctgtagtcccagctaccgtggaggctgaggcagaagaattgcttgaacccaggagatggaggttgctgtgagccgagattgggccactgcactccagcctgggtgacaaagcaagactccgtctcagaaaaataataataataataatatactttattatggaaattttcaaatgctacagatgtagaaataatagaataaggaacccaacttctctgtcatggcacttgctctaagcttcataagcttatgagatctgaataatgctgtgtgttcacttggaaggacatttagaaatctattgatatgagccaggtgctttagctcgagcctgtaatcccagctacttgggaggctgagaagggaggatcgtttgagcccaggaggtcaaggctgcagtaagttatgatcatgccactgcactccagcctgggtgacacagccaaactctgtctcaaaaaaaaaaaaaacaaaaaacgaaatctgttggtatgaaaacaaaataccaaattagttgcccttctggtttgggagggagtaaaaagccttcaacaacagctcactctcagagttcagtatcatgcaagaccatgggctctgcaaacagtaggtgtttaataagtgtttattgaatgaatgagtcagcactgtatgcaagcaggatgcttgtgaggaacagggacgtgacccagtgtgggctctgggctggggtgtctttgcatgtgccgtactctgccctgggaccctcttaccctcattgcagatggcagggtggagggggcccatggcgtggttgggtacctcgggccctgtggctggctgaactgagtccaagtttctcaggtgggaattcatcattacctgcttatcttggcttcaccccacacccccctctaccctctgggccagctgaccagagccacaggtcccctccccacactaccccagacagcacaaagccccctcaccagcaataggcactggtgcgctggcaggccacgagccctcccctccccaccacctgcaaaccagacgagggcgggaggcagaggggagccccctggtttgggatgagcctgtaggtgtgagaaggagggtgctgggacctgcggaaaagctgccaaagacctgcggtggcccattgtggcccacaggcttctctttcttggacaccaggtctgagccatgttctcccaccaggcctcccaggacacctcccgggacccacccagtctggggggctgctcctcccacaagcctcccagcccctcccccaccccaggtggcaccgcagccccacttgcccacacatgcacaggcagctcctcctcctgtgtcctctcccctgtaagtggccttgccactgtccctgggatccctactcctttccatgtctgcagcctccactggccttgctgtaggctgtccctccccctcctcacctggcttcccagggtcaatagaaaaagtcagacctcagtccttgccctggcgaccttgaccctccctcccatttgggtcccagtagcccagggaagcacatctgtgatctctgaacaccccctgaggttcctcagtgaccaggggtcccagagcagacgctgttctgctcccgggaatggcctggagctgggcagcaaagccactgcccgccgtccctgcttctgctgcctctgctcttgctggagaccggcctctgctgcatctctgtgcctggtgggtggaggcccccacagtttgctcctcgggggcagctgatggtgggctggggtgcagggtgggccgatgctgtatcattcggaatgcggctggccctcgtccccagttccctcgaggtagctctaagtctttggaatttcccaagtgaaaggagtatttttgttattcatggcgggggtggggggctctaagacctccaggaagggaggggctggaggctgagttcactctgtggcctgtgatcccatcaatcccactgaagaaatgaagcttcaatgggggccctggatttccagaggttccgttggcccctcgctcccccagttggtgatgctatgatgatgggcccaaaggggaggcctcttaactccacgggagaagtcacagacgctctgagtccaggacgctcccagaccttaccctgcgcgtctcttcctatggctggtcctgaattgcattgttcgtaataaagctgtgattgttaagtctagtgccttcctgagctctccaagtcattctagcaaattatcaaatgtgaagggattgtaggaacccctagatttgtaggcagcttgtcagatgcgtgggtggccttctcatgggggtgccctcaacctgtgaagggtggtctaagcccagatacaagccgttgcagacatagatgatgggtgtggctgccagggctcccacggttcttgtggggctgggcatagacctcccatttcccccggatccctttcccctggaccctggggcctggcaggggccgtgtctcatcttctctccccggagctgagtatacagtgggcccccaacaaatgctggttgagctgatcttccattggtccaattatctggcacatcccccaagacttgcacttggtctgattccagacatgataatgctacttggcttttttttttttttttttaatcctgatgttatctttctctttcaaccctaaaggcattgatttgactccttgtttcttcagtagccttataaatcacccatcactttaggagcaaagttgttctttcctctgttattccacaggaggagggctcaggctccgggtcagccatggaaccctggcctccgcggtggtagacactttgtctggaaaacactctactttcaggcatagccattgaagattttgtgcctgaaaactcccacttggcaagggaagcaaataaaagtgtggcttgcagtgcagccctttaaaacagaagcttgctaaacaaatggaaagcgtgaccagaattcgtaaggaactgtgaaatgaagaggatgctgtatttggaagctgtgaaattgctctaggattccaaacctcggagtagcttccaggctcctgggaagaatcagatgcgtggcgtaaataaaagacagccccctggccaggcagccagggcggggacatcaaagagttcacacactgtgcgcgcgtgtgtgtgcgctcatgccagtgtgcatgtgagtacgtgtgtgcacgcaagtgtgtaatttttttttcaagagacagggtctcactctgttgcccaggctgcagtgtagtggcgtgatcctagctcactgcagcctcgaattcctgagctcaagtgagccttccacctcagcctcccaaagtgctgggattacaggcgtgagccaccgcacctggccaataagatttttttttttttttttgagacaaagtctcactcttgcccaggctagagtgcattggtgtgatctcagctcactgcaacctccacctcccgagttcaagagattctcctgcctcagcttcctgagtagctgggactacaggcgtgcaccaccacacccagctaattttttatttttagtagagatggggtttcaccatgttagccaggctggtctcgaactcctcacctagggtgatccacccacctcggcctcccaaagtgctggaattacatgagtgagccactgcacctggccaaaaaaatttttttagagacaaggaaggtctcattatgttgcccaggctggtcttgaactcctgggctcaagtgatcctcccatcttggcccccaaaatgctgctgggattacaggcgtgagccactgtgcctccagtcattagatttgaagcctacgctaaatccaggataatcttatcttgatccttagctaattagatctgcagtgaccctgtttccagtgtcacattctgagggtccagggggacttgcgtttttttttttttttgggtagggctggggtactcttcccccactacacagggttagaggtggactgagcggccccacagccccttccctgaggtccacacctaatctgcaccctcaagatcagcgctgcccagtggaacgttctctgtgctggacacgctccatccctgccttgtccagggcagcccccaccgtgcgtgactgctggacacctgaaatgtggcgagtgccactgaggagctggacttttttttttgagagggagtcttgctccttcaccaggctggagtgcagtggtgcaatctctgctcactgcaacctccgcttcccgggttcaagcaatttcctgcctcagcctcccgagtagctgggattacaggcatgtgcaacgaggagctggacttttaaaaatgtgaatgctttcgtcctggaaggtgcaggtgtgggtcttcccactcctgtgtgaggaaaggaagagggagcagaaagtgctgggaggaggggctgcaccctgctccaggcttcccatccccagcccccacctggggggcccccaaggtctcctgggagatgagcaccctcacagaagccagggcctgggcccctttgtacagccccccgcccctgtgctgggcctggaaccttggccaaggaaccttttactgcattgagcagagccctttgaagggatgagcccaggggccttcaaagccaccaaggctgcgtgtggcctctccctgtacattacccctcctgggcctgtaccactggggttggagcccctgcctctgtgctcacagccagaggagctgctcccatatgcaacggcatgtccacagaccggccagagggcattgcggatgcggggggcaacagcttttctgcagaggtggggtttagtgggaaggggtgtagagtcagcaaggaggcgggagagcattccaggtggaagctcaggcaggaggatgcccttgaagaactgaaggaaggctgctgggccaggtcctcgggggcagaggtaggggcctcgtggaccagcagtggagggatctccgtgttccccactcctgacgacagcctggtgtgggtttggctccctccccactgctgcctgtacccctttgtgccctgttttcacccttggcacatgtgcctcaggctgttcttacctgtgtccttgtgtgtttaattgtaatgaagaagctgtgggttctgggaagcggggcggcccatctgttctccgtgtccctgagccgtggccgtggagtgagaaagtgctgagaatccagggggtggggggtgggtggtgacatcagactgcacttgagtcactgtcagggccttccccagggtgtcctgcatgcagggggtcctctgtctcagggccctgggcagagagaggaggaaagtctgaaccatgaggtctccaacctcttctggccacttgtggggtggggcaaggtggggttggggctgggagaggagaggcagctgtgtctgcaggcacggaggatggtctgcaggcatggaggatggtctgcagggccctctccttcaggagtctgttctgtctttttttttttttttttttttgagacaaattcttgctctgttgtccatgctggagtgcaatgatgcaatcttggctcgctgcaacctctgccttccgggttcaagccattctcctgcctcagcctcccaggtagctaggactgtagacatgtgccaccacgcctggctaatttttttgtatttttagtagagatggggtttcaccatgctggccaggctggtctcgaactcctgacctcaagtgatctgcccgcctcggcctcccaaagtactgggattacagacatgagccactgcacccggcctgatctgtctttttatctcactaagcgcctggcccggagcctggattctgaggacagagataagcagacccagtcccagctctcaaggggtacccctccccgcagctgtccatatgtggggggcacccctccccgcagctgtccatgtgtggggggcgcccctccccgcagctgtccatgtgtggggggcgcccctccccgcagctgtccatgtgtggggggcgcccctccccgcagctgtccatgtgtggggggcgcccctccccgcagctgtccatgtgtggggggcgcccctccccgcagctgtccgtgtgagggggtgcctctccccgcagctgtccgtgtgtgggggccgcctctccccgcagctgtccgtgtgtgggggccgcctctccccgcagctgtccgtgtgtgggggccgcctctccccgcagctgtccgtgtgtggggggcgcctctccccgcagctgtccgtgtgtgggggccgcctctccccgcagctgtccgtgtgtgggggccgcctctccccgcagctgtccgtgtgtgggggccgcctctccccgcagctgtccgtgtgtgggggccgcctctccccgcagctgtccgtgtgtgggggccgcctctccccgcagctgtgtgggggcacctctccccgcagctgtccatgtgtgaggggcacctctccccgcagctgtccatgtgtgggggcacctctccccgcagctgtccatgtgtgggggcacctctccccgcagctgtccatgtgtggggggcgcccctccccgcagctgtccatgtgtgggggcgcctctccccgcagctgtccatgtgtgggggcgcctctccccgcagctgtctatgtgtgaggggcgcctctccccgcagctgtctttgtgtgggggcacctctccccgcagctgtctatgtgtgaggggcacctctccccgcagctgtctatgtgtgggggcacctctccccgcagctgtccatgtgtggggggcgcccctccccacagctgtccatgtgtgggggcacctctccccgcagctgtccgtgtgtgggggcacctctccccgcagctgtctatgtgtgggggcacctctccccgcagctgtctatgtgtgaggggcacagatgtgtcaagagactgttgtagcacatggtgacccgggccataatggacggcagggctgagcatctgcattcctgagagggctcctgtacccccgacatgaggtcatgcccaggagccattgtcccccaggccaccctggcctccaccatggcccagaatcatggggtggggggttggaggaggaggtagagtggctacaccctgcctttgaagtcagatgcgtctcgatttaagtccttggtgccgcctgccagctggctctgcactgatgacttaaccctgctgggcctcggttttctatctgtaaagtggggggattatttccagcgtacggctggtcatgaagatgaacttggaccacgtgcataaagccacaggtgatggatgctcactcagcaggtgtcgcctccgaggaacgctgctgcctgtgcctcccagctcgggctggactggccaaggaggctgctttttgctaagtgcctgaggattttctaggagaaggtggcacagaggctcacctgtgtctgctcctccaggggatgaccgctttggaagacgtgttgtcacgttcagctgctgccggatgccaccctcccacgagctggaccaccagcggctgctggagtaagtgttctgccccctctctttctgtccctgtctctccatgttgcttgtccccatcccttcaccccacctcactctgagtcatctgctgtggtctggggcctcctttgtgaccttgctggtgtgcagagctcttgcactcatgagcctacccgagggccaactgtggacacccctggtccctgggcttctgtgcaccattcattagcacagtgggagccaggttttgtttccttttagccacccgagctgtgggtgcctccctttggagttggggacagtcccctggtcctaggtgtaggcgaaccttgcagatgacacggctgccgagcgccaggcctcccccacgcactgtccctttgaaacctccctgggcctctctctgggaacaccttcagagctgtgtgagtttcctgtagtggccataacaaatgaccacatgcttggcaacttaaaatgctctgagtggatcctccatggttctggagggcaccagtccccaaggtcaaggcagcggcagggctacactccccctggaggctgcgggggagcttctggcctcttccagctccagggggccccagatgacttgtggccacctcattcctatctctgcctcggtcttcacatggcctttttgcctctgtgtcttcccatctcataaggacaccagccacgggactagagccactctaactccatggcacctcatctgaactcattgcaccagcaaagaccctatttccgaataaggtcacactctgaggttttgggtggaattttgaggggtggcattcaaacccaggacagaagacaagggcctgctgctgctgctgctgctgctgccgccaccactggctcagcaggcatctattgagcgcctactgtatgtgagactttggatagatagtcactgtatcagggcccacctgtgaactgaggaaatcacccctgtggtttggggtgggagaactaaggccaggaaatgactctgagacagaaggtggcaggacgtggaaggggccgagtgagggggtgcctgggccccatgtcccttgtacactcccagtgccacccaggtgcgcatgggctccacagctggtacagggtggggggccgtagaaaatcaaggttgttgttagtttgccataccaacaagcatcaggagcattcagaaggggaggtctcaggcagtttcccaaactaacttgggcaaggaaccttttactgcattgaacagaaccctttgaagggacgggcccaggggccctcatagccaccaaagctgtgtgtggcctctccctgtacattacccctcctgggtctacaccttctgttcccccagcctttgcatgcagcacccccaaacacatcgtcccttgcatatgtccccttgtgtgcttacctgcgttctgtgccagtcccctactgtggctgtcctctctccaccccccaccactatgcagacaccacctcccatgcacacaccccctcccatgcacacaccccctcccgtgcacacaccccctcccaggaacacacccccccatgcatgcacctcctctcatgcacccaccctctcccatgcacacaccccctcccatgcacacaccccctcccaggaacacaccccctcctgtgcacacatacctgctctcatacacacacacctcttgtgcacacgcttctccatcactaagttgactaagtcacatgctcagcacagactgggtgttcagagtgaaagactaacctaaagtagattgactcatgggtccttagatggctgtcacatgacccccaggccaccagacccacctgcaggactgagccttctccagcccaaagcagctttgggtccacagtcttgagcgtgggcccgggcctcacgccctcttaggtctgcctgcttccttccctccctccatcaccctcctcaaagccacatgggcctcgcaccctgcaccctctgcattggccgtttcccattgctcagaaggaaccacctgttcctcacctgtgtatggccttgggcgccctgtcatcctctttcatctgtcccttgctgctggtgtctgctgtgctggccacactgctttcataaggcggccaccgagcctccttcctggtgaaactccccggcccaggagagctgctgctgggggagagttggcaaaatagcgagagcagcacctctgctggaatccctgtctgtgtgagtgagaggcccccaggcccaggggagaagctcagtcttagtgaagggaagttaggttctgagggccttggaatttgctccccgacaatgaactgattgagcttcatttctgaggccaagccctggccgatctctgggtgtccctggaaacatttatgtgcccttgtgaggacagggagcacggcacctggcctgctgcagactccctcactgctggggacagctcaggacgtgaccctggcggggaggctgtgcctgccaccacttccagatgccagcatctaactgctaaagccaagggactcagggagtgggctcgacctggaacccccaactcaagatgaacaaaggcatgatcggacatagaagcacccagaagactttgggctggttgcttcatgagagtccccccaatatatgcattctatctggtctgttaaagaatcttctgaccacagctgaaactgcagtggcaaaggcagagacctggcggggagcaggtgccgggagcgacttccaccagtgcaccagtgctgctgctgcacggcgagacctgcaggattcatggggcgagcttggatcctggtgctgattaccccagacagtgaggctggctttccccaggaggtgctcaccccagtgaggagccgatgccagcctgcagcccactcttggtgtttaccaggcacacagggagagatggatgctagatccaggaagagctcgtctcctggggtcctcttgagaggacgcattcccttgtcaggtcatttaggcacggaaagacctgtgacctgtgggtcagctctccccgaggaggctgctgctgggccaggaatgagctcacgatttgctgttcttataaagacaaaagtgcctgcaaagacagaaagcgaattggtggttgccgggtaccgggagtgtgatggggagaatgactgttgaacaggtctcagttttcttttggggtgataacagtgtttcagagctgtagagagggggtaattgcacagctttgtgaatgtactagatgcctgaattgttcacttgaaagtggttaatttatgttatgtgaatttcaactaaattggacaaaaagcacccctgacaacaaattggtaccttgtgctcttttatgtgcttatccaagattcctttactattaggtggaagtagtaagcatggcttccatgaacagttgtataggttgttcacagcacaaggctaaccagatgagaagctaccatcacctggtgcttttttcactcagcgtgggacaagcatctgcccagaggaaaaggcatctttttctaactcatgcaaaggtgctctgtgggcttctcggccttgataagaagagccatcaggcttacttctccgcagcctttatgaaaaaaattaacaccccgtacattatcctccctatccattccaaccggatggctttcttgtggccagatgcatgctcctatttttgaagcgggtgaagaaacaagtctatgtctttgaaacccaactagtaatttagttaatgacttcctgtgctgagcacgcgggcagatgcattgacactcagaggatttcagtgtgctgaacagaaggcactggggagagcccagcgctggggccaaaggaagggtgcctgcttttacaaggaggcgcccagagtgggaagaggagctgtgcaaagacattggcctcagtttccctctcttgaaaaagtcatttgcgaaatacaaaagtggctatcctgagaagtgaggaggagtgaagagttctcagtggttcgtggactcttccacccctctgtgttcaggtggaagtctcgacctgggtttttctgagaaagtgactcaataaaggatgaccttggtgaagtatgccccggtggcttagcccacatggtgttcgagacagcactctggaaaatgagttttgaagttacttccacaacgggtgagctgaaatcatgcatggtgtgaggtcagatgtgcgtgatttctctacatcaaagcagacaacgggatgggagcaggcgtggatggcagcccacagttctcagagacgctgagtgtgtggaagctggagccaggccacttggttcaaagcccagctctgccccttactgattcacctctgtgagtctcagttgacttgtctataaaatggagataatagtacctggctcctagggtcattgggagaattaaacgtgtagaaggcctgcagttcaggtggtatgggcttttgtcagagggcactctgacatcacttagaaatcaaacgcacaggccgggcacggtggctcatgcctgtaatcccagcactttgggaggccgaggcgggtggatcacgaggtcagaagatcaagaccatcctggctaactcagtgaaaccccgcctctactaaaaataatagtaattaaaaaaaattagccgggcgtggtggcaggcgcctgtagtcccagctactcaggaggctgaggcacgagaacggcgtgaatccaggaggcggagcttgcagtgagccgagatcacaccactgcactccagcctgggtgacagactctgtctcaaaaaaaaaaaaaaaagaaatcaaacgcacacaggagaagctggcatccttggtctccaggcttccgggcagtgcgggaccagccgagcctctgcaggtgggcacaggctgctgcggctttctcccgaggcagttctgggagcttctgtctgcagagcaccccacccacagcctcagagagtggggccacgtgggtgggttaattacaagatgtgctccaggtgagaacctggacaacctgagctgagggatcatggcctgaccggctcagtgtcaggccctgcagagtgctggtggagggttagggggtccttctggagcccttccttctgcagatggcagggcaagccctttcccacaggtgacatgaagacagtgcttgctaggtgcagcagggcaggatggaacgtggtccatgggaaatgggtagagcctacaccatagggggtggcgggcgacagacgcagagcacagtgtcaggactctggctttgtaatgaaaagcaaaatgttaggagctcacctggagggaaggaattgcttgccttagaaatgcagcaggcagccgggtgtctgaggtagaagggcctgtggtgttgggggtcaacggcaagggctgagcagtcaagcattcctgggttcaaatcccagctcatcctccttgtgagtttcccggggctgccgtaaccatgatcgcaaatgtggtggcgtaaaaccagaaatgtattctctcacagttctggatgccagaagttcaaaattgaggtgtggccagggccgtgctccctgggaagggagaagcccttccttgcctgtccagcccataaaggctgtcagcagtcctgggccttccagggctggtggccacatcatgctgtcgtcgacactctgctttgcctccgtctttacgtgaccttccgccctctgacttctcatcttcgtgtctgccttagaaggatgcatgtgattgcactgaaggtccacctgggtagtccaggatgagcccctcctctcaaggtcctaaatttaattgcacctacaaagacctttttcccagataaggtcacattctcaggctccacggatttgatatggatgtctttccacgggcaacaatctggcctaccacatccacttactagctgtgtgactttagataagtcacttaacgtctctgagcctcagatgtcatctgggaaatgaggaccggggcccacggtgcatggagtctccatgtggcccggtgctggcacctactgggtgaccatagcttccattatagggaaagcacgtttggtttcaataatgagtaggtgattttcataactgaatcttctgtgttgtgcccaggtatttgaagtacacactggaccaatacgttgagaacgattataccatcgtctatttccactacgggctgaacagccggaacaagccttccctgggctggctccagagcgcatacaaggagttcgataggaagtacgtgcccgcaagccttcagggacgtgggtgtgggctgcttgtggcaggaggaggcattgtggccacaaggggtcgcagagtgtgcagtgggggaggggtctggtagggcggagggtggagggtgagcaaatgtggggcagtggaggttcacctcccctctgggccaagctctggaatcccgggcaggggttggcactcatttttttttttctttctttcttttttttaagagacggtctcacccagccaccatggctcacacctgtaatcccagtactttgggaggccaaggtgggtggatcacctgaggtcaggagttcgagaccaggctggccaacatggcgaaaccctgtctctagtaaaaatacaaaaaaaaaaaaaccaaaaacaaaaacagagacagtctcgccctgttgcccaggctggagtgcagtggtgcaatcatggttcactgcagcctcggcctcctgggctcaagcagtcctcttgcctcagcctcctgagtagctgggactacaggcgttcaccaccatgcctagctaatttttgtatttttttttgtagagacggggatctcactatgtggcccaggctggtctcgaactccaagctcaagcgatcctcccacctcagcctcccaaagtactgggattacaggcaggagccaccatgccaagccaacactcttgttcttaaagggccagacagtcagcattttagctttgcaggcctgttgctctattgcaacaactctgctggactgtgttccagtaaaacattatggacgctgaaatgtgaatttcatgtcattttcacgtgtcatgaaatattcttctgtttttttttttcaaccacttaaaaacataaaaagccatttttagcttgcagcctgtaccaaagcaggaagcaggctaggttcatcctgcctgcccattctcccacccctggtccagtgaattactggcaaagaaacaactgcatgaccgtttcttcactaaagcctcttcttgctttcacagccctttacagtctgcaaggggcattctgatgcctcttgttggtgagatggcagcctcattttacagatgaggacataggccccagggagcaagtgacttacccgtggtcactcagcttgtgtgtggtagggcaggatcccaccccaggcccccgcctccctctcccacccaacgctactcaccgcttggccatggcctggagccggcagacttttcctgagggacgtccggcctaataatcaacttggcaatatatctggctcgtagactgcggcgatgggcgttgatgtggatatcctagattcctctgggttttccttcttcaaagtcctttcaaacctgtaacagaaatctgcttcacagatatctgagtcagtgggacagtggaaggcagtgcctgaatgtcccagaagtcctccctccagttgccttttgggtcctgctgtcattatcaataggaccttcggagggacttcttggttccccatcctatgtcttagggaaagaattgttgctgtattttgcagtcatttactgggcacctgtataagctggagatggcctagccccagcgcatgtcctcctccaggaaggcttcctgggttgtcctgggagaatcaatagccccttccctgcagcctcactgtgcctaagcagacaccaatcctagctagcacttaggggtttgtgaacaggtctgcctcctgcactaggctgtgatcccggacctgtctctgcatcccttgcaggtgggaaaggatctgcatatggcagcctttttttttttttttttttttttgagacagagtctcattctattgcctgggctggagcacagtggcgagatctcggctcaccacaacctccacctcccaggttcaagtgattctcctgcctcagcctcctgagtacctgggactacaggcgtgagccaccatgcccggctaatttttgtatttttagtagagacggggtttcactatgttggccaggctggtcttgaactcctgacctcgtgatccgcctgccttggcctcccaaagtgccgggattacaggcgtgagccactgtgcccagccggcaggcttttattaagcgttagatgggaggatagaggagtgaagtggtactggcaggaagtaccaaggttccagctggcgtaatcaggaaggctgcatggaggaagcagcctttgagctgcctgtggagtggtgggcagggtgttgtgaagtggcaatcactggattttgcttctggtacgaggtgtggccagatgcaagaaagagcagggtggactttggtgcaattggtgggggtctggtctgtagggttcccgtggggagccgtggagggaggcagcaaaggagggaggggcacagaggatgctggactgtgtttaagaggcagcagggagccatggcaggtgcttgaggagaagcgagtgatgtgtttaaagcagccctttcaggaggctcaggctcacagcaggatgtgcacagtagccctgtcttgagctaaagcagatgaaggttttgccctctgcacttccccacgtgagaaacgaagatgcacccgcagattccttgaggcagctcccccacttctcagttgccagaaatcagcccagagaaacaaacccgtaatcagcccagggtgctttcccttccctttctcgagggggctgctggttcgcacataaggagtgggtcactcccgcttgggagaaagcagcagaattccttcacagccaggtaagatgtgccagtggtcgatggatgaaatctagccggggagttggaatctgtgttgccagcagtgacctgtgagcagtgacaaagccaaaggtaacggcaccagcccggggaaggaggccggcctcgtggcaacctggggaggctgtcagagctctcacattgaagggcgttgataagtggagccacgcaggtggagagacttgaagcagtgacttccaatcggcggtcatttaaccttggccagaggggactaggcagggaagagaggaaggtggcagccgtggccttcaaggcatcagatggaaagaggcagacttgttctgtgtgactctcccactccccgggaggttggataggggtaggggttagggttagcgttacagatcttggctcagtagaagcaaaaaggagggacactctaggcatcaaactacccaaaagtgtaatgtctgcaggggtgctgagttccccatcgctagaggtatgcgagtggtgctccaaatagaattagatgagatcgcctgtaatcccagcactttgggagtctgaggcgggtgagtcatttgaggtcaggatttcgagaccagtctggccaacatggtgaaaccccatctctactaaaaatacaaaaaattagccaggcgtggtggtgcacgcctgtaatctctgctactcgggaggctgagatataagaatcccttgaacctgggaggcagaggttgcagtgagctgagatcgcgccaccgcactccatcctgggcaacagagtgaaactctgtttcaaaaaaaaaaaaaaaagatttatgcagtgagggttttcagtcggccattgccacaccccatcaggtttcctgcattcttttctgttctctctgcctttggcttctcatcctccagaccgtcctgccaggtcattccttttaggggtgaacaaattcgcacgcaagtgttcatgaccccacttctgggagtgcttgcctcaccaaagagctcctgccatgggtggcaactaatggaagccactggaagctcagtctcagggtgaaccttgcagcagctgccctctgggctcctggagactctggaagccactgctactgccccccgccccgcccctcctctcagagcctttttttttttttgctttctgtttttttttttgagacggagtcttgctctgtcaccaggctggagtgcagtggcgcgatcttggctcacggcaacctctgcctcctgggttcaagtgattctcctgcctcagcctcctgagtggctgggactacaggtgtgcactaccacgcccggctaatttttgtatttttagtggagacgggttttcaccatgttggccaggatggtctccatctcttgacctcgtgatccgcccgcctcagcctcccaaagagttgggattacaggtgtgagccaccgcgccctgcctcagagcctttttaaaattagttaattaacatttcttggagagatgctttgagattatataaatatcctgctccttgtcaaaatacttttcactttcattgctgctgcttggcttagttgttcatatgatggcagccaatggtggtctgatgagcactcggcatctgacgaagggaagagctttttcttctcctcacttatttatctcagtgtggacatgtgtaaaatgtcctattttattcattgagttacaatccattactatcattttaatgatcaaattgtcccaaatttgcccatgtgggtgccgttttaaggactcccaggtccttctgacactccccctcactctttgagtgcttcctttactttctggcacaggatatgccaggcttatcttgtatttttcttgctccagctcaggaatctgccattctccaaggagcacagtcgccctggctccctgtagtggagaatgctatttagagaccaagatctggacaagcggagtgcttgttgcttttggggtgttatggctcccaggccctttcagtggacagagttagggtatgtgtgtgtgaatgtacatatacatacacttacacacacacacacacccctacatacacacatacacacctggatacagtacatacacctgcatacacatacatacagacacctacatatacatacacttacacacacctacatacacacatacccacctacagtacatacacccacatacagacacctacatgtacatacacttacacctacatacacacatacccacctacagtacatacacccacatacagacacctacatgtacatacacttacacctacatacacatacatatacacacctacgtatactatacacttatatacacatacacctacatacaactacacacacaccacttacagctacatacacctacacacacttacgcttacttatatctacacacacctacacacacacccacacacctaaatacacctacacacccctaggtatacctacacatatgtaggtacacctacacacactttcatacacttacacctacacacacctacatacacacctatatacacttacacctacatacacctacacacacatacaattacagttacatacacttacatagagctacacacacctacacacttagacttacatacgtctacacacatacacaattggcttccaaaaattcctgaaattttgacagcccgtgtgagtggataagaggtggctctggcgtcctgcaggctgaccccacgcaggccatgtggatgccccttctcgcctcctgggctgtgtctccccagcaggacacaccgtcccccactcaccctctagagccctggcatgtcctctgcccccatccccaccctggttggctgcctacctttcttccccaacctgatggctttgggctgaaatattcaagaaggaagcatggagactgggaaggagggagagagagaagttcactgggtgttccaatgtgtgggtggctgtattgcattgaaccggcctctggccggctgatgtttaggttattgccgggtttatctgccatcataaccaacacggtgagctccttctagcccaggtcagctcctggcagggcaggtgttggccaagaggctctgtgcggttttaattctgagagctgttgccaaattgcccccaggatgtgctccagccacccccgaccctggtgtgagtgagcgcctataaacagggctccgacttgcagctgtgcctcggcgaactaaagcgctgcaggcatgcctggcgggggcagcaggtgaggggtcctgattttccccgagtttatttcattctttgtttgatgtccttaaattgatcctgttgagaggagtaacattctgagactcacagtggaggcagctgtttcagggttattgggcgtggggtgtttctcggagcgcggcagcctgaagtcatcccccgtttccctcctcaggtacaagaagaacttgaaggccctctacgtggtgcaccccaccagcttcatcaaggtcctgtggaacatcttgaagcccctcatcaggtatgcgtcactctgggagaggacctcgctggggttggaggtttcacccctcagggtccatgggacggccttccctatccacgcatcatggagggcccgtctccagggtgcctgtgtatctggggctccctacccgccctggggtctgcggggggtcacaaggccagcccaggtcatggacaggagtgcagtgccggcctttggcacctgtggggtttgcacctggtgtttaaaagcccccctttgcctgagcccccacactgtgtgaccaccctcaggtgccgtgattttccagagggactcacagatgtcaggaaagctgttatcttcactgttgtggtctgttacagagacagggcacagatttaagtcagcaaaggtaaaaggcacacaaggctgagtccaggaggaccaagtgcaagttcccagctgccctctccgggcggattcatacaggcagtgctccattctcccagcaggaatgtgtgggggaggagggagcatggctggccgcggaagctcaccgagccttggtgcccagggtttttgttgcgggtcagtcatgtaggcacggagcatccacccggctgacctcagccactcggtctccagcccctcctgagatgagacaaataaaacccacccaaggcccccgccctcaatcacattgttggcacaaactctgtggtgttggcccaaggttcccggtgggcaaagacattaccaggccgactctcccaggagctgagaggtttccacccaggagcaggtcacccatggccagccttctctttggaacgtgtggggcttggacacccccagcctgctgagttaagccttgattgcatagcaacccaaataagcggcctaaagaaaggcagccacagcccggaaatgtggcgacttcagtcagcttcttccatatttagacttgttcctgctaaaggatttctgcctcagtattgggaagcaagagctcaaggggctcgtgaggcctgggaggctctgcctgggtcgcatgggcatcttgtattttcttccgttttggctgtatgcatcaggcacaaactgtgtgcacagagccacatgacgggggtggggtggggaagagactgacagatgtcgttcttgcacggtggctctggccctccctgggtgagttctgcaggcgagggaggggctcagagcaggagggcgcaggtgtgcaccagacgggtcaggatagccaggtgaggtggctgcctctgtgagagggcgggaggactcctggagggcctccctaggatgaagcctctggggacagggaggcgcatccctggaggggtcgtcattcttccccagaggtttgcatctcacaggcctttgccatctcccccctcggctccttccacttgttgaagcccactcgtggctctgaggctgctgctgacacaggtctcttctcgtgccccacagacaccgtgtgagtgggtgtgacgctccgtgtacagggagcactcagacagagctggaatgccagctgggacctcggaatccacactgtctccttcccatttccccatccatccctgggaagcatctcggccccccaggagcatggacagctcaggctctcaggcacctgcctgtcttcccaccagccgtctcccgccccaagggctacactgccccgtcccacccttgtccctgtgtccctttgtctcttaatgtgactggtactcagaggaatgttggcaagcactggtccttgggcacatcgagagctactctgcagccagacacagtggctcatgctactaatcatagcactttgggaggccaaggcaggaggatcacttgagcccaggagtgtgacctgggcaagaaagtgagccccacctctataaaaaatataaaaattagccggatgtgtagcatgcgcctgtggtcccagctacacgggaggccaaagcaggaggattgcttgagtccaggacttcaaggctgcagtggcttgtgtttgtgccattgcatttcagcctgggcaacaagcaagaccctgtctcaaaaaaaaaaaaaaaaaaaaagaactgccctgccaggcggcttggagcctttcttttctttcttttttctttctttctttcttttttttttttttttttgagacgaagtctcgcttttgtcccccaggctggagtgcaatggcgccatctcggctcactgctacctctgcctcctgggttcaagcgattctcctgcctcagcctcccaagtagctgggattacaggcacctgccaccacgcctggctaatttttgtgtttttagtagagacggggtttcaccatgttggccaggctggtctcaagctcctgacctcaggttgatccacccgcctcggcctcccaaagtcctgggattacaggcgtgagccaccatgcccggccttcttttcttatcagctcccaaagctgtcattccagggactgaatcgtgtggtcctgaggcacactgggagaattcccagagcagcagacttgagtcagctcctgcttaatagaaggagagatttttggggccaaagagctcctttcatgtcactagaatttcctgccagtttttctcacctactggcctatgccgcacacattcccctattggaaggtgaggttttgtttgtgtttaaccaggcccagcacccttgtgccctatgtgacatgtgacatatttgacatagcaaaaaagctagtcctgtcatttaccttagaaaagtccttagaggggctgggcgcaatagctcacgtctgtaatctcagcactttgggaggctgaggctagcggatcacctgaggtaaggagttcaagaccagcctgctcaacatggcaaaaccccgtctctactaaaaacacaaaaaattagcgggtgtggtggtgggcgcgtataatcccagctactcaggaagctgaggcaggagaattgaggcttgaacccacgaggcagaggttgcagtgagtcaagattgcaccattgcactccagtctgggtgacaagagcgaaactccatctcaaaaaacagagaaaagtccttagagggcgaggcatggtggctcacacctgtaatcccaacactttgggaggccaaggcaggtggatcacttgagcccaggagtttaagaccagcctgggtaacatggcggaacctcgcctctacaaaacagataaaaatcagccaggcatggtggcgcgtaccttagtcccagctattcaggaggctgaggtgggaggattgcttgagttcgagaggcagagactgaagtgagctgagatagcaccactgcactccagcctgggcgacagagtcagactttgttgtacttaagagttctagaaacctctaaggttcttggaaaaaaagttcacctgcttggccaggcacagtggctcacgcctgtaatcccagcactttgggaggccgagatgggaggatcacttgaggtcaggagttcgtgacaagcctgaccaacatggtgaaaccccgtctctactaaaaatacaaaaatcagctgggcgtggtggcgcatgactgtaatctcagctacttgggaggctgacgcaggagaatcacttgaatccaggaggcagaggttgcggtgagccgagatcacaccattgcactccagcctgggcaacaagagtgagactccagtctcaaaaaaaaaaaaaattcacctgctcctcctgttttccacgtggcagcgtgatggtgatggcaccagactgcctgggctcgactgctctgccccttgccatccattacccattaccctcaacaaaagagccaacccctctctgcctcagtttccccatgtggctgacaaggctatttaagtcattccattgtcataataattcactgacttaatacatatagtgtttattttatttttcttccttccttccttttctctttttttttcataggttcttgttccatcagcccggctggagtgcagtggtgcaatcatggctcactgcatccttaacctcctgggctcaagtggtcctcccacctcagcctctcacatagccgggattacaggtgcgcaccactgtgcccagctagtttaaaacaattttttgttgagacagggtctcgctatgttgcccaggctggactggaactcctggcctcaagtgatcctcctttctcagcctctcaaagtgttgggattataggagcgcaccatgttgactgtttagaatagggcctgccaggcaaatactcaatgttagctgctagtactgtgttttttgtttgttgttgttttgttttgtttcattgctttgagacaaggtctcagtctgttgcccaggctggagtgcagtggtgccatcacggctcactgtagcctcgaactcctggactcaggtgatcctcccacctcagccttccaagtagttgggactacaggcacgccaccatgcccagctaaattttgaacttttagtagagacagggttttgccatgttacccaggctcctctccaattcctaacctcaagtaatcctccagcctcggcctctcaaagtgctgggattataggcatgagccactgcacctggccctgatttaaaatgtttttaagttggctgggcgtggtggctcacccctgtaatcccagcactttgggaggccaatgtgggcagattacctgaggtcaggagttcgagaccagcctggccaatatggcgaaaccctatctctattaaaaatacaaaaaattagcggggagtggtggcaggcgcctgtaatcccagctactcaggagggtgagctacgagaatcgcttgaacccgggagacggaggttgcagtgagccaagatcgcgccattgcactccagcctgggcaataagagcgaaactccacctcagaaaaaagaaaaaaaaatcttttaaaactacccttttgtattaatttgattccaatatcttacgcaccttatgtgccagcaccgcaaaacagtactgtgaagtcagccacattttccccattccaaagaagaggaggttggtgctcagagaggttacgcccaagtcgcaccatgagagggggcgtgggctgggatccaacctgagcctgtgtggttctacccctcattctgcctcatgcctggacataagcagctgccaggagaggaccataggaattgggctggggctctggagcccagattgggctccgcagcccattgcctgtgagatcttgggcagccacataacctctctgtttcccaagtcctcatttgtaaatgaaggaagtagaggaactctgaggccctgggtctcgccagacctcctgactcagatccccgcaggtggtgcctgtggctgcaggtctaacaaaaccccagcaactctgccgcacgccgtgttgggagcccctggctgagctggcctgtgggccctttcccgagaggagaggcaagtggcagggccctggctgcacctgtcccagagtccgtgtttggcagagcctggcctgcaggacaggtcagggaggttgcagagaggaaggtgaggggctgggcatgggaggcctccctgcagctctgaagcgggcacctctgtccctgagaatggttcctgcagaggggcaagactccctttgcccttagtgggttcctcccgcccatcacacaggacgttgacagtacttcacagccccggggacaccctccggcatccttccagcagagaccagactgtccccgagtcctgtggcgtctaaatgggcaggcggtgaggacactcctgcaggggtcccaccagccccttccctccgggggctggggtgcaggcactaaggcaggccccgctttcctccctccccttgtgcttggggtgaggggcacactgcactttggtggctattctgcagccccagccttcagcccgggttccctggcctacctggcagtgtccttgaatacagaaacctggcaatccccgccctcctccctcagcccccgggtccgattctttctcgtccactagggggagccagtgcacacagctcggcctccctcggggctcctttaggaaccacctggcgctggtgctggcgctggactgagctgtgggctgagctttgggctgagcactgggcggccgctgtccctttggattctcctacctgtcatgatctccgtattttttgtttttgccacggtaacttgaattattttgatttcacaaaataaacgacattgaaaatacatgaatacttatttcaagactttcaaattgtcataaaataacataaaatatcttcggtttggctgaatacataactttccttttccagtaacaacataattctttacccacattaatagttgtatatcttggccaggcacggtggctcatgcctgtaatcccagcactttgggaggccaaggcgggcggatcacgaggtcaggagatcgagaccatcctggctaacatgttgaaaccccgtctctactaaaaatacaaaaattagccaggcgtggtggtgtgcaccttaatcccagctacttgggaggctgaggcaggagaatcacttgaacccaggaggcggagcttgcagtgagccgagatcacaccactgcactccagcctgggtgacagagcgagactccatctcgaaaaaaaaaaagttgtatatcttaaacatatacaataaagaaataatactgtcctccaaaataaaactcaaatgatatatttatggcaaaaaccaaacctagactatcataaagaaggcggggattacaggcttcttataaaggcgtgctcgcatccatctgtcaatgatccccactttgcaattcatgctgagccttgttactaatagcagtcgtcacagcgagcatgtccaccagacgtcaggcagtggactagacctgcaaatagccttgcattgtcttccgccctcacttaggagggagaacccccactttcagacccaggccctgagagggagtgaattgccctggggcacaagaggagggagaagacggagttgctgcacctggtcagggcatgtctggccttgtggctgcgctgctccctggggtccgagagactgtcctggagacaaacctggagagcctcattggttcctctccttagaagaggtggccaaatgtgaagccaccactgaccccaaaaccgcgagcaactgaggctgccctggggcaggcttcaacctcagagctgctctctctgtgccagtggcttagtgccccctgtctagcctgcatcccccaaaagcgcttcttggcacttccgcgctatctcctatatgcaaattcagggcagatgtaaattggaggcagatatttatttttatgcagatgagccactccagcgtgtttggtgcattggagatctcgtgaaagcaaaatatctcccggcgtgcgctgcttgtgttatgttcgggttttaagtcgtgtcagcgtttacattttcttaatatgaaaaatgcctgcattgttctgccgccaactccccctccctccctgcaaccctcggcctctctgctggcgcctaatcgttctttattctcttgcttctgctttcttagtcacaagtttgggaagaaagtcatctatttcaactacctgagtgagctccacgaacaccttaaatacgaccagctggtcatccctcccgaagttttgcggtaagtgcctgttagaccccagaagccgcatcaatacatcttcgtgcttccaaagggcttggttcagtcccatgaatgtttaaggcttgatttccaaatgtgtgcttggctagatttggctcagaaatctgcggcatcgacaaagatccgcagcaaaaggtgctaactgctgactcagagaaatgaaatggcaaaggttgtatacaggacgggatgttttcctcgcccaccattgcaaaactgatttaaaaaataagccctaacatggcaacggccgtttgttgccttggtgtttaccgtttttgcttttgagcagaaaattaggagaatttcccaggcgtgtggataacgctgtgtacagaatgaagtgttctcagggacgtcacgggtgctctagaaaacgacctgtctcctggatgctgaaagcttaattggtgtgtctgctacaaggcttaaatgtaggcccagatgaatagaggctgcccagaaaggcgtatgccacacagccagtacagggcgcggccagatccagcctgggtctctggacccccagcctgggttccctctgcccctgtgtctccctctctgaggcgctcctttgaaggagcaggcccttgccaaagtacgtgcagggaaggctggtagccttgcaggggtaatggagataataacttctctccggacgccaagtcacatggcaggtgctgggatatagaggtgtttagggagtgtggtctctgccctcatgacactctcagactagtgagggccacaaatcagtgatgacaggggccagaggaggcacagaacccagctggggaggggactggtgtgtgggggtaatccaggaagacttctaggaggaggtagctcttaaagtgagtttcacagggacagttggctagatgaagaggccagggaagcacatttccagcagagggaagccctcctgcaaacatatgggtgaaatattgggagatctggaggcagtgagaagtcccatgtgatcaggcagaagttggtgaacgtgaagctggaggtcaccttgggccgggagtccttggtgccaagcagaggagagtgaactggacctggaggccatgagaggatgatgggaatccctggtcgcccgtgggccctggcaagaccccactcccagacctcactaaagtgatccgggggagtccatggagacggctcagaagatgtatttgtagcagctctgtggtggaagtgatttggtctggtgacaaagggtaactcacatcctcctgtgtgggagagtgatttggggatgaaatggacggcatctgtgaaacacgcagctccggcttctcagtgggtactgggtgcagtctagggcctctggaatgtgcaggtggctggcaacactgagggtgcagggtcctgtgagtcagaggggatgaggtttgggagaggggcttgggcttgggcattgggagctcctgaacttactcagtaggcagccggcacccctgttccatagccatgcagcagaaccccagaggacacgtccaatgctgatgcttttaaatgagcagcttctagactgggggtggggctgagtctggattttctccacccccacatacttcctggtgggtgctgcgagcaccagaggctgagacccactggcacagcggcagggcagggccttggggtgctgaatcctggctgtcatcccagcttgtgacctggggcatgtcaccagaccttgacaagcctcagtttcccaatctgtaaagtagacaaaataacccctctacagtaggcccctcatgagggaccgagacatctctggggagccacttggggcgcagagcgctgtgattaactcacaaaaaacaaccgcacgtggtagcagctcacacgtgcttggctggccaggctcagtccagtgcaccaccttctccgcagacctttcctgcattgtcgggtgcctaaccctgcaccatcttgtgtcactgactgcctcactcccgagctgccaactaatggtcatgtgcccccccatcctgtggccgggtccctgctgtatgcacagtgcccggcacatagtagggcttcaatacgtatttgcctgtgttaaggaaggactgttacctgagcacagagggtcttttcttttctttcttcttcttttcttttttttttttttttgagatggagtcttgctctatcgcccaggctggagtgcaatggcgcaatctcggctctctgcaacctccacctcctgggttcaagtgattctcctacctcagcctcccgagtagctgggattacaggtgtgcacaaccatgcccagctaatttttgtattttcagtagagatggggtttcatcatgttggccgggctggtctcaaactcctaacctcaagtgatccacctgcctcggcctcccaaagtgttgggattacaggcgtgagccaccgtgccgagcacagaggttcttttcacccgaaggctttaaccacctccttcagagtttatccatccttttcagagtccatctgttcattcatgggtttcttgtttcattcaacaaatattttaattgagcatctagtaggcagcaagccctttccaggcactggggataaagtaattaacaaaagggacgaggttcctttagcattaccggccagctctcgtcttaaattcagacacttgcgagagctgagggtggtcacgcccaccttggggctgaccgcatggtaagcaggtgaggctgctctgctggccaggggcctcaggagagactggacatttgctggaggttggactactgcctcttatgcgaacagcccacagcaatgggggattgtgactgtgtgtatgtgagtgtgtgtgtgagctggcagtgtggcacgtgcgcccagagggatgagatgcccaggtgtcctgcaggtggggcatccagccccacccagcgcctccgtggctgccagctgcccctgccaggtgagatcccagcctctgttgtgtctacaggtacgatgagaagctccagagcctgcacgagggccggacgccgcctcccaccaagacaccaccgccgcggcccccgctgcccacacagcagtttggcgtcagtctgcaatagtaagtgagccggggatgtgcctgctcctatgccctggagccctgggagctgtggggcgcttctgggtccagaaatattttccccagacgtttgtctccagcagccaagctgaaccctgcaggaaagataaagcctgagctcatcactgaggccgtggctcgctgctcagtgcctggttgggggggcgcgtgctcgctgctcggtgcctggttggggggcgcatgctcgctgctcggtgcctggttggggggcgcgtgctcgctgctcggtgcctggttggggggcgcgtgcttgctgctccgtgcctcgttgggggggcgcgtgctgggtgcctggtcgggggggtgcgtgtcactgctctgtgcctgattggggggaccggcagtgggtagtggatgggggtctctggggttcccgccccagcttccatcactgctgccccctgccctccgggtacacagacacttcccaccaccttcaaggagggcgtggtcatgggatgtgcttaggtgtaggtgtggggtgtgtcgtgctaggaggaagcttccagagccagtgggcagctgcctctcatggtgatgtataggcctgggtccggtagagacggcacgtggtcactctgcatccctgatccccgcatcaccatgcaccttgctaacacccaggctggacacaggcatagagaagacaggcttgtgctgggctcagccgctgagatttaagggtcattgttaccgcagcgtaacctgtccttcctaataccctttatcagccacatgaccttgaactcacctcttctctcagcttgtttccttattcctgttatactacctttttttggggtggcgggaacagagtcttgctctgcttctcaggcaggagtgcagtggcaccatctcagctcactgcaacctccgcctcctgggttcaagctattctcctgccttagcctcctgagtagctgggattacaggcgcacaccaccacgcctggctaatttttttgtatttttagtagagacagggtttggccatgttgcctggctggtctcgaactcctgacctcaagcgatccacccctctcagcctcccaaagtgctgggattgcaggtgtgagccactgcacctggccacccagggtagattttgaaacattttgaaaggttttgagaactgaggaggctctgggcggcatctgggccaggggaggaggtgcatcggtcacctgcccttactgagccatgtgggcaggggcattcctggggttagagggaagtggattcggccctggggacctgcctgtttctttcttggccaagagtggaggagctcagggaggccagggagggaggcagaatcatggcccccgacgaagtccatgccctcattcccagaacctgtgattaggtcaccttacatggcaaaaggggcttggcagaaatgattaagtaaaggatcttgggatgggaggttatcttgggttctctggtgggcccaaagcaatcgccagcgtctttacaagagggaggtaggagggtcagagtcagagaggagatgtggcagcagaagcagaggccggaggggtgcggggccagaagccaaggcactcaggcacctctagaaactgaaaaaggcaaggaatggattcttccctggagcctccaggtggaacacagtcaggtcaacccctttttgactcctgacacctccaggatgtggtgagataatacatttgggtggtggttttttttttttttttttttttttttgagacagtctcgctctgtcccccaggctggagtgcggtggtgtgagctcagctcaccgcaacctccgctccccaggttcaagcaattctcctgcctcagcctcccaagtagctgggattataggcgcccaccgccatgcctggctaatgtttgtatttttagtagaaacggggtttcaccatgttggccaggctggtcttgaactcctgacctcaggtgatccacctgcctcggcctcccaaagtgctaggattacaggtgtgagccacctcgcctggcccatttgtgttgttttaagctaccaagttgacggtagttactgggaccacatgaaaataaagtaggtggtagtgagtggtgggtagttgcgagtatagggggagggaagtgtgtctaaatcttgttcccagagctagcaagtttgcttccagggtgcttgagcccaggagagggccgggcctggagtgcaaatgtgaagttggctgggcatctcgggtgtatcacagctaaagaggactgctggtgccccagcgtcggtccctagaccagcattatctgatggaactctctgtcaggatggacgaggtctgcacggtccagtatggtagccagtgctcgcgtgcggctagtgcagatgctgaattgctaattttatttcattttaactaaattagaatcatcacatgtgacttgactgtcgtactgcactgcacagctctgaccgattcaccctcgccttccctaactaggcgcacacacgaggagttgtacttaagacattttgtaagcactttgccaataaatgagcaagagactatatgttgaaatagaatgttcaccccaaatatatctggaacacacattttactaccaaatagtacttccttttcctttttcagacattgtgagaatttgcgggtgcgaacaactcttgcactcccaccaccccttaggggccgcccaggaatgctgggcggggcaggcacctgcagtgacctcggtcccctcctgggggcactggtgagaactcagcccttgaccaggctcagccagcagaccagaatttttttttttttttttttttttttgagacaattttttttttgaaatggagtctcactctgttgcccaggctggagtgcagtggcaggatctcggctccctgcaacctccgcctcccgggtttaagcaattctcctgcctcagcctcctgattagctgggactataggcgtgcgccaccacacctggctaattttttttgtatttttagtacaggcagggtttcaccatgttggccaggctggtcttgaactcctgatctcaagtgatccacctgcctcggcctcctactgggataacaggcgtcagccagcacacctagcccgggccaggatattccagccatcaggtgaccgttttccccacgttcctgaagccctgtgtctccagcccgttactggggctctgctgggctgatactgcttccatgtgctgtggcacacagggtcccaggggtgggtctttagctgggagattccagccacgcctttctcgtctcttatcttattgtttagagccacttctctcttcttatcatctaacaaaactttaaaaacgaaaaacaaagcccgggtgcggtggctcatgcctgtaatcccaacactttgggaggctgaggtgggtggatcacctgaggtcaggagttcaagaccagcctggccggtatggtgaaaccctatctctactaaaaatacaaaaaaaaaaaaaaaaaaaaaaaaaagttgggcatggtgtcacacacctgtaatcccagctactcgggagcctgaggcaggagaattgcttgaacctgggaggcggaggtttcagtgagccgagattttgccactgcactccagcccaggagacagagcgagactccctctcaaaaaagaaaaaaaaaaaagaaaaagaaaaaacaagcatagctcacagacttcgaaagccgtctacctgagtgaagtgtgggaaaattgttagccatggctgtaggcctctcggctcctagaaggctaccagagataccattagccctgcattctgagcaggtgcctttcagaacgtactgatgcagggctgttggctttaactgtcactttgccatagtccatccctctcccagggccagttgtaactgtaaaagtccggtccttagctgcttttgggacaatgggccacactgcgcgtgcagcttggagagagaatccctgcagttgcctctttaaattaatattttatgtggtttcattgccaatgattataataaaatggcaataaacattttaaaggaagcactagatatgtaatttgtttggactatgaatgaatgaaagtcattaaaattcataactgaatcctattcacaaatgttaatttgccaagttcaaaagcttacagcagaaagctatcaccttagaatgagctaatgaagttaatatattaaagggaagtcaaagattcaagaggtctttgcttgccatccctgaaaaggaaaaatggaaacctgaggcctgtgtgggcacctgggggaggcaggtacagggcagagcttgagatgtccttaggctgggtggggcaggtcatggctgagctctggcattttcttttttttcctctctctctttttttttttttccctgagatggcgtctcactctgtcgcccaggctggagtgcagtggcacgatctctgctcactgcaacctctgcctcctgggttcaagcaattctcctgtctcagcctcccgagtagctgggactgcaggtgcacgctaccaagtccagctaagttttgtatttttagtagagacggggttttgccgtgttggccaggctggtcgcaaagtcctgacctcaggtgatccacccgcctcagcttcccaaagtgctgtgattacaggcgtgagccactgcacccggctgttactgttttttatttttatttttttagacagaatctcgctccatcacctaggctggagtgcagtggcacaatcttggctcactgcaacctctgccttccagttcggatgattctcctgcctcagcctcctgagtagctgggattacaggtgcctgccaccatgcgagctaaattttttttttgcatttttattttttattttcttttatttattttagttttgttttctgagacaaagtcttgctctgtcacccaggctggagtgcaatgacacgatctcggctcactgcaacctccacctcctgggttcaagcgattctcctgtctcaccctcccgagtatgtgtgactacaggtatgtgccaccatgcccaactaatttttttgtatttttaatagagacgaggtttcaccatgttggccaggctggtctcgaactcttgacctcaggtgatccacccatctcggcctcccaaagtgctgggattacaggcgtgagccaccgcgcctggcctgtttttattttttatcgtagccatcctagtaggtgtcaagtgtagttcattatagttttgtttcacatttcactgatgcctaacgctgttgagcatcttttcatgtattatcggccatttgtttaccttctttggaaaaatgtatattcactagatcgtttgcccattttttgtttggaccgtcttttcattgttgtaaagatttgttgatatatgctagaccctaggcccttatcagatgtatggtttgcagatgttttcttccgtcctatgtgttgtctttacaccttttgatggtattttctgaagcataaaagttacattttgatgaagtccaatttatttatttttttcttttgtcgcttgtgcttttggtgttttatctaagaaatcattgccaaattcaaggccgtgacaattcatgcctatgttttcttccaagagttttaccacttaggggttagatttgggtctttgatacattttgagtagatttttctacatgttgtgaggtgaggtctgatttgcttctttgcgtgttgttacagcaccacttgttgaaaagacttttcctggccaggcagggtggctcacgcctataatcccagcactttgggaggctgaggcgggtggatcacctgaggtcaggagttcaagaccagccttaccaacatggtgaaacacccatctctactaataatacaaaaaaatgtgctgggcatggtggcaggcacctgtaatcccagctactccggggactgagacaggagaatcgcttgaacctgggaggcggaggttgcagtgagccaagatcatgccattacactccagcctgggtgacaagagcaaaagtcatctccaaaaaaagaaaagaaaatacttttctttcccccattcagttgtcttggtaccttgtcaaaaaccaataaacatgagggtttatttctgggcactctaattcttgcctattggtctatatgtttatccttatgccagtgccacacaatcttgattactgtagctttgtagtaagttttgaaattgggaagtgtgagtctgtgagtcctccaacttttttttcaatattgtttaggctattctgcatctctttaatttccatattcattttagtatcagctcgttaatttctgtaaaaggcagctgggatttcaatagggcttgtcctgggtgtgtagaccaattttgagggtattgccatcttgaaaatagtagtcttccaatccatgaacatgggatgtctttccatttatttgggtcttttaactttttttcagtggtattttatggttttcactgtaccagttttttgaacttttttgttaaattttttttttttaatttgtgatgctattgtcaatgtaatttttttttttttttttttttaaagacagagtcttgccctgttgcctaggctggagtgcagtggtgcaatcttggcgcactacaacctctgcctcctgggttcaagtgattctcctgcctcagcctcccaagtagctgggactacaggtgtgtgctaccacgcctggctaattttgtatttttggtagagatggtgtttcaccatgttggccaggctggtctcaaactcctgacctctggtgatctgcctgcatcagcctcccaaagtgctcagattataggcatgagccaccacacccggttgtcaatgtaatttttaatctatctttttgttactgattgctaggttctagaaatacattttttaaatatgttgatcttgtatcatgcaaccctactgaacttgtttattagttctaatatttttgtgtgtggattttttagaattttctatatccaggatcatgtcatctgcaaatagagatggctttacttcttccttttcaacctattgccttttattgcctgattatgcctgactgtaacctccaatacattgttgaataaaaatgataagagcagacatggttgtcttactcctgatcttaagaatcagcagttaagctgggctaagcagcatgtacctatattctcagctatttgggagattgaggtgggaggatcacttgaggccgggagttcaagactagcctggacaacatagcaagaccctgtgtctattaaaaacacacacacacacacacacacaaaagaatcaacagtccttcactactaagcataatgttagctgtgtgcatttcatagatgccctttatcaggttaagaaccatcttttttcttttcttttcttttcttttttttttttttttttgagatagagtctccctctgttgcgtaggttggagcacagtggtgcaattatagatcagtgcaacctcagattcctgggctccagtgatcctcctgtctcagcttcccaagtagctggtactataggtatatactaccatgcctggttaatttttaaatgtgtttagtagagacagggtctcactatgttgcccaggctgggaacatcatttctatttctagtttgttgagtggttggttggttggttggttggtttgttcatgtaaaggtgttaggttttgtgaaatgcttttcatcgccattgagataatcacatggcttttgtcctttatactgttgatatggtgtattatattgattgatttttacatgttgaataaaccttgtattcctgggataaatcatttgtgttcatggtgtataatctttttcatatattgctggatttgctttgcttgtattttgttgaggattttgtatttatatttataagaggtattagtttgtcattttcttgtcttatgatatccttgtctggttttggtgatactggcctcagaatgagttgggaagtgtttcctcctcttctattttttggaagaatttgtaccatattagagttaatttgttaaacattttacagaattcaccactgaagccatctgatcttaggctttactttgtgggaagttttaaaattactaatgtaacctctttgcttgttatatttattcagattttatatttcttcttgagtccattttgattgtttgtgtctttccaggaatttgttcatttcgtctaggttttctaattagttggcatgtaattgttcatagtacttcataatccttttatttgtataatgtcactagtaatgtttcctcttccattcctgattttagtaatttgaatcttcaccctttttttcttggtcagtctagctaaaagcttgtcaatttgttgatcttttcaaggagtcaacttttggttttgatgatgttctctgttattttcctattttctatttatttctactccagtctttattattttcttccttctgcctgtgtcagatttagttcattttctttttccagttttttaaggtggaatgtttatcattttagaatcttgctttttgcaatgtaagcatctatggctataaattactaagtcctgcaatagatgtatctgttagtgtattatttccatgattttaattaatcttaaagtattttctaatttatcttgtaatttttttctttgattcattgatttctaggagtctgttgttaaattttcacatatctgtttttgatttttaattttattttattataattagataacttactttgtatgatttaacttctttcagatgtatggaggcttgttatgtggtataacatatggtctagcctggagaatattcaacggacacatgagaagagtgtacattctattattgttgggtggagtgctctataaatgtcaattaagtctacttggtttttagtatttttcagtcttctgtttctctgtcaatttctgcctagttgttctatttattattgaaagtgggggattgaagtctccagtatcattttaaaattatttatttctcccttcaattatgtctgttttggctccacatgtttaggggctgtattgttaggtgcatacatttttatgattcttactttcttatgaatccttgcatgatgataaaaaaaatgtccttccttgccactagtaacaatttttgtgttaaagtctattttgtcggatattaatatagccattatagctctttttagttactgtttgcatggtgtatctttgttcatctctttactttcaacctatttgtgtctttgaatctaaattgtgtctcttgcagacagcatataattaggtcatgtttttccccattccaccttctttattagattatttaatccatttacatttagtgtgattactggagttacatctgccattttgctatttgttttctatatgtcttttttgttcctttatgtcttcattaataccttcttttgtgttaaatacatactttctagtgtactgtttcaattttttgtttcttttgctatatatatatatatatatttaaagtattttctcaattgttgccttagggattagaatttatatcttaatttataaccatctagttctaattaagaaggattgtggagccaggcgtggtggctgaagcctgtagtctcagcactttgggaggccgaggtgggcggatcacgagatcgagacactgagaccatcctggccaacatggtgaaaccccgtctctactaaaagtacaaaaaaaattagccgggcatggttgcaggcgcctataggcccagctactcaggaggctgaggcaggagaatcacttgaaccggggaggcggaggttgcagtgagccaagatcgcgccactgcactccagcatggcaacagagtgagaatcagtctcaagaaaaagaaggattggggacttgcaaactcttcagagaatacaacttttgggtgttgtcttccaccccgtgctaacactccttctttgccactggaagaaacttgatctgatggtgatcttattagcaagcaggaccatgtggcccttttagtttctccttatctcccagagccaaggtgttaactgagccagtgttcacttttgtcagaaaagaactggtaagtatctgtctttctagtctcttttttcctgtgtgcgtaggatatgctcttcttcggtctcctgtaccatgtggctgtctggagactatacaatccttctctttgcgatcggcctccagggtgggacactggcctcccataggctctggttctgagccgtgtgtgccaatctgacttgccagaacctctaccccattagagttttggggactgacctcactaaggataccaagcagtttctcattccccatctgcctgcaaagaggggcagccctgcagatgtgagactacaggattccagtgccttgttgccacctttcacctcacgacagctccacctcataccaaatcacaactctaaatgcaagactgtgatctgtaccttttttttttctttctttcttttgagacagggtctcactatgttgctcaggttggtttcaaactcctggggccaactaatgttcctgcctcagcctcctgagtagctgggattacaggtgtattgtcacactgcttgtcttttgaacccaggtataatgaggactttgaagtcagattttaacttgaaccctggctctagtcaaccctaggctgtgtgactccagacataataatttgcctgagcctcagttttgtcctctataaaaatgggggcacagtgatgcagtgagtgggctttagtattgcacgtggtgcacagtaggtcctcagtacacagtaggtcctcagtgcacagtggtcactgtgatcgttcacatgcactgcccatttctctgggcatccaggacctccctggctgactctgtgactgagaactttgcaggtcagtggtgcaagctgcagccattcatcccctttcaaatattgggaggggacgtgttgtatttagaagatgcaggaccatctcagagggttgggaaaagcctgggtgcccagctgaggcaggcctgctcagcactccccattatcactgtaatttcaggttgccattcctccctcccccttccctcctgtttctttctttcttgttttgttttgtttgtttgttttgaggcagaggctcactctgtcacccaggttggagtgcagtggcacgatctcgatctcgtctcagtgcaacatccacctccctgtttcaagcaattctcctgccccagcctcctgagtagctgggactacaggcgcgtgccaccgtacctggctaatttttgtatttttggtagaaacggggtttcaccatgttggctaggctggtctcgaattcccgacctcaggtgatccgcccaccttggcctcccaaagtgctgggattacaggcgtgagccactgcacccagcccctactgtttttaattagtcacaatttctccttatttgtgcattcctcgcatgcaaaaccagagaaaaaacatgctctgaattactctaagcacatctcccgaggggaggggtacaagcaagaattctatgctgagagtccccgatgccctccagtgggtggacgactgtcggaaagccaggtgggagtcactggccacagagaacgctgtgctgaccaacaaactgtgctctgtgctccagagtcctcctgcccagcatgcatcttggaactttagttcatggtgtgggtttaatgcagtttgtgcatccttgctgagacgtgaccctggcccgtgcacattgagatgcacgagatgaacgtggtgtgatacgattcaccggcgccctgggcatccccacccagccaggaaacacagcacatctgccaaccagagtcccctggggtcattgctatgcacagcactgactctgtcagtccattgaacaagcctctctctccgagccagcaagtagcggatgggcaggggaggagaaacccaaattgtgggtttctgctctatggagagtagtaattcgatgccggggccctgttcttccgctagctgtgagagcctcagagtagatgtgggtgctcctcaaatgcacgggcagtggaaaacccgcttggctgggagcacggcagctctgggccagtccctcctctttggggacctcagttttctcatctgcctgaggaggttgggctggatgatctcagagtctcttcctgctctgagagtcttttattttattatttatttattttgagatggagtcttgctctgtctcctaggctggagtgcagtggcacagtctcagctcgctgcagcctccacctcccgggttcaaatgattcttctgcctcagcatcccaagtagctgagattacaggagtgcgccaccatgcctggctaattttttttttttttgaagacggagtcttgctctgttgcccaggctggaatgtgatggcacgatcttggctcactgcaacctccgcctcccgggttcaagcaattctcctgcctcaacctcctaagtagctgggattacaggcacgtgccaccacacctggctaatttttgcatttttagtagagacagggtttcaccatgttggtcaggctggtctcgaactcctgacctcgtgatctgcccatgtctgcctcccaaagtgctgggactacaggcgtgagccaccgtacccggccttaatttttgcatttggtagtagaaacagggtttctccatattgcccaggctggtccggaattcctgacctcaagtgatccacccaccccggcctcccaaagtgctaggattataggcgtgagccaccatgccccatctgagagtctacttttaaaggacagcacagagacaaagcagtaggcaaaggggtctttcaggaactcgtcctcataactccacattgtcccgcctgttgagtaggactcagtgggtctccctccccgggaacagtagccagccagggctttggaatcaatggatgcaggctctccagctgcgtgaacccggataagtcactgtagctcactgggcccatttgttcatctgtgacatggaccacctgtgtgcagcctgggaggctgctcagcccctggcattgggacaattttcgtcagtgccattggcttgtagctcagcaaagcctgcacctcccttgttgtttaatatttgcagaccttggggagagagcgccagcatctctgctttccaaatggagaaactgaagctggagaggataaggaaactggccggtggtgatctagctcctacgggaagggagggacagggtttgaaagggtctgtctggcttcctaaggaaccagagaggaggaaaagagcctgtaactttggcacatcctgggagaaaaggacctgcctgccacattcctccctccccagggacactgtctctgtgggccccaggacgccttctccctcccagagaggaaaccaagatgggaaggaggcagggggccaggtccgtattcctgcaacagcaggacctcctgaaggtcacgccagccctcagggcacctcggggagctgtggattgctgctcagtgtccccaacgtgaagcttcagcaaaagcaaaattgccatgaaaccaaaccacccatcgagattggatatgcagaagccttatggctgtggacagagttctaatcaccgtttaagtggattagcagattcctctgtaaatcttggaataaaactaaagcacactcgataccatgtgcacctgataaatcatctgacatagagacgttcccagggggccgtggagcccagcaggaggagcagagatggaaacccaggccgggcttgcctccctgtgccacctctcaattgtgggaccttgagctggtcacctggcctctcctagtgtcgtcctctgatctctaacttgggctcatgaaacgatggtggaaatgaggcagacgatacacacgtggaggaaagacttcacactcagcccggtgggtttcattcgggcccttttcatcatgaccgagtcttccgttacctgttaccacttcacagattctccaggacttagtggtttccgacagcaaccacgtcacacttctcctggtgtttgtggaatttgagcagaactcggccaggcgagtttgcccatggggcgttggcagagggcacgtggtggtgtccagctggtggctggctaggatcatccaagacatgccttatgttcctgcacctctggcctcagtggggactgttggccagtgcacctgcccgcagtgtccccagcctgatgttcccacggtagctgtgcttcttccagggcagctcagggtttccagcaaaaaggttcccgagatcacaggtgggaagagtcaggctctttaggacaggagagaaggacctggcccagaaactgaacagttgcttctgtcaaattctgttgatccacacagggtccttggggacctgtggctgctgtcacagtggcttaaagtaacacatatttattttcttgcgattctggaggtcacaagtcctgaaatcaggatctcggcagggctgcattttttctggaggttctggggggtatctgtttctcttctagtttccagaggcgcctatgctccttggctcccagccctccctcccatctttttcacagcacaccactctggcccagcttcccttgttacatcccctctcccttctgctcactagatcctctgcaagggtctttgtgatcctgtccggtatcttagtctattccggttgctatgacaaagtaccataaacagagtggtttataaacaacggaaatttacttctcatagagctggaggctctatgagtctaagatcaaggtgccaccagattcgggcaagtaactgtagctcgctgggcccgtttgttcagctgtgacgtggaccgcctctgtgtggcctggttggaatgatttttgtcagtgccgttggctcacagctcaacgaagccggcacatcccttttcgtgatgaggattcggtgtaggatgaggacctgcttcctggttcatagatggtgcctcccggccgcgtcctcgcgtggagaaaggggaagctccctggggtcgcttttaaaagagcactctgtctgcctggagtgtctgaggtgagccaggcctttggggaggtctggctgggaaggggcttgtggccggataagcgcctcactgagtacctggtgagtacctgccgtgccaggcactgccagctccatggccccaaaacttggctctgcaggcctcatacatgcagggctgcctttcaggggagtcccgtttacatttattggccccatagagagcaaggaggaagcgtgtgtgcctgcctggcagggtggaatctgccgtggccctcgtagggaacgggggagggaagatgccaagcactgatccaagtcaacgttaagattcaggtacgcgtcatggccaagaatctgagtaaagtttccatgtattttttcttttttagaattgttaagtctctgtgcgagcgtgatttgccgattgtactgtaacaagtcacatagactgcatgttttctgcgtgctggggtccattctcatttaattctcacccgcctgcccaccctgggaggcaggtgctagtatcccgcccatgtgacaggagaggaagtagaagcagaggtgtcgagtagctctcacgcctgctccctgccttccaagtgcactcctagctccacgtggccaaatccaacttcctttttggggtatccctaaaatgcctcctctgcggtaccggactgcgctcagggtatctctcttcctgtgcacaccagtcagcttttgctaattatgctgcataacagtctcactgggctgcaacatgtttctttctcgctaaggttgggaggtagacaggccagcaggggctcggcccacctccatgtacctgcattttggtaccgggctgaagaagtagcctcttgacatgccattctcagggtggggactggaataagagtggccacgccaaactacgctgtctccttggacgtggtatatgttgtgtctgctcacgtcccacagcagggcacatggcccagcccagagtcagtggggcagggaggtgactgccctccaggaaatgaaggtgacacagagaggaaggggacgcttgttgacggcaccacagtctactcccgtgtggctcctgatcagcaccaggtgcggggagcactgccaaaatctgcttctcatcctcccccaagtatgtactgtttgctgggtctcaggccctgtgttggacacttgatttgaagggttaaaaccaggcacaggcttagcgcagtggctcatgcctataatcccagcactttgggaggctggggcgggcggatcacatggtcaagagatagagatcatcctggccaacatggtgaaaccccgtctctactaaaaatacaaaaattagctgggcatggtggtgcgtgcctgtagtcccagctactcgggaggctgaggcaggagaattgcttcaactcaggaggtggaggttgcagtgagcagagattgcgccactgcactccagcctgggggacagagcgagactccatctcaaaacaaacaaacaaacaaacaaaaacagcacaggtcttgcatacacatccccagtcatttccttgggatgaattcctagacatagattcactggatcaaacagtgtgactgtttgtaaggtttttggttgtcgtggaatcaccctccagaaaggtcacgtgctttgtagagcctgaagccgggggtcacaggcagacctcagtggctcaggcaggtggggctggtggcgagaggaaagtccctcatcctaacactcactcacgtgcaatgtgcaaacatagctgatgcgtcagctggaggtgagggccagctggcactggcaggcaggagcccagcctggcttccttgggggccaccaggggtgacatagaccctcagagccagggctgagcatcaggaggttggcagggcctgggggacgccaggagctctcttgcaacaagagagaaaagcagcatcttagagttgtctcagtgcaaaggctcacatcacagtcagccccagcaaggccagggagacccagtcgaatactttgaccccaggtgggcctgtgtttgtctttgtgtgtgtccagcattgtgttctgttttgatgagaatgtatgccatgggctacgttttcattttcatcttggtgaaggtttacgttgttgatgacctgtggactctaaggatcagggagaggaccctgcatccagaggtgggcagttggaatgtaaacccctcacgaggccagctgtggacaggcacggaagcctttctctctctggaccccttttccttatccatgaagtgggtaacagtagcctgccttgcccaccacattatttccagtgaaacaatgcattttgcaagcggtaaagctgtgtatttcagaaataaatgcccagtaaaaactctttcagataaaccaaagctgagagaatgtattttcagcagaactacactataagaaatgttaagggaagctctgcagaacaaagaaatagaatgccaaatagaaattgggatcctcacaaaggaatgaagcatgctgaaaatggcaaatatgtgtaaatagaaaataaatagattttctcatttttaagaatatctttgaaagtagattgactgtttaaataaaaataataaagtagtatgaggcttaaaacatgttagagtactggataatgtattatattataaagacaggcctggcccagtggctcatgcctgtaatcccaggactttgggaggccaaggcaggtggattgcttgagctcaggagttcaagaccagcctggacaacatgacaaaaccctgtctctacaaaaaattaactggcatggcatggtggcacatgcctgtagccccagctacttgggaggctaaggtgaaagtattgcttgagcccaggaggtcaaggctgcagctagccaagatcacaccgctgtactccaacctgggcaacagggtaagaccttgtctcaaaaaaaaaaaaaaaaaaaaggatgggatatgagacttatactataagtagaatggtataatatcatttgaaatagactgtattacattaaatatgtataatgtaaaactagggtcactacaaataaaaagatacagcatatatacatagagagaagagggagagagttgaagtcttgctctgtcatccacacttggagtgcagtggtgcgatcttggctccctgcaacttccgcctcctgggttcaagtgattctcctgcctcagcctccagagtagctgggattacaggcatgcatcaccacgcctggctaatttttgcatttttagtagagacggggtttcaccatgttggccaggctaggcttgaactcctgacctcgtggtctgtccactttggcctcccaaagtgctggaattacaggcgtgagctactgtgcccggccacatctaatatattaatagagggataaaatgaagtcctaaaaaataattagccagcaaaataaagtcaagaaaagaggaaaaaggaacagataacaaatagtagattcaaacctagccatattgataattacattaagtctaagtggcctaaacattccaattaaaagacagagattctcagattggattttattttattttattttttttgagatggagtctccctctatcacccaggctggagtgcagtggcacaatctcagctcactgcaacctccacctcatgggttcaagtgagtcccctgcctcagcctggagagtagctgagattacaggtgtacacgatcacatccagctaatttttgtatttttagtagagacagggtttcaccatgttggcaaggctactcttgaactcctgggctcaagtgatccgcctgccttggcctcccaaactgctgggattacaggtgtgtgccaccgcacctggccaacatttctttatgtgaatctctgtctcaaaatagtaaagtaagagacaggttaacccagataacatactgagttttttaattgaatcaatatccagtccagggcttcttattctgccctcacagccaagccatctcataccactgggacttcccagtatggcttccctgtctagaatgcccttctctcttttgtcctctggcaggctcctactcatccctcaaaacccagctctgaagttgccccctggggaagccctccccaaaccccatgtcttccctgtatcataaatatccctttcatggagttctcaaatactgcactatcattttattatttggtcttcagactttctacttcctgagggctgagcctacctctctcttcctggacagtgcctgggtcctgtgttttcacaggggtgtggagaggaccagcgcctcttctcattgtgatcacccatcaagctcaggtaaaaactgcgactttcttttctgttttctcagcctcaaagacaaaaatcaaggcgaactcatcccccctgtgctgaggttcacagtgacgtacctgagagagaaaggtgagacggggccggctccagctggatgacgtgagggctgctgggtgcacctctctgggtggtttgtcttggatcctgagcacccacaagccagggggtgtgaccaggaagggaggggctcaagcacagtggctccaggtctgggctctggcctcggatggtctgggtttgaatcctgtctcccctgtgtactagctgtgtgacctggggcagttaccctctctgggcctccattcccttgtctgtccagtggggttaataacaaaccgtacatgacttgtaggattgttgtaacccctaaacgagacagtgcctgcaaagcacttcgggcagtgctggtctgtaggaagccctctcgaaatggggactcctctgatgggatcaactttgatttgcagataccattgccagtagggtgggtgcagtcaagaacttggagtggggtgagccttgtgggctctccacagctcctgaggctagaactgaggtccatggagaaggtgcgtggaggctgcttttaccttaatgggaggaaagaggttcccacggaggagcaggcaccagggaggctttcctggcaccacagctgcaggtgtgctaggtgggccgggtggtctccagcctgggtgctgcagcgcagatgcgtgggtgtcagacaagaagtgagtgcccccccccatccccaccaccaaggcagggctggctcctctccagcctccagagctcggctcaacagttgcttcctcagggaatccccctaacatggccagaccccctaaagcagaccccagctctgcccacggactcagcaccgtgggccccgagaccccgccaccgtgtggtcccttggctgctgccgtttctcacatttccatctggcggggagttcccatgcaatagctcttaaagccaccgcctcagccctgcacctttctggttacgagtgggttgatttcctctttggagcaggccaggtgggtggtcttggaaaaacctgctttagacaggcggggcctggagagcccctcctcacttgtaggccagggtgcccaggaaatgtgctttggcacgagagtccatgcacatgggggtggcatcagtgagcagatgtgctgggcgggggcctgggagaccatctccctcaaaccccagaccctgcggccccagcatttccctcagtcacgatgctcagctggcaggtgagcaggtacggggggcaccccacactgggaccccaagaggcctgcctgtccccggcctggactgcccctccttgccctctaccggttaggtcctgctttccggaagccctctccaattctgcccctctcccaggcagaactgccttcttcacgcctccccatcattcactcattcacttgggaggcattcgctacgtgcctccctcgtgccagactctggggatatcaaagtgagcacacgggatggggaagcagcagctattccaccgagagctgcccagatgctgacttccatcagggagaaggccctgccagaccggggtccctgttaggggggttgaccttgttggggggcttccctgagggaggggcagtggagctgagctctgaggacggggagaagctggccatgccgtgtgacagaaaggccccagagaggagagcaggtgaaggggctcgtggctgtgggagtgcgggagcgtgcggggcttcgaggaagttgggaggagaaggggaggtcaggccttgcaagtcccaagaagacttgcacctccagatgcctgcgccacagtcctaggtcctggtgttccggggcacccccatcatgcaccgcaggccccccaagggcaggctcaggcctgtttctctttctggctctgaagccagcaggggcctggccagagggagcccttccctctaccccacagctgctttcatgagccaattacaagcactgaaaatgctctttataaactgacaatggagacaagttttcttctttgattacaatcacctctttagcagaattgcccaactgaacttggacatcatctatatcttcactgtctaaacagcagccaccagcccctgtggcagtagctcaatagggcagttcatatgaggctcatgcaattgagtgactagatttctaattttatttaattttaattaaagttaaatccccatgtgcagctactggctgctgtgctggacagctcagccctagctcttgtgggaagtcacgtgtctggacgtctcccaggtgccaggcacttgctgggcatcaccgtgtccagtcctctctgcagcccttggagacaggagctcatggccttattctgtagataaacaaggcagataggctcagagaggccgagagctttctctgaggtcacacagctggtaggcagagctggactagagcctaggtctgtctgagattagagtctatttccgctttccctttccatggaccacagaggtgggaaatcgggtgggttggggaatatggaaaggatttgaggaacaaataaatgtgtggaggccagccacaggtgggtgatgccgtgggcaggggagtgtcatataatgtcctggaagccctttgggctgggacctgtgagatgcctggaagctcctctcctgcaggcctgcgcaccgagggcctgttccggagatccgccagcgtgcagaccgtccgcgagatccagaggctctacaaccaaggtgagggtgtcccgcagtcctgagccccgagctgcctggtcagcgagcacagcgctccggggcctcagagcggaggcagggaagcaccgcccccgcaacccacccaactcccagaaaacactcagggtgggggcagcttcccaggaggcatcgaggggcccactggtagtccagagtggggaccttttgtccagacccccaaccccactgggacatggtggccgcatgatgccattttgcctttagggtctctccatccacaccacgtggcacgtgctttcaggagacaccctgcagtgcagggaagctggttttttttatctggcagctcccccgaattggctcagcacggcttccttaactgccatgtgtaacccgcaggcaggggcagtggcctctgagctgaggatgcattgcactgacgctaatgaaggcgctgtcttgctgacaagacttgccctcgctcccactcgctcccgtcatcagttgtgcattacacaatcatggagcatcaggtctgcacggggcccagctcaggcctgcctgtctcaggcccagggcctgcggtgtcatctctgccacagacctggcctcagagagctggcattgtagccgggagcaacagcatgccacagagaagccagcagcccaccccagtccccactgggagcccgggaggaggcagttagggtagtgtaggggctgatggggccagagcacacccatttctaggtggggacagcatcatccctaggacacatggctccagcatcaggtgcgtcccatccggacatctcacgccctgtgtctcagagctcgttctgcagcggcagtgcccaggccggggtgcagacctcagcagtgctgtgttgtgtgtgcagggaagcccgtgaactttgacgactacggggacattcacatccctgccgtgatcctgaagaccttcctgcgagagctgccccagccgcttctgaccttccaggcctacgagcagattctcgggatcacctgtgcgtagctgccctggcgcaggggtggggggcttggtcctcagatgctgtcccccagctactggcccagggtcaggctctggggtggccgaggtgacgtgtacccaccctcctcctgttgccatctggcactgcagggcaagagagggggttgttggggctgcccccaccatgcacagccagtccacactgtccaaaggcagaggaggtggggtcggtcagggttgtccaggccggtctctcaggcacagctgggccaggaggcagggtgatggggggctctctagatttggggctcatcatcctggtcaaagtcctgcctgtaaccgctcccaggccccagaccctcagctctctcatctagaaagggctctcggcatttctccccagatcattgtaggatgccaagcatatatcacaggaactgagcagctatagtgtctgatcctacaggcgctttgtgatgggtcaaatgctcagtgtggctgagcacagatgactcgtaaaaaactccgtaacagcatctcaaaacactggtgaatgctaaggaaagtgatgcctcgaaagaaccataaaacccctcaggccttcatctaagtcatcgaacaccgtcttttcaaatgggactacctccagcgccctcctttcttcttggagcactaacagtcgaaggggggagctgattttggtgtgaattctgaagcagctcggttaagatatcgtaaagacaaatcttgaatcttaaaatcaatgtttctaccccactgtgtattcaagaatcacatttgcccaaagggcagcctggcctttgtcctggcccctggggggtgacttctgaaccttgcactttcccaaggggcaggagttacctttgtcactcatcaggggccctgatggtttatggtaactcatggttatggtgtgactcaagataggggtgtaggggtggccattccagaaagaccaattacatggttagagggtgcgggctttgagtgatgtgagaccagcctgacctctggggagggcatggggctggagactgatttcagtctcaaggcgtcctgtcaaggtcgctggaccccaaactcccctcaaaggcaaatttacacccatttactcagcagtgctcctaagcgcctgccaaatgcaacgccctttctgagatggggaaggtctctcctacaccctggaagaccatgaaagatgttgagggctgactgactttggctagtggatgggaagcctgggagagttcagagccaggctgagcctcatggagacaaatttgatcatgcgcatagaggtacctatctggtggagacagaaggaggcactacattcagcagcatcctaccagccggggccagagcaggcaagatggacaatgctccatcacctgaatgcgccaggctgtgtcctagagagaagcttccagaagcctcccaacttcattagcccctgcagagggatgatgactccagcctctgtaggttcctgcttgagaaaactcaatgctgccaggcgaacttactgtttgttccagccaaaacctggtgacagggagataggccctggaacccctctttgagcagcagttcctttagaaagcttgcaattgtgggccaggcatggtggctcacacctgtaatcccagcactttgagaggctgagttgggtggatcacttgtcataggagttcaagaccagcctggtcaacatggcaaaaccctgtctctactaaaatacaaaaattagccaagcgtggtggtgcacgcctgtaatcccagctactcaggaggctgaggcaggagaatgacttgaacccaggaggcagaggttgtagtgagccaggatcgtgccattgcactgcagcctaggtgacagaacaagactccatctcaaaaaaaaaaaaaaaaaaagcttgcaattatgaatcctttatctgtcctttgagatgaaaatcatctaccacccagagctatgtcaaggacctgagagccatctctttgaaatgaaaacattcaaagtgctacctctgcctcccagtccccggggagggaaggacccagctctggcttgcaccactgcctccggtcataaagataccagacatttgtccacttccggataggcaccaattaacaaacctggagagcgtagtcatattaagcaaccctctgttgggaaggaaaaaatcctttcctgctacccgtcttaggttcattggtgggaaccctgtaacttgttattctgacaaaagacagattcacacgagaaaagcatgccagtttatttaatgtaagttttacatgacacaggagccttttaaatatttatttatttatttatttatttatttaatttttgagacagtgtctcgctctgtcgcccaggctggagtgccgtggcataatctcggcacactgcaacctccacctgacatgggaacctttatgaaaatgaagaaaatgaagacccaggctgggcatggtggctcatgcctgtaatcccagcactttgggaggccaaggcagaaagatcacttgagtccaagagtttgagtccaagagtttgagtccagcctgggaaacatagtgagaccccatctctacaaaagattttaaaaattggctgggcttggtagtgtatgcctgtagtcccagctgctcaggaggctgaggtgggagatcacctgagcctgggagttggaggctacagtgagccatgatcacaccactgtactccagcctggacaaaagagcaagaccatgtccccaaaacagaaggaatgatggagggagggagggaggaaagcaagcaagaaagaaaagaaataaagaaaatgggccgggtgcagtggctcactcctgtaaactcagcacttcgggaagccaaggtgggtggatcacctgaggtcaggagtttgagatcagcctggccaacatggtgaaaccccgtctccactaaaaatacaaaaattagctgggcgtggtggtggacacctgtaatcctagctactcaggaggctgaggcacgagaactgctttgaacccaggaggcagaggttgtagtgagccgagatcgcactgctgcactccagcctgggcgacagagtgagactttgtcaaaaaaaaaaaaaaaaaaaaaaaaaaaaggaagggaggaaggaaggtgaaggaaggtgaagacatggttcagcccgaatgttttgatactaggtttggtgaagagtggaaagtcatggagcttcaattccttttgtcattccgccgtctttagagataaggcaccctctggacatagggaagaccccctcccattagaaggttttatgatctgctacacagaagtagggggagtcagagagagcccttcccacacctgcctttcttagattccttcagctcaataacatattcagcatgcccaggctccatatttgggacagtagtgttccggaccccagcattcccccatctggaactttccccaggaagttttacagtccagaaactgagttggtagattgtctcatgttgcatgaatccttctctcagtgctgtgactaggtcactccagggaaagagttgtgtctcaattcaggaggtagcggtggaggtgggagtagggtgactacctaagtcagcctgttaataaggggcctttctttgtcaacaaacatgaagttcagtggtttgaacaaaccataagttccggggattttttttattttgttttttgtttgtttgttttgtttttgaggtgaagtctcactctcactcaggctggagtgcagtggcacgatctcggctcagtgcaacctccacctcccaggttcaagcctttctcctgccccagcctgccgagtagctgggacgacaggcccgtgtcaccacgcctggctaattttttgtatttttagtagagacagcatttcactgtgtcagccaggatggtctcaatctcctgaccttgtgatccgcccacctcagcctcccaaagtgctgggattacaggcatgagccaccgtgtccggcctaaactccatttttttagtcaggagaacatttagttgagaagattcctagatgttggcttgaagtatcctttcatggtagagagagagtggcagcagctggccagtgaattccatagtttgcaatttagatgtctttggtgatggcactgggtgttccggtgaactttctgagcagactgagtaggaggcacaaggactatccgtacatcatctgctgtgatttctctgaagtttatatcaagtcttccagcgtcagcttttggggctttggggaaatggcaggttttagttctttgtcatgccaactcagggggtaggagaaaactggaaatgttagcttggagcgtcgtagccagatattggaggaaaggagaggaactgagaacccgcaagcgtgcgccgtagttttccacgggagcatcatttctctgtaccgttgcttctctcttgattctcagttacaaaataagtctggtttcattagaatttggcctgattatttacataagggcagcaagaatgggaattgacctatgtcggctctttttaagtctaccttgctagaacttttaataaggaatctcagattcactttttaaaagcctcttgaggctagaaagccaagttaaaaatttgccatcagggccagctgcggtggttcacgcctgtaatcctagcactttgggagaccaaggcgggtggatcacctgaggttgggagtttgagaccagtctgaccaacatggagaaatcccatctctactaaaaatacagaattagccaggcatggtggcatgcacctgtaatcccagctactcgggaggctgaggcaggaggatcgcttgaacccgggaggcagaggttgcagtgagctgagatctcaccattgcactccagcctgggacacagcgagactctgtctcaaaaaaaaaaaaaaaaaaaaaaaaaaaaaaaaaaaaaaccatcagactttgcctgcagtatctgtagatttgagagaattcctctcttctcaaggttctcaatatattttaagtttcctgggcctgccaggaagcggccttgcttactcactgtaacgtcatacataacactgaataaggctagttgtcatttcaaggaattccccttgtatctttttttttttttttttgagacggagtcttgctttgttgcccaggttggagtgcagtggcctgatcttggctcattacaacttctgcctcctgggctcaagtgatccatctgcctcagcctccggagtagctgggattacaggtgtgcgccgccacacccagctaattgtatttttagtagagacgggcttcaccatgttgcccaggctagtcttgaactcctgacctcaaatgatccacccacctcaacctcctaaagtgctgggattataggcatgagccaccatgccaggcccttgttatgcatttttaaccctacttcactagtaagcccaactacataaagatgtatgcttggattatacttaatatgggtaactcagaagatgcagctggtttttttgttttgtttttgtgttgagatggagtctcgctctgttgcccaggctggagtgcaatggcaccatctcagctcactgcaacctctggctcctgggttcaagcaattctcccacctcagcctcccgagtagctgggattacaggcaccggccatcttgcctggctgatttttgtattgttgtagagacggggtttcaccatgttgccatgttggccaggcttgtcttgagctcctgacctcaggtgatctgcccgccttggcctcccgaagtgctgggattacaggcgtgagccaccgtgcccaacctatacagctgtttttaataaactaacaatatcagactaatcttgtcagagttactcaagtcacaagaacttgaaaagaatgtttggcttagtttctatatttctgagagctttagaaatgttttatataaatgctcatgtatctctaagccaatttgaatagaactcctttaagggattttataaattaacttggtaataccatcagagggagaataatttcacgtatacataacatacatgcgtagacataacatagatctgcaaagaaaaaaagaatttttttttaagacagggtctccttctccttgacctctgggctcaagcaatcctcccacctcagcctcccaagtagctgaggcatgcactaccacacccagctaatttttaaatatttttttgtaaagacagggtctcaccatgttgcccaggctggtttcaaactcctgggctcaagtgatctccccacctcagcctcccaaagtgctgggatgacaggcatgagccactatgcctggccacaaaccaagatcttataactttcatacatagtttcatacaagttaagattacctgttgagggtgaaagttgttatcagtatttcaggagaaggccctaaagatttttttctttggccagtttgtttccaaatagtccttttaaccttgttttttgttttgttttgttttgttgtttttaaccaaaggtgtacctaatccaatgtaactcgaaacccataagactttttgtggccatggatacaagagatgttctcagagtcccccaggatccaaagttaccccacagatagccaaaagaaagacaagcgccctcagagctggtgatggctggtaggatgtcagctgtcgccgagtctgtgttgctatgaagaaatacctgaggctgggtaatttataaagaagtttaattggctcatgtttctgtaggctttataggaagcacggtgttggcatctgcttggcttccagggaggcctcaggaagctttcaattatgacggagggcaaaggaggagcaggtgtctcacgcagtgcgagtgggagcaagatggggtgaggtcatgccacacacttaaccagatctcttgagaaatcactcactctcatgagaacagcaccaaagagatggtgctaaccatttatgagaaatctgtccccatgatttaatcacccgtcacccatccccacctcccacattggggattacatttcaatgtgaggtttacaggcaacatcatccaacatatcagagtgcagctcacattactgtctggccagctataaattccctttttttttttttttttttttttttttttttttttgagacaaagtctcactctgttgcccaggccagagtgcagtggctgagattctctactcactacaacctctgcctcccgggttcaagtgattgtcctgcctcaggctcccaagtatctgggattacaggcacccgccaccacgcctggctaatttttgtatttttagtagagacggggtttcaccgtgttggccaggctggtcttgaactcctgatctcaggtgatccatccgtctcggccttccaaagtgctgggattaaaggcgtgagccaccgcgcccggcctgtaaattcttggggctacatcctgaccattggctgttcccccaggcatttggaagccaaactggccataaaggcaagttctcaggacacaaaacaagacgaaaggagaatcgtatcccatgattctcctcttcacaacaaaggacccaagagacagagacaaaggcaaacagtgactcttcctgggaggctgaagatcaccgaggactcctcgagatcagatgcgctgaagtcaaaaccaaagaacccattcttccgaatgtggctctgctggtccaaattcagaaaggaagaaaacaaagagactttgaccaccctcacacagtcgcgctgcagacagaaatctgggaggctgacttgagtaagaattctttttttttttttgagacggagttttgctcttgtcgcaaaggctggagtgcaatggtgcaatctcggctcactgcaacctctgcctcccgggttcaaatgactctgttgcctcagcctcccaagtagctgggattacaggtgcccaccaccacacccggctaattttgtatttttagtagagatggggtttctgcatgttggtcaggctggtctcaaactcctgacctcaggtgattcacccacctcggcctctgaaagtgctggtattataggtgtgagccaccacgaccagtcttgagtaagaattctttcttttggccggctctaccaggggtcctggctctctgtgcagctcccagaccaagtgaggtgttccagccaagggtacctcatccccatgactagaaactgcagggagggtcaaaatcttttccttctccccatcttaggttccttggtgggggccctgttgcttggactaacaaaagacagattcacaagagaaaaacataccagtttatttactagaagttgcacatgacatgggtaccttcgtaaggaaacgaaggcccagagatccagtccactgagtgtgctgatgccaggttggaagaagagtggagaggcgtgggaagtgcgacggacaggggagtgagcctggggcaggaaactagggggacatgccatcttcagagatgagtttgccccttccctctgggtatagggaaggcgcctctcataggatgatctcatggcctgctccagaggagaaaggggaggtcagagagtcctcgaggcccagcctcccacatgcaagctgtgtgacctcgggctagtcacctaacctctcagagctctctttcctcctctctctacactggggtggttgaaatgcttgacctcttgctccctcatagggagtgctcagtgacattggcggttgtgacgctcagctcaccagtcctgcctacttgccagcaggtattctcagagggaccacagagctgagggtgacctgcaccagtacccacttgggaccataattcgtagataaggttcaggcacaacacccagagaaggaaatggcagccacctggctcggttgaaatactcatttcaagggaattccttgtccattcaaatgactgaacaacagcttgatttcatggaataatggcttttattaagaagccaacaggaatgatcatagtggggagtcttgtgtcctggcagtgggtgtttgtagagcacccggtggtcaccagcaactctgtgcaaggctcagtgggagggtgattggtgtgttggaggatgtgggtacacagtagcataggcatgcatgtggctgagtgcacacatgtgcatacatgttcacacatgcacccgcagcgggaacttggtgaatacttgttggttggtggtggtttttttttttttttgagatggagtttcactcttgttgcccaggctggagtgcaatggcaccatctcggctcagtgcagcctctgtcttctgagttcaagcaattctccagcttcagcctcccatgtagctctgggattacaggtgtgtgccaccatacccggcttttttttttttttttttaagtaacagggtttcaccatgttgggtcaggctggtctcgcactcctgacctcaagtgatgtgcctgcctcggcctcccaaagtgttgggattacaggcatgagccactgtgcctggctggttggtgggttttgactggaaggctatggagctccagtggtagatgtggttataagggtaactggggggtctcagagtgggggccagttgcatcaggcccctggagggtgggacactgcctttccaagagcaacaaagtgtgggcgatttgtggtgctgagaatcctgagcaggcagttcgtctagagcagggttgcaaactttttctgtaaaaggccagatagtaaatatgttaggctttgtgggccttgtagtctctgttgcaactactcagctctgccctgatgaggcaaaagcagccacaggcaatgtacaaaatgtccgtggctgtgttccaagaaaacgttattggcaaaaacaggcagtgggccagatctaagccatgggccgtagtttgccaacccctggtctagaccactcccatttataaagtgattcggctttagcagcttcctggaaggtggtgctgctggctgataaagcagagggatggagcttgtagaattcaggtgatgatagggcttggatctgagtccccagcgcgtctcatgttgaattgaaactttggaggtggggactggtggcaggtgattggatcatgagggcagatacctcatgggttggtgctgtcctcgagatagtgagttcttaccagatctggtttaaaagcatgtggcacctctgtcccactctctcttgctcctgtttttgccacgtgatgcacctccttcctttttgccttctgccataattggaagcctcctgaggcttctccagaagctgaacaggtgctggtgccatgcttgtacagcctgtagaaccatgagccagttaaacctcttttcttataaataaccccatctcagcaagaatagccaaacacacaggtttgctgagcagagccatacggccagaagataagtgggggtcccaagcccaaatgtgggatagtccatcctcagagctgtccttcctacacccctgttctcctcccgggccgggatgcagcgctgcccctggcccctctggagctcagcagggagccccatgcccttccaggtgtggagagcagcctgcgtgtcactggctgccgccagatcttacggagcctcccagagcacaactacgtcgtcctccgctacctcatgggcttcctgcatgcggtgagtggggaaggggggagcttggggtgaagcccagtggccttccctcccatgctgggcccgcatggaccagtcccctccttgccctgggtctggggtcatgccctgcttgggcctcggaataccactccctgccccccaaggacctcatccaaggcctggtcaggcacccatgctgctgcggacctcctgcctgtcagacagggcgtacctgcccctgcctgctcctgtacctgctgtccctcagccattgccagtgacttttgttattggggtcctctgcccccatgtcatttcctgcttgggctgagtctctaggaggtgggagctgtgtccaccactggtacagagcccagtggactgagctgaccattcctggggaagggatacacccagaaccacgtacattaagttcctgtgactgcatcgtgggtgccttaaaacagatttactgtgtcactcttctagaggctagcagtccaaaagcaaggtgtggcgggctgtgctccttccagaggctctagggaaggttccccttcctggcctctcccagctcctggtcactccagctatgcctccagctcccccctggcctttgtctgtgtgtgtgtctaatctccctccacctttccctcctaagtgtggaccccctgccatatgtcactgggtttaggacccacccagatgacgcgggatgatctcatcttgagatcctcaacgacagctgcaacggccctcgttccaaataaggtcacagtcagattctctgtggtctatcttagaggggccaccattcaatctactacacaccaggctaagcaaatgaccagagagagagaaacccttcagtgctctgggcctgggcttagtgtgctctccccctggggcagggatccatttggagcaaaaacctgtgcagccaacaggggaaggttcaacacatccacgtgggtccacccccaacccccagacccacggccttgaatgtttaaccccctccatctctccaggccttcgccccaggctgtgcagggtgaggagagcctgagcagagtaggcgtcacatcccagagtctgttggagaatgtcacttcttggttttacaacaattttttttctccctgttgcttgacataatttctcagaggcccaaaactaaactctcctaattctctcaaaaaaattttttgagacagtcttgctctgttgccctagctggtgtgcactggtgcaatctcagctcactgcaaccccagcctcccacgtagctgggattacaggtgagaaccaccatgcccggctaatttttgtttttttagtagagatggggtttcgtcacattggccaggctgatcttgaactcctgacctcaggtgatccacctgcctcggcctcttaagagtgctgggattacaggtgtgagccactgcacccagcctacttctttttcattaggagagactgatttctctctctagccgccacctccatgggcaccgatgtgaatgcacctggtggggtgtggtgttgcgtgttatcaccccagtggcacctgggggcctcggcttgaggaggggtggcctgcagtgggcctggctggtgcacacctgcaacgggcttgggggaccggcagccagggggagcctgaaaggcatccagccatctcacctgagcatcctcaacagatctgtgagggtggtgcctggccctgcctccctccagttctctgctctgccctggtactcaccgcctcatgacccctgtttctgactgaggttccccccagcttgaatcttgtagggaggcaaggagcagagaacaggccctgccctcacgttggtccacatggccccctgccactggctggccacatgaccttgggcaagtctcctgtaccttccaggccccagattcctcatctgtaagatggggagtaatgactcccccgtgctggggttgcacgtgttggcggagatggacaaggagccccttctagcaggcaagctctttccactctccctgcccctcgtagtggcccctagatgtgctggctggtccccatcatgcccagttcgccactcacagagccgaggccagagaggtcaccaagttcgtaccgtctgtgctacagcccatccccaagattgcatctccccagaaggtgcagtggaagaggagatagtggggggttgaggctgtcacagaaggtcagagccagagggtcctccaggacatggaggccaagccttccttttagagatagggtaactaaggccctgagtgggcaggtggctgcacagggtccccattactggctgccggctcccagtccagtgctcctctcactacacctacgcctctccctaagttcgggagggagttccaggtgcccgtgccccttggtgttcactcccctttacttgtgtgtggtttcctccaggtgtcccgggagagcatcttcaacaaaatgaacagctctaacctggcctgtgtcttcgggctgaatttgatctggccatcccagggggtctcctccctgagtgcccttgtgcccctgaacatgttcactgaactgctgatcgagtactatgaaaagatcttcagcaccccggaggcacctggggagcacggcctggcaccatgggaacaggggagcagggcagcccctttgcaggaggctgtgccacggacacaagccacgggcctcaccaagcctaccctacctccgagtcccctgatggcagccagaagacgtctctagtgttgcgaacactctgtatatttcgagctacctcccacacctgtctgtgcacttgtatgttttgtaaacttggcatctgtaaaaataaccagccattagatgaattcagaaccttctaatgaaaactccatgcctctggtccttggactcttgtccatggttcctgagctgtggaccgggatagaat

SEQ ID NO: 36821 - DNA, 33501 bp, Homo sapiens
ctcaagtgaaactgactctgctagaacagtgccgtgcttttccacagaaggttagaccctgaaagagatggctcagcaccacctatggatcttgctcctttgcctgcaaacctgtgagttctgacccttgctgatcgcctcctagttttccataaagttttaaaaattgcccttaaggaagacattgaactgtctttttgatctgtgtttagcagaacaccctgggtctcagtatctactgtactcaacaggatccaactggctggggagagacttaaaattcaaacctaagtgtttaggttcagctttaaagtttatattactgagttatatttctgagatctggagatctcagtttccaaaggtctgaggcaaatccttctcagaggaatcagcacttggtaaacccacccaaaaagcctggcaaaagaaagatcttctaaaagcttgaatgacttacaagcaatttcttcttggcattcaattgtgatggcgtttgagagagaaaaatgtctttcctaattatagttgattgttctatcaggttagagtgatggatgactcatcgttatcattgttgagcctcatctctataaactccctttattttcaaaacacagagctattactctgcttttatcctcaacaaactctaaaataaatgaggaagagattactatcccattttttacaaatagtctcaaaaaagagttggagaacttgaattaaaaaccctatttttcttacttatggcataacagtaaactaaaagaacgacatgaatattgattgttatttgtacaaagaaaattgtaacattaacatagatctgggagtgctgtgtcattgtacatgttatctccttaaatacaaacaattgctctaacagaaatttactatgtttggaacttctagatctacttctagtatctcttgccagttctgaaaatgcactagcagaattctggcatgagttagaaccctgggaacctagtacgtttggattttctgtaaaggtagaatcaatgcactgtgatctctctggtttctttggccatttcaagctatggctcctttaatttgaacttcatggagattgtaaccactagtcagaccaaatttttggagcctctgctggtcgctctagaatggcagacagaaaatgcaagtagatgaggaatggtactagggatgtccctaatcttccagagagagaccagacaaggtagcatttgataccacttaatttgcaaaacattctacaatgtttatgcctacattcttatgtcatccatatgaaaaccattgagatgagcaagatagacgttattaatcccattatgcaagaaaaataataaattaagatttaggggtttaaaaattcacctgaaatttcactacctaaattggtagagctggaaatagacattggtttttctaattccaaggttaatcccaatcccattggttcttctttctgctccacctgacctcttcactcattgctttcaaatttttgatgctcttcaaaaggttaatacctgctaagataaaaggtagctctaggatacacttctttcatctactgaaactgaaataaagttgtcaaatcagctagtagtgaattgtttacaagttttgtgacctagacgaagttacattcctcctctgactcttgtttcagcttcaaaatggggaggtattaatacagtagaattgttttgagaatcaaaatgatgataatgcatgtacaacacttgccatggtacctgaatatagtaagtgtttaacagatatcagctaatgctactatttttcacactcgcttttcattcattattaggaagagccatggctttaccacacagagatcctgggcaggactcctctgtcagggaattgtccaaggaacataaacaggagaaaaggtggtgggagtttgagcttaggtgttggttgtctgggttctggaaaaggaaactaggagtgagatattcatttcatcaaggatccatgaaaggggaatgggagcttgtttttataaaagtgaagccaggagtactttttacatactgtccacctttactgaattatctgtttgcctcttaaggattattctgcaaaccttttctgagcacaaaaatataccatgaattcctcctgctgctgttcctggtagaggtagtcccttacattcagtattgggcttaggagtctacactttacacatttccctggaattcagagcagttgaagaggctgagaagcagtggagagatgcagggagaaatccccatttcccctcagaaatcaccgacataaggaaagtctgagtgtgcaaacttatgactgttccatgttggaaaagttttctctgagtcaaaattcacagtcttatgctctgatgccaactttctgatcatgactttggaaacaccatgactctgactgtctctccacataccctgggagacactcccactctgagggtaggagatgaaggagtccaccagttttaatccttgcccaccccctctacatatactgtctcatactcttaattcttccttttctctgccccattcgtatttctatttcttcaactccctgtcttatctcccatcaataatagtaataagtaaccatttatggagcaatcactgcatattcagcattactctaagtagtctacagttattattttgtttaatccttacaatacactatgagatagatacggtttatgtgcacatatacagatgaaagcattgatacacagagagtcaaaggccacttaaccaaaaagtgaaagaagtagaatttaagcttcagagtccttagacttcacctctgagtcatgctgcctccacccacattgatgctgaagtggagtaaattactctccctactattaatgtttgggaatatgtcagtaaagagtgatgatttatttatttctgtcaagacaggattattcggatagaatctgtgcctttctctatacccacccacagaggaggaaggagctgttggcaggtccttgccaataacggaagtttaggcagggcagtgaggcagaatacccaagcaaacaaccatctccagacatatttcaaataccgttcactttaatattattcaaatgtgatttgaattagtttctttaaacaaataaaagtccaatatcagcatgatgttgatgtcttgttggatgttaaacatggtcatgggcatttcagcagttgagacctaaaattctaagaaatgagtgggctcactatgggtaactggaccccaaccatcatcctggggctcagagacaggaagcatacctgtggaagtatgctgacaaaacaacctgccactgatctgaagtccttgcattgaggggtcttcaagataaggacaaggcctctgtattagaatgagatttaagcagatgactaccacagacattcagaaaagggctcaaaagcagaaatccagttatagaaatggaaatatattacatatgggtaaaactgcttatcaaaaacccagcttccaaacagagggtggaaagctgttccccctgtgataactcaggccttcagtggaaggcagcggaggcctaccttgtcagctccaagtgcttgaagcagtcctggagatcaatatggaggccaacaaggcagccagagcaccttcgcaacaggagcctgatggtcggtgccaagccattcaggctactggagtattcctaaatcaaacctttcttgtcttggaccttaggaaagggatggacctgtaagtttggagatcactgggctcatctatgtgaaacttggaaagaggtatgagcaatcagctgggggctgatataggtggaactgactaggtactcttgtttcctttgttatactcagtgttcaagtacacgctaatagagggcagcaatgttaaaacggatggctatgatctcatgtctgttttgagattttgtgtgtgtgtgtgtgtgtgtgtgtgtgtgttttgaaggaactgattcaagtaaacctaaatcccaataaaggtgatataaagtaaaactcccaggggaaaacaatgtactattgcatgggggtagtaggttcctttttcttaaaacctcatgatcaaggactttccgtcgctttggagaatgacacaaaatttctgcctgcccagccctgtgcttcctcttcccctctatgtcccttcactcagtgtgagcagttataatggactctcttttgggcaccacatgctaaagctacctctggtcactctcccagacctacaatactcagcgatgttccacccccactttttgactctaggaggcagtgggtggagaagaggagaggaagtttagctagtgccacaaaaaaagaacaagaaatgtttgtctggaggatcctaagaaagtaagggggtggaggtgtctgttaagcaactgtgcagtcttccccatttccactcttattaatagctacttgctgactttaacatctccccaataccccaactctaatttttcccttcgtagttgtctgaggtgttattttagtctctttgaagatgtttatttgttttacatagcaaacatatatagtgcctagtatatgccaggcactattctaagaggtctacaaatatcaattcatttaaccctcataatatttttatgaggtcaaatattgtgctactattaccttcaccaatgtgctaatattaccttcattttaaagctgaggaaactgaggcacagagaggttactgactttccctggggttcatggccagtccctgacagagccaggattctagcccaggcaggctaggcctcagtgactaacccatggtgacatacaggtgattccacaaggcaaggctctccttaggaccactagactctcctccattagtacacacacttgagagcaccctcatgtcatttaatcctaataattcctcaaagtggcaggacagctctgttttatttcttttaccaactagaaccctctgacttagcaagtaagtgacattcatggtcatttagctagtcaacaacagaccctagactcaaacatgtttcctaatccctgattcaggacacttttactaactatgctgtgggtccccattttgtggatctaaaaaattttcttcacaaacagtatagaatatagaaagaaattgcagttagccatctgattcttgttaataatcagtttaaatacttgacctttcacatcaagacccagagatcagtaaagagtcctctcttgccttcactctttctcttgctgagattttctgccttgtttttctattgttggaaaagattaattgagtcagttgcaaaaaaaaaaaaagctttgtttttttttgtttgtttttgttttttgttttgagacagagtcttgccctgtcacccaggctggagggcagtagcacaatcgtggttcatggcagccttgacttcccaggctcaagtgatcctcctgtctcagcctcccaagtagctgagactacaggcatgcattaccatgcctgactaatttttttttattttctttttcatagagatgggatctcattgtgtttcccaggctggtgttcattttttcaacaaacatttaataatcatccactagttcttggaggaacagtagtgattgaaacagacaaagactcacattcttgataattgcattatagtagcagtgtattgaggggatgggttgggagacaatcaataaataagcacaggcaatgctttagtggtgataactgcagtgaagagaaggatagtaaggcaaggcaagagagaaggatggggtggggattgctgttttaggcacagtgaccaggaaagctctttctaatgagatgatgttgggagaaaaccctgaacaaagtgggggactgctgaaaagagtgtggtaggaaaagaggagaacaacaggtgcaaaagctctaaggcaaagtgcccttggcctgtttacagaacagagggagctgatgtggttggagtagggaagtaggggaagatcaggcagagcctagtagtgatggttaagattatgaaaggagaatagagagctccccagactccaagggtacactgtgttcatttttaatagaatctaaggagaattatggggttttaggtctatataacctctccattgtcatccatatttgactttggattccacccaaaacatcagtaagttttgcttgcccagccttgaagaattttcctctcatgagttaaaagcctcatacctcaacaatctttatacaatctatatatatgggtttctgattcttttctatttgttttttgttttttcaaatattcttctttttctcacgatccctattgtcttcttctagtcagtggctttgagctgcctaaccatgaaatgtacatttgtaaaatccatccatatccctaggatcatccagggaaacagggttatcatcttagacacagaaaggtgtattgcattgggaagggtgccccagcccaatccaggaggggaaggcaacctccagtgagcaaccagtcctcagtgatctctttcaacactggtcatcctgctccctgagtcctgggctccctctttgccatagctacctaagagtcacagtgaacaggtttttccatctaagcctgcaccccagggtttcagccttttcttgcctttgcttctcctctagaggtatggcctttctcctacctttcccatttgtgttctggcataagaaggtcacgaaatcacactctttggaaaaggttgtaaatgtgggttaccacttcttcactgggctctcaagggtagttagcaaacacttgatccccttcatcaatctcttgttgactccctatggtgttccttatagtaacattcccccccccaatttttacattcaccaaaataatagcaactaccatttatatgtgccaggcattgtgctaagtgctttatcttcgcaattgcatttaataattatccacactttacagatgaggcacctgaggaacagtgaatttcaataattttctcaagataacacagctacgttcaaatattcctagattcaaaatctgcacctttagtctgtatacctcctagctggtcccactcttgcctcctcactgttgccagttagtctcccctcctacattactgaagagatgaaggccaccaagaatgactatcttccattttatcctatctattccaaaatgtccactgtgtattaagcaccttctatgtgtcctcaaaacaattctataaggcaggcattattatagcccatcttgtagtcaagtaagatcagggcctcagcaaatgtcagggattgaacatgagcacaagcccacctggctcaaatctatgctcactctacttcaccaagcagcctcttcctatcaccgtctttaataacatctcaaaatacctttgctctttcacttatcctttcctttcccctttccacttcaggtgagggtgtgaccctccttaaatctacagcttccactgcctgccctttcctttccatcttttgttccatgacaagcattagtagcctgtgtatcttgtgctgttctgcataccagaggtttaaggcaaggcccctggactcagtcattcacagtgtccagaacacagacacgcagattgatgaccaccacacaatgtggcaagtgctatgagagggaaacctggagttccagagaggccatgagcaggagcatctaacctagagcaggcccactggggacatctctctctgcttaccctccctagctcctcccccccagcccccagtctcttctattttaaaacaaaaataaattagtttcacctgaccttctagctactgtcctatctcatcacccttctttcactgtcaagtttttcctccatgctttaccacctactctgtcagtcccctagactctggccttccatcgagttgtcttacttgtactacattctcaaaggccatcaataacctcgtaacgggcaaacccagggccattttcagtctttatcccgttgaacgctgaatcattagacatcagtggcaatctcctccttgagactctttctcctctctgtgatatggcccactattggtgcctctcttgcactcttactgcttggtctcttctgtttcttttgatggtgtctcttctataaatgtgagcactctcgcagggctcagtcgtggacttcaggcttactcttcctgaatgaccctcctctccttcacccacgccatttctgtggatgatctctaaacccgctggatttcagtgttacagtaagtaccagagacactaaaataagaatggcttaaacaagaaagaggtttatttcttgctcatgtaaaaaagtgcggagttggcagttcacagtcagtagaatagttcacaaggtcattggggttccaacttctatcttcctgctccaccatcctcagaacttggcttcctcctcatgactcagaatgtctgtctaagatccagctgtcatgaccttctggcctgcaaaagcaaggaagagatgaaaacagcaaatttccctctttttatgtatttatttatttattggttttcttctgagacagggtctcactctgtcacccaggctggagtgcagtggtgtggtcttggcttactgcaaccttgacccccttgggctcaggtgatcctctcatctcagcctcctgggcagctgggactacaggtgtgcaccatcatgcccaggtatattttgtacttttttgtagagacagggttttgccatgttacccaggctggtctcgcactcctggactcaagcgatccacctgccttggcctcccaaagtgttgggattacagatgtgagccaccatgccaggttcccactcttcttaaagacacagaagtcatatacaacacttccatttttattctgttgggctgaacttagtcatatgaccaacgttagctagaagaaagcaggacaatatagtctttactctgggtggctctatgccctgctaaaaattagtgattctattaataagaatgaaggagggaacaaatattggaaaacagctagcagattctgccacagtgccccaaataatacttcaagtccattctctctccttatcttccatcattccaagagcttacttacatggtccaccatcatctgaagtttaatatttctaacactaaactttcttccccctttgacttctttccatcataaactttatgagtttttcaatgacataaagtagaaactcaaaatatattgatgaacaattgaattctagcagatgcctctttatttcttgcctttctttgtgttatcatcaaatccagcccttcctttccattcccattatcgtcccctggttcatgcccagaagactacagtatccctaaatggcctctctgatgcagcctctccttcctgttttcctccccacacatcattactacattacaatgactaaaacattattttaatcttcactcgcaaaaaccttaatagttcccctctgcctctgatggagacctcaaactcaaggctgtctcaaatctaaacctaatttgtatctccagctgtacctctccccactctgatatgcaaatctatattcatccaattaacatcacaggttctgcttctaaacttttgttcaggatccgaggacttgagacacccctcctttccctttccatcaagtagaattctattcagccttcaaaatcctcctcaaattctactttctttgagatgttttttctaaccactacagctcagcaatccctcccttcttagaattcctaccgtaatcactgtttctaccattcacttgaatttattattcactatctcatattgcaaaggagaattgtgtgtgtgcgtgcgtgcgtgcgtgcgtgtgtgtgtgtgtgtgtgtgtgtatcttatttccctaaccgggtatcaaattccccccgaaaggcagagaatctgtctttgccatagactagcatagtgcatttcatggtaagtcctcaagatgtttttgtgccacaagttatctctgaaattagattttactaaggtcacttccagtgataacataatgttagagtccctttagcacccagaaaaataaatattgggattgattgatatggacactctttcttttaaatcttaaaatcttttaagagcagaataaagtctatccagggtacctgaaactgtccctccaggctttacttgaattagcccttaaaaatggcttttgatatatgctccagtatggccccggcatcaccaacgccatcataagggtggcctagggcaggcccaaagggcatgtaccaattgttgaagtgatgataaagaacatacgatgaatgttaatatatcagtatcaactccagaaataactaacatttattttaccttgatgatcagcaaagcatttctactcatattacatcatttgctgctcaccaaacaggacaaatagcataattattattttcattctatggatgaagaaactgaggttcagaaaggttttgtgacctgtaatcccagcattttgggaggctgaggcgggcagagcatttgaggtcaggagttcaagatcagcctggccaacatggtgaaaccccgtctctactaaaaatacaaaaactagctagccgtgatggcatgcacctgtaatcccagctacttgggtggctgaggcaggagaactgcctgaacccgggaggtggaggttgcagtgagccaagatcactccactgcactccagcgtgggtgacagtgagagagtgagactttgtctaaaaataaataaataaataagaaaggttttgtgacctcgttaaggttgtccagttcataagtagaagtacttgcacctacaccttctgcctccctatctttccactgcatgcaatggttttgcagctgcttctctcagagcacagttggagtgtttgaaggtggcagaatcttcatcttaaacatgtgcaacccctttgccttttccagcaagcaaagtattcttgccaacaacaccagcagcacaaataacagcttcccccagctttgcctacccaccacccccactgcctgattgctctttgataccccaccaacacttcctgaatgacttgctacaggagatgagacatacttttaaaactgcaccacacaccaaccactgtggctgctcaacggccctaatattaagaaggtctcagccttaacaatctacctacatacttcctggggtttagtgagagaacccagcaaaattacgagtctgtggaatctatgttctgtctctctcctcacacctaatctcaatccacagagtggtgtggcaattaagcactagggcctgacttcaaaaaagacttgagacgtgggagatctgagaccaggactggctagataatttgcgaggcccagtgcaaaacgaaaatggagggccccttgtttaaatagtatgtagaatttaaaggtggcaacgcagccttaagtccagttcagggtccttttgaattcagggttctgtgcaactgcatagatcacatgcccatgcctggaccatccagggattcacgctgggacactccaaatacccctctcctagaacccgtcagcccagaaaaacagtttatctgggaagaattaatgttcttaaattttggcaaactatgactcttaccaccaaaggcagcattagcctctttctgacccgctaccccaatggcttatttctattgcttttaccatttagcactcatcgtgttgtattgtctttcacttgtgaccacatctgtcttattttctaggctgtgagctcctcagggctgcaacgatgtcctgtttatccctgtgtccctaacacagcatctgacacataattagcagttaataaatgtttgcagataagggttcccaatttcccccttcctactcccactccacatactccccaccctgttgtatcttctgtacttagccaacccccaactaaatcctcaggccttgtcccggatactgctcctacgggaaaatctctgttggtcagaaaggaaagagctttacatcagctgttcctggggctctttcagtggttgctgagctgaagagcaagggtagccatagtgagacaacaccatcaggttaagaaatcgctttttttgtgccactttcaagggacgtgtatactttatgatccttattcttccgtataccaagccttggataaactttagggtcaacctgaacccacttatgtggaaaactgatgtctggtcatcagagcctacatgcaaccagtacacaccagaaccgctcaactagtttgtttatggctaacaccctttctgattggtcaaggcccacgtcatattggttattaaatactttggatatcatctatgcttgccccaaacagtgtttctcactaaagagccctcattgagaattataggataatgaagaagaggaggagaaagagcagaaaaataatgtcttgaagttacattgtctctcattttacaaactatatattaaatcagtttatcttcaaaagtgatagaggagagaaaagggaggagaaaataagcttttcatcttcccatgttacattttaaaagtattcatccttaagttttcactaggaaatgttccctcgattcccagaacagatcaagtccccttgctggtctctctcaaatcaccataatgcttacatattttgtgcctatccatttgtttctatggttatctgatcaacattggtatcttcctctgattgtaagtctcaaagagcaagaattatatctgtttcttctcgccgttgtatcctcagctcctcgtatcttgtttaaaagagtagatgtccaacaaacacttacattataaattaaattaacaaatacccaccatagtatctggagcaaaactgatcctgaataaatacatgcaaccattcacaaatgtatgaatgaataaacgaaacttgcttacttcagaagttgttccaagagagtctaggaaactcatgagtaaattctatcaattaattccacaaatatttattaagccccttctctgtgttaggcactcttctagagactaggaatatggaagtaaacagaaaaatatccctaaaaatcaccaacttagggaatattttctccagagactccaaagcactctctgcttctatcttccaagaaaagagacaaaagtgttacttgctttttacagagatcacaggaaaataaaaagcaatgacccaagagtccatcagccaagatattccaggttcttgttctagctcttccaccacttggcaatatgatcttgggaaagaagtgcacctaatatcttagactacgtggaggcttatggccttcacctctcaaatgccttctagctttcagagtctgtaagtctaggtaaaaatatttttaacaaaatggatctctagtgagaaacttagtttttgaatgagaatgcgttagaaaatttagttgtcataacatattaaatacacctagagtagaatgccaaaaaaaaaaaaaggcatcctcaagaaactgggtgaactgcatttgtggcagctcctcagggagctccaaggccaaaaagattaggaagtgaaaaagctgcaacagtcagatggctacagttttctttttatgttctcagggccggaagcagctggaaaagactcagaaatcttcacagtgaatgggattctgggagagtcagtcactttccctgtaaatatccaagaaccacggcaagttaaaatcattgcttggacttctaaaacatctgttgcttatgtaacaccaggagactcagaaacagcacccgtagttactgtgacccacagaaattattatgaacggatacatgccttaggtccgaactacaatctggtcattagcgatctgaggatggaagacgcaggagactacaaagcagacataaatacacaggctgatccctacaccaccaccaagcgctacaacctgcaaatctatcgtaagtcatgggaagacggagagcttgtgttttatttttactttgcaagtttgctatctgaaacacatctacatttctgataattgggtcccctaaatctttttatatctataaatacttacatattgatacatcaatacttataagaggatgtagtcttatttcagtcctgactttgcctgtttttagctatgtaattcttccatcagtagttggtcccctgggccttggttttcttttttacataatgtcaatgatcatactactcacttcccagggttatcatgaggatcaaatgagatagtgtatgcaaagtgctttaaaaaaacttttcattttgagatcatgatagatgcaaagaaggtacaaataaatatacagggaggttctatgtacccttcaccctgtgttaacaccttgcataactatagcacaatatcaaaaacaggaaattgacattagcacaatctatagagcttatttaggtttcaccacgtatgcatgcattcatttatgtgtgagtatgtgtgtagctctgtacaatttaatcacatgggtagttttgtgtaaccactaccataatcaagattaaccatcacaagattccctcatactctccctttatagccacatctccatctttcccttccccagtccctgaaaaacaaccagtttgttcacatctacaactatgtcatttcacacatgttatgtagatggaataatgaaggacgtatctttttgaggttgggtatttttcacttagcgtaatgtcactgagattcatccaaactcttgtgtgtactaatagtttatacctttttattgctagatagtattccacggtatggatgcactaggttgtttaaccattcacctcttgaggaacattttagttctttccagtttggggctattacaaataaagctgctgtgaatatatgtgtacacatttctgcatgaaataagtttttatttctctgggataaatgctcaagaatgtaattttatgataagggcatttacagctttaaaagaaactgataaactattttcaactttccattctcaccaggaatgtatgagtgatccagtttctctacatcctcactagcatttggtgttattatttttcattttggccattctgatgggtgtgcagtgataactcaatttagttttaatttgaatttctagtagttaatgcaaagtgcttttgaaaggtaaaatattataactatttgttatcatcattataattgccacaattcactgggagatgtgcgtgctttgttttgcaagctaccccaagtgtggtctgtagactggcagtatcagcatcaactgggagctttttggaaatgcgaatgttcaggtcctccccctgacctttgtgaatgaatgaagtccaggaatctgtgtttaatgttatctctggattattcccacctgtgccaaagtttgagaaagtacggacctagtgctgccctattcactatggtagcctctagacacatgcagctcttgagcatctgaaatgtggtgagtccaaattgagatgtgctgtaagtgtaaaattcataccagatcttgaaatcttagcaccaaaaaaatatataaaatatctcaataattttcttttttttcttcaatgtttattttaagttcaggggtacatgtgcaggatgtcaaagtttgttacataggtaaatgtgtgccatggtggtttgctgcacagatcattccatcatctaggtattaagaccaacatccattagctaaccttcctgatcctctctctcccccaacccctctccaacaggtcccagtgtgtgttgttcccctccatgtgttctcatcattcatctcccacttataagtgagaacatgtggtgttcggttttctgttcctgcattagtttgctgagggtaatggcttccaactccatccatgtccctgaaaaggacatgatcttgttcctttttatggctgcatagtattccatggcatatatgtaccacattttctttatccaatctatcattgatgggcatttgggttgattccatatcttagctattgtgaatagtgctgcaatgaacatacatgtgcaagtatctttataatagaatgatttatattctttggggtatacacccaataatgggtttgctggaacaaatggtatttctgcctctaggtttctgaggaatggccacactgtcttccacaatggttggaattaactaatttacactcccaccaacattgtaaaagcatttctttttccctgcaatcttgccagcatctgttgtttcttgactttattaataattgccattctgacgggcaggagatggtatctcattgtggttttgatttgcatttttctaatgatcagtgatgtttagctttttttcacatgtttgttggctgcatgaatgtcttcttttgagaagtgtctgttcatggtttttgcccagtttttaatggggctgtgtgtggttttttttctgtttgttttttccttaaacgtttgtttaagttccttgtggactctggatattagacctttgtcagatggatagactggaaaaattttctcccattctgtaggttgtttgttcactctgatgatagtttcttttgctgtgcagaagctctttagtttaatcagatcccatttgtcaatttttgcttttgttgcaattgcttttgacattttcatcatgaaatctgtgcccgtgcctatgtcctgaatggtattgcccagattttcttatagggtttttatactttggggctttacatttaagtctttaattcaccttgaattaatttttgtttaaggtataagggagtggtccagtttcaattttctgcatgtggctagccagttctccctgcaccatttttaaatagggaatccttttcccattgtttttgtcaggtttgtcgaaaatctgataattgctggtgtgtggtcttatttttgagttctttattctgttccattggtctatgtgtctgtttttgtaccagtgccgtgctgttttggttaccttggccttgtagtatagtttgaagttgggtagtgtgatgcctccagttttgttctttttgcttaggactgtcttggctattcaggctctttttcatccatatgaattttaaagtagttttttctaattctatgaagaatgtcaatagtagtctaatgtgaatagcttagaatctataaattactttgggcagtatggccattttcatgatattgattcttcctatccatgagcatggaatgtttttccacttatttgtgtcctctctgatttctttgagcagtggtttgtagttccccttgaagaggtccttcactttccttgttagctgtattcctaggcatattaatctttttgtagcaattgtgaatgtccttcactttccttgttagctgtattcctaggcatattaatctttttgtagcaattgtgaatgggagttcattaattatttggctctctgcttgcctgctgttggtgtataggaacattagtgatttttgcccattgattttgtatccttgaggattgctgaagttgtttaacagcttaagaaaatattggcctgagattatggggttttctagatataggatcatgtcatctgcaaacggagacagtttgacttcctctctccctattcgaataccctttatttctttctcttgcctgattgctcttgccagaactttcaatactatgttgaataggagtgatgaaagagggcattcttgtcctgtgctggttttcacagggaatgcttcctgcttttgcccattcagtatgatattggcgtgagtttgtcatatgtggctcttattattttgaggtgtgttccttcaatacctaagttatggagagtgtttaacatgaagtgatgttgaattttattgaaggcccttctgcctcagttgagatgatctgtgggttttgtcttcagtactatttatgtgatgaatcacacttactgatttggatatgttgaaccaaacttgcatcctagggatgaagccagcttggtcgtggtggataagctttatgatgtgctgctggttttggtttgccagcattttactgaggatttctgcatcaatgttcattaaggatattggcctgaagtttccttttttggttttatctctaccaggttttggtatcaggatgatgatggcctcagaatgagttaaggaagagttcctccttttcaattttttggaataattttagtagaaattatgccagctcttctttgtacttcttgtagaactcagctgtgaatctgtctggtcctggcttttgttttgttttgttttgttttgtttttggttggtaggctatttagtactgcctcaatttcagaacttgttattggtctgttcaaaaattcaacttcttcctggctcagtcttgggagtgtgtaagtgtccaggaatttatccatttcttctatattttctagtttatgtacatagagatatttatagtattctctgatggttgtttgtattgctttggggtcagtgatgatatcccctttatcattttttattgtgtttatttgattcttctctcttttcttctttactagtctagctagcagtctctctatttttctcattttttcaaaaagccaacttctggatttgttgattttttgaatggttttttgtgtctctgtctccttcagttcagccctgatctttattatttctcatcttctgctagctttggggtttgtttgtttttggttctatagttcttttagttgtgatgttaggttgttaacttgagatctttctagctttttgatgtgggcatttagtgctgtaagtttccctcttaacaatcctttagcctgccttgcagagattctggtacattgtctctttgttctcattagtttcaaagaacttgatttctgccttaatttcattgtttacccaagagtcattcaggaacagattgttgaatttccatgtaattgtgtggttatgagtgaatttcttaattttgagctctaatttgattgtgctatgatctgagagactgtttccctgaatgatttcaggtctttcgcgtttgctgaggagtgttttacttcctattatgtgatcaattttaaagtaagtgcatacggtgttgagaagaatatatattctgtggaattcgggtggagagttctgtagaggtctacaggtatacttgatccagagctgagtttaggttctgaatatctttgtaaactttctgccttaatggtctgtctaatatggtaagtagggtgtttaactctcccattattattgtgtgagagtctaagtctttttgtagatctctaagaacttgctttatggatttgagtgctcctgtattgtgtgcatatatatttaggatagttagcactatcctaactatcctggtaaagggtagttacccattaccatcatgtaatgtccttctttgtctttttttatctttgttgctttaaagtctattttgtcagaaactaggattgtaacttctgcttttttctgtttcccatttgcttggtaaatttttccctatccctttattttgagcctatgtgtgtctttgcatgtgagatgggtctcttgaagacagcatacaaatgggtctcagcataccagtttgccattctgtgattttttaaattgggggcatttagcgcatttacacttaaggttagtgttgttatgtgtgaatttgatcgtgtcatcattatgctagctggttattttgcagacttgtttatgtagttgcttcatagtgtcactggtctgcatacttcagtgtgtttttgtagtggctggtacctgttttccctttccttatttagtgcttccttcaggagctcttgcaaggcaggcctggtggtcgcaaattccttcagcatttgcttgtttggaaaggattttatttcttcttcacttatgaagcttagtttggccagatatgaaattctgggttgaaaatggttttcttcaataatgttgactattggcccccaatctcttctggcttgtagagtttctactgagaggtacacttttagtctgatgtgcttccctttgtaggtgacctggcctttctctctggttgccttaacatttttactttcatttcgaccttggagaatctgatgattacgtgtcctggggttgattttctcatggagtatctcacttgtgttctctgcatttcctgaatctgaaggttggcctgtcttgctaggctggggaagttctcctggatgatatcttgaagtatgttttccaacttagttccattctccccatctctttcagctaccccaattggtcataggtttggtctctatacataactccatatgtcttggaggtttcattcattccttttcattcttttttcttttttcttgtctgcctgtcttatttcagaaagatagtcttcaagttctatgattctttcctccacttggtctgttctgctgttgatacttgtgatcagtatctcgtgttgtggttttcagctccatcaggtcggttttgttcctctctaaactggctattctggctatcagctcctgtattgtcttatcataattcttagcttctttgcattgagttagaacatgctcctttagctcagcaaagtttgttattacccaccttctgaagcctacttctgtcaatgcagccatctcagcctcagcccagttctttgcttttgctggagaggtattgtggtcatttggagaagaagaggcatcctggctttttgagttttcagcatttttgcattaattctttattatctttgtgggcttatctactttttatctttgaggtcactgaccttccaatggggtttttctgaggtcttttttgttgatgctgttgttttctgtttgttggtttttctttcaatagtcaggctactcttctgtggggctgttgcagtttgctgagggtccactccagaccctaattgcctcagtttttcctatacctggaggtatcacgagtgaagtctgcaaaacagcaaagatggcagcctgctcctttttctggaagctccatcccaggggtgtactgacctgttgccagcctgaatacacctgtaggaggtggctagggacctctgttgggaggtctcaacctgtcaggaggaacaggatcagggacccacaaaaagaatcagtctggttgctttttgatagagcaggtgtgctgcattggaggctcccttccttgtccagactctctggactctccaaagccagcaggctggaacagctgagttgactgaatggcagaaatggtggccgcccctccccataggagctctgccccagggagaattcaaaactctgtctgtataaccctggctagagtggctgaagcccctgcagggaggtcccacccagtgagagtaaagcagcagtctgatctggcaaagcagctgtgccgcgttgtaggggacccttcctcctccagatcatttgaactctccaaagctggtaggctggaatggctgaagctactgaaccacagagatggcagacgccccctcctcagtaattttcatattagggaaaagaaatttttgttatattgggttaaatataatgcataatttaaaagtaatattacctgcttgttttgacttttgaaatgtgattattagaaaatttaaaattacataagtgactcacattacatttcttttgggcaacactagtttctagcatagagaacaccttggccatttctcaaagatttcactgttcatctgcctcattgcagaaaaacacagaaatgtgggtaatccatgttgtgacagatgcaattcaggtatataggtcacccactaaaatgcaagttccataaaggcagggactttgtatattgtttatcactgtattcccagcaccaacatcatcaggtacatagtggatgctccagaagtatttgttgaaaaagaatgaatgaatagtattattcccaggtttcacagtgcttagcaattgtgaatgttcgattaatataagatgattgaatcagtttctataccgatggacagcatagcggaaagaacgctaatgttgggattaggcatactttgccagctgtatgatcttgggcaagttgtttaacctctctgttccaaagtttcctcacttatagaatgtagatcgtaattgatggtattaaatgagataatggtagttgagctccctagtatagtgcctgccttaaagtaaatgctcaataactagtaatcattaattttttaatccttatcccttaaaaaaaatctcattatgaaggacttcctagatgaagaaggctctgaactaggcttgaataatgtagtcaaagagccatacccaaatgtcaaccctttagaaaatatttaactcattcgagaactttagctgagaaaataaagatggtattcaattttaagatattgatttttaaccctttatatgtttaattttgcctacccaatcttcagaaagtcttctaccacgtgcaattaggacacagtacagtaatatcttagagaaagctgtactgtatatacaataaaatctgtaccttatgggtagttagctgggaaaataaagagaaggaaactaacatttattgaacatcatttatgtgtttggcattctaatatctattttaaaaatatatagactatacatatttaagcactgtatgcacaaaaagagcaaaagataatacaatgagatgtaactctctcttctcagaggcagtggctgtagccagcttcttctgtgtcttccatagataattaatgtgcataccagcatagacagacagatagatgatagataagtaaataggtaattagaataatctttatcttcaaaatctcatttaatcctcacaacaattgtatttagggaaaaatttttaccctcatgttataaataagggagctgaagctccatgaatctgtataccttctccattattccatagctagagagcagtagagcctggattctgaaccaggtctccagtggcttccacaatcttggcttgggaggatgaagatctgtcggccatgactctgactttctcttcccagcatctttgtgcaggcaacacctctgttcctgctgagaaaagtgagatgggatcctcttctttaccactgtcccctacctcaacacctacccccaacaattggtaaacaccaagcactccctaggcatttttgtaaatcaaatttctaaagaaacacacacgcacacacacaaaattttgttcactttctactaattgatatcgtatcagtcactattatagttaatccaggtctgtaccccaaacttgttttgggtttattccaagtcttcactaattctaatatggaatagatccctctaaaagattgttaggaccagaatttctggctagcttggaatcaaacatttttacagcttcttactgttcatgttgagttccttcacaaacgcaagataatggttcttatatcttgtgtctacacttctgaatttattgcctttctagttgtgcaccagttccttctgactcctctattcccttcctcacatagctacagtggaagaaacaaaccccaccacagcaactttgctgagagggcgctgaacttattaactccaaatgtggtcattttcttattcctggtaaaagaaaagaccttaacgcttccccatgccagctccagtcctagctatcacttgaattattattgttctttagtaaccctttactagccttcaacttttatagtttactttttgattgcttaagtaaaaacattttaatgaacttttaaagaaattatagctttccaccatggatagtttttaaaaaataaagaaaatatacatacaccagaaaacagaatgaaaaaaaattttaaagattattttggctgggtgcggtggctcacacctgtcatcccagcactttgggaggccgaggcgggtggatcacgaggtcaggagattgagaccatcctagctaacacggtgaaactccatctctactaaaaatacaaaaacaaaattaggcgtggtggtgggcacctgtagtcccagctactcctcgggaggctgaggcaggagaatggcttgaacccaggaggcggagcttgcagtgagccgagatcatgccactgcactccagcctgggtgacagagcaagactccgtctcaaaaaaaaaaaaaaaaagattatttcatgtagttgtgtgctgataaatatttaattagctcttaattgggtgtgtgtattcatatatatatataaaatttatgtttagtacaaattttattgacttgaaggatgtgtagcacacagtttcattaatgataataaatatataatagtctttattgtaaattctatatagaatttattttgctgagagggcactagaggataaattccaattattcttacagaatgctttcattgatttttgctaagcatttatatccctaatcagcttatagttgtaattgatgtatgagtatagttccaacacaaacatcggttgatattttcatttcagttaaataataagaaaaaagtgattcaacaaagacatatatattggagcttcatttgtttatcaatgacacgagcgacttctttgctgaattggataatggtttccaaataccagaagaatacttcctattttttgtgctattcacaatgtaatggctacagatattatacaattttaagtttcatctgcattcctccattgctatcttaagtctagagcaacaatcatcaaaacagtaaatcgagtcctagcttatagcaattgcaaatttctgtggggtaatactcctaccatggctgattttaagacatgcagaattagaaagacagatactctgttaacaaaggacagatacaatagatgtagataacctcgagagcatagacagcaggaaaatgtcaaaaaaaggattagaaagtgatgagttttgaggatttattatctttatttttaacataatttatttaattatgtttttataatttaatttttaatgatggcttgcaaatttctgagaatttaacaattggctcccacaaactagtacaagccagctccagctcactattggctcatgtgtttgcccccacaggtcggcttgggaaaccaaaaattacacagagtttaatggcatctgtgaacagcacctgtaatgtcacactgacatgctctgtagagaaagaagaaaagaatgtgacatacaattggagtcccctgggagaagagggtaatgtccttcaaatcttccagactcctgaggaccaagagctgacttacacgtgtacagcccagaaccctgtcagcaacaattctgactccatctctgcccggcagctctgtgcaggtaaccagctctgcccatctctcctggtgagtctcagagatcactctgaggagctgcaaggtctgaacgtgggccacattctctagggagatgtgcttcctttatctttggcctggtcactgagggcatcacctcccaagaagcctactgggaaagaggccaaagccttctgagagatgctagacatttctgggtgttctgtggcagcccctgatcaactctctgattcaatttctcatcctggcttttaatagcagaaagtttagtttccctaggagctttggcactccttcggagggcacccaattttcataatgcccctgactgtgggcaaacctgcccagcctcttgggcctatttcctgagaatcaagactcactgcatcttctatttccagacatcgcaatgggcttccgtactcaccacaccgggttgctgagcgtgctggctatgttctttctgcttgttctcattctgtcttcagtgtttttgttccgtttgttcaagagaagacaaggtaggattttcccagaaggtaaaatgtggaaactcaccttctctcctcctgggactgaagccatttatccaaggtttagctgaaaggcccattgttccagggaatctgcctttttccgatctccaccccaccacctcccagaatgatggctctgaggatggtatgacattaccctgaatggtcttcagaatccattcctgagatcaccagtagctggtgggcccagaacatgggttcgagcttagtacatacatgaacaagctgtgcttcactgtacgagtgtgttcacctttccagctcagggccctcacatgtgaaatgtttggactagaggatctccagggtcacttccaatttcattgtattttgattatgactattggagagtcattgagaaacatatactaatcctgtactccatggttgtcactatgtccctctgaatccctctggatcattctgtagttgtgccattctccattcagaaaacctgatcttagaccctcaaggaatcattataccctccgattcacccacatcccatgtccacccaagaacttccttttcccaccaatcacaataaaaaacatggaacttctgcttccatgttcctgactctcctttgggtctgattcctcaggttcctgcttgaacaccttcactaagaacccttgtaagttctcagccacaaagttccttgaataacaattgggagggatggggagttcccaacagagtggttaagactaagcacgtgatttgcagtcagtctaggcgtgaaagtcccagcttgaccatttatcagctaccagtttttttatcattgtaagcttccattttctcagttgtaaaatattcacagtaataaggtgtgctgtatatacttattaagtagattaaatggaattagaaatacaaaatacttggcccaattcccagtacatagtaagtacttgataaatgttagctagtatactgataactgattggcctggggcatggtacggaggaggcattctaggggggaggggatttgtgacgtgtgccatactcaaatggcctcacaatggggagaaggcatagcctgcttgaaccacaggtgatctgcaaggtccctcaaagagatattgtcttcaatccctcgctgactcttgggaagagaaagggctattctttgcatctataaatgagacaagagagagcactcagtttgtctcatactcaccaaataagtgataggactaaactctgaatgttggagccctgtaatactgctcagctcagacctgttatttgtaggtatgttggtgccctggattatgaaggcccaaaattctggccttcttttttcaccttgaccctaaaatgttctgtgttagtaccaaagcaaaggagtacactgacgtgaatgtctcttctagcctatacattcttaaaaggaaagacttgtctactgtcttttcttctctggggcctcacacagagcctggcacatagaaggtgcttaataaatgtttattaactgtgtgaactggcagggtgctgtggctcatgcctgtaatcccagcgctttgggagatcaaggcatgtggatcagctgagctcaggagttcaagaccaacctgggcaacatggtgaaaccctgtctctaccaaaaatacaaaaaatttgctgggtgtggtggcacatacctgtggtcccagctactcagaaggctgaggtgggaggatcacttgagtccagaagatagaggttgcagtgagccatgagttggtgcaccactgcactccaacgtgggtgacagagtgagaacttgtctcaaaaacaaacaaaaacagactgtgaatcaatcaaacaagcaataaatgttcatgaaacatctactatgggcttaacattgagatggttacagcaaggtctgcaccaaaagaatgtaaaatagtatataactagaaagaatcaatcaagttaaaaaactaagaccgtgacatggaaagtcaactagccatgcaagacagtcagtggtaagtgtcagaaacatgaagggagatcctgggtagaagagctacatttgactggccacacagggaggggttggggaaattgtctttggcctaatctggactctagagtagaagagaattcccattgacctgtgggtgaggcctcagccaagtgactcctgagacattctgaggatccaagcatccatttcaaaggatggcagccatttaatccctgggggcttcctttcttcatcttaaaaagagaacattggaatagatcattgctaaaaaaaccacctttcacagactgtgggtctatatttatttgtgagacagatgctgcctcaaagaaaaccatatacacatatatcatggcttcaaggaacacccagccagcagagtccagaatctatgatgaaatcctgcagtccaaggtgagctgatgcaattcatggacacccctgtgccaccatctccatgacagggagtcatgggcagccattgcctctgcttgttgttgtctagaaagcagccacggccaagagtccagaggttccaaccaggaaataccatgtcagggaagtgatgccacggatctttctatgaggacaggaacgtgacccattgtcaccccatggcagcctccatgggctgaggcactgagtgtcccacagtgggcccggctccaggttagatgagccatgactaggagcaaggcgccccctagaggggccacacaacagaggagctactggagtgaggtgagggctgctatgtgactaccaacgtggtgaacaggttgctaagggggctacgaggcaacagaactgacagacaagttcccttgaatgcccctcctggtctagcagcagcggcttgctttcctcagactcagagtcactgttccacacccctcctcccatccgccctttacctgcctgcccctccctcccctccaccctggatcgccctctcctgtgtccccaccagcctgcctccttaaagtctgcaaggaatcaagggggagactgaggtctgcctggtcagtctagcgctgtgcttggactgatagggcagctggatccatagagcccatggaaagctaaaatcctgactgagcaggactcatcctgaaccatgggatccctcctcttggcccctgaggtttttcacccccgagaccctgcccaactgctacccattcacccccaccttatcccttcctgatcctaagcctctccagagttggatggaggcagaactgaggccaaaggggaggccacccagtaaatgtgggaccagggaaggatggtgggtagaggcagaattaggaaaggggacttgtagatgggcctgggctccctcactgaggggaagatgtgtgttttacaggtgcttccctccaaggaagagccagtgaacacagtttattccgaagtgcagtttgctgataaggtaacccctttctggctttttatccttgctttcctaactcttccagccattctggtgcacccggtccatccaaccaggggctagctggttcccctgggactccttgtagttctcaggacccactgcctaggtttttggtctatatgtacttccacccatgcacaaagccccactccctaggtcaatggccatccacgagttatcttacttgggatgctgatcccacccttcaaatgcagaagtccctatgcctctgaactacggtatgggaactccatcccgtataatacctggggtcactgctagctcacagtgtgaaaatgagaaaacaggtgcttccctctgagcaaacacaggcccatgccagatgcccagatgggtgcaatggagcagaagctgaatttcagttcatttgctccctcagctgctcttttaccacacgcagcctgcacaaccatttgtagtgccaagtgccttgtgccttatgcctgtgccttatgtccttctctgtcatatgcaaagccctctgacaggactttaaattttggggatctaaggagggattgtcactatctgaaggtcctcactgctgctacaatcaggacagctttagggttgcttaaagaatcatgttttctaagtattcctgtttaatagctgagttaccaagcaggaagctaaactgagtacgaattgagagtgatcctataaggcaatagggaggacatctatgagctcgacaagcagggcagtgctacttccttttaaggaggacttgaagcacagggcagtttgcttgaaaagataagccaaatggactggacaaccagatagagggacatttactttcttagtgatcaggagagggaaggagggaaagaaaaagaaggggaggaatgaggaaagaagaggagaagaaaaggaggacaggcaagaagtgagggtcagggtgcccagcatatttgtgccaggatctcaaggagagttggaggaacaagagtaacttaacttagaaggagataaaattcgagggattaatcatggaatcctggattgtgacatctcaagataaatccttaaagacaagttagataacaattattgggtcagtatttaattgaaaacctaagactcctcaaaccaatgggaagattgtttgcagccctctaaatgcctagagcacaggagatgctggcagtgagtccccactatgtataggtgaaagtggagttattgggatacaaaaaaactaggggtcaactaggaacaaggaatgcaggtagcttgaacctgaatgttgcctcaagtctataatcaaaatccattccaaatatgcccccgcccccattccctcccattgctcttttctgggctaagaagttaattgctcagggcctcccaaatggggggtagctggagcagacatgagggactcagcaaagaacaaggccctgctaccccagatttccccagcatgaggcaaatctaaggcattcccccgtgccatttgcttaactcctctgggaacttgcaggactggagttccccagcagcacctctcagttaacattttctcacgcttctctcctgcacagatggggaaagccagcacacaggacagtaaacctcctgggacttcaagctatgaaattgtgatctaggctgctgggctgaattctccctctggaaactgagttacaaccaccaatactggcaggttccctggatccagatcttctctgcccaactcttactgggagattgcaaactgccacatctcagcctgtaagcaaagcaggaaaccttctgctgggcatagcttgtgcctaaatggacaaatggatgcatacccttcctgaaatgactcccttctgaatgaatgacaaagcaggttacctagtatagttttcccaaacttcttcccatcatagcacatgtagaaaataatatttttatggcacactgggataaacaagcaagattgctcacttctggaagctgcatatgactagaggcctcttgtgactggaggtaacaaccctgcccagtaactgtgggagaaggggatcaatattttgcacacctgtaataggccatggcacaccagccaagatgctctgctcacagtcagtatgtgtgaagatccctggtgcgtggccttcaccacgcatcttgagcaaattaggaaaatgtacccttcgcttgaggcagatgcagcccttcccccgagtgcatggcttggagagcagaatgtgggctgcatataagcacactcatccctttgtctgggaatctttgtgcagggcataacaggcttagtaagtccaaacacagatgacagtgctgtgtgggtctctgtcagagttgtggctctcagccatgtagacacactctccaaatggagtgttggaaaatgttctttctgcagggtctagagactgctgggacacttttcttggagtgctacttcagaagccttataggattttctttctggccaagatttccttctgtatcactccaagcagcctcagcagaagaagcagccatgcccagtattcccactctccaaaaggaactgaccagcttatatttctcacacttctggggaactgggtataatccaaccatcaaaatagaagaccttgcaagaagcagagtcattctccagaaggaacttgggagatgatggtgcagatgatgaaactgggttcatcccagttccaaagactcagagaactagagtttaagctgaggcagagtgccgccaccctggcatgccccacaaacagatcaccagccagcttacacaggcattaactctcctcaatgaggaagaatcattcacaactgagcaagacattcatatgatcatttaaggaagtgtttcccttatgtgttagcaagtataatcggctaactcctaaatcccaatgaatagtcctaggctggacagcaatgggctgcaattaggcagataaagacatcagtcccagtaaatgaatccatagactcatctagcaccaactaccattagcactatgttaggagctgcaaggccccaaagtagaagatgtgcataatgtctgctcttgtgtagctcaggagacaattccagcacagacactacagttaacgctgaactgcagctgcaagtaatagcatgaacagtcagaaaaataccttatgagggggcagggctgaagctgggccttgaaggatggatgaaatttggatagagaatgaggaagacagagggcctccaagtgagagaagcatgaaaaatgagcaggggcctggatcagtggggtgtattcagagcacctctccagatgcaccatgcatgctcacagtcccttgcctatgtgtggcagagtgtcccagccagatgtgtgccctcaccccatgtccatttacatgtccttcaatgcccacctcaaaaggtacctcttctgtaaagctttccctggtatcaggaatcaaaattaatcagggatcttttcacactgctgttttttcctctttggtccttctatcactaaaactcatctcattcagccttacagcataactaattatttgttttcctcactacattgtacatgtgggaattacagataaacggaagccggctggggtggtggctcacgcctgtaatcccaacactttgggaggccaaggcaggcggatcacctgaggtcaggagttcgagattagtctggccaacatggtgaaaccccatctctactaaaaatacgaaattagccaggtgtggtggcacacatctgtagtcccagctactctggaggctgagacaggagaatcgcttgaacccaggaagtggaggttgcagtgagctgagatcacaccactgcactccagcctgggagagacagagtgagactccatctcg

SEQ ID NO: 36822 - DNA, 367469 bp, Homo sapiens
cgcgctcggcgccctgctcgccgggcagaggggaaggcggcggccggctggggatgggcggcccggctgcgccgaggggcgccgggaggctccgcgcgctgctgctggcgctggtggtcgcggggatccccgcgggcgcctacaacctcgacccgcagcgccccgtgcacttccagggccccgctgactcgttcttcggctacgcagttctggagcatttccacgacaacacgcgctggtgagtgcccgcccgactccgcgaccctggcccgcgcggccaccgccccggcccccaggccagcgccgccgccgcctttccggtctcttccacgccgccgtcccgagggggcgatttaaatgtctccgttgcgcgcggctcggccgccgggggacggcgggagaagggaggacgccgtccggggcccgctaaggtcggggtcggcgcctggaggcgggcgggggcgtccgggtgcctccctggggtcccagcccagagcgtggggggagagccgctagagttgtctcctccgccgcccagctagactcggcttcactctctgaatcgaaaagtaacttggctcctctgcctccgggcggccgccgctggcccagcgagcctcctgaacctcgcagggcctggaggagtcggggcactggagctgcacccctccccggttttggggaacccctgaggaaggagtatagcctctccagcgccgctgcgcggggtggggctccccaggggcagggtgtctgggatccactggggcgcactggagcccagagccccggcgcccccccccccccccagctcctacaagaccctgggtggaagtggagcggagaagctcctaggatatagggaagaggaaggtgagggagcacttcccagtgacaccgccggtggggcaggtagttatctcttgggagagcctgagtctcatctcatatgggccattcgacccggagaccttcaccagaagccttaagagagagacgtgtttctatagtggccaaggggtccagttgtcccctgagtccggaggggtgggcctaagaagggggcagctctcccccattaagcaccataagccgagtggtacagagcttgtgcccaaccccagcagagaagcactaagggggggttggtgccctccttggccacatcctctggaccagagggtataaacagccacacagtggtcacttcttgataggagagagagttaggctgcgggaagttcccccgttcaaggtcgtgcctcatgggggcccaggtgacagccaggccggggttgattttattgtgtattcaccagcctgagcgtccttaggggtggcaggcagggaggtcgaggtcactgatgctggtgctctcagcatgtagttatgcaggagagtcactgctctgtattggacagaggctgatggaaaagggtggtttgtggatcgcagtactcaagcattcctggaaaaggggactctgagaccagcccactaagaatcatgctgttcaggagatcagccttcaagagaaccagttttcaaagccctcacatagctctcgcccagctccacatctccctctctcacttactccagttgctgggtataagaccgagtgtgtctgttcttaacacttgtcaaattccccttttaaagcggagcaggctgaacatttttctgtgtcctgcagactcagggtctgaggttgaagaacacatcccagatccccacactaggcaccaggcacgcgggaagcactgtcaaaaatgggagggctgctgtggacagcgggctgctgagaaagggcgggcagctgagcaggcagccaagccagccggagcattgtgtgtgatctgcaggctgaggctggctcaactgccttggagctctttgacagctagagggagagaggccaggccactgtcactgtggatttgcatgggccacaggtcaaagccacactgcctgggaaaggaatgggtagagacgagagcagatctgacagagaaaaggtgttcagcctacttggatttaaaacggggatgaagaaaagctgtgtgacatgagcagatttggccagtgtgggaaaagacagtctggccttcagcttggtacccagggtaaatggtagggagtgggtgtggagcagtaatgctgtgcatattcttgttgccagttgagatgtgggactggtatttcaggggtccatgggaacccatgtgtctgggctgctgagctcaaaagtgccctctcttgttctgatacaagctggctactctttgtattggagtgcttgtccccatagctgttcaggcaccaacttaactctactgaaatctttttaaaataatgcttctttttcctccctcacccaccatattgacttaattttttcttagattgtgttctccccttgatttctgttctcatgctgttgttttcaagtattttcctccccatccttttttctctttccctttttcccagtattctttgtcttagaccttgaatgtattttttgctgtatgtatgcttgaatgtgttttttacccaggcttggtaaactatggcctttggagcaagtgacttccaacatcttctttctcctttttctttcctctagaggctagacttattgtgcaaggctgctgaaacttaagccaaaggattcttgcttgcataggcccctattaatgccttgtccccaattttataattttatgttaattttcttaaagttagtcaccctaaatttgtaagatcaggtcctgtgaattctggatctgtcctaagtctgtaccttaacttcaactgtggggttggttgattgacttggtaactgattgttggtcgcttactcctaagcagtacctgagccctggatcttctagtcctgcttgagggacatgtcagtcattttcaattattcgtgattgcaaacagcagcaggggtaaacaacctttaacgaaacccttgaggacaatcttaattatttcctttgaataaattcctgggcttagaattgctgggtcagagaggatggaagcttcaaggcattctttatgtattaccaaagtgccagtgaagtgtgtgtactttagaaaaatacattaatttattcagacactggaggcttgggagtagttttgcaaagggctgctctagtgcactgaaagagtatagaacctacatgggggtgacttaaaaggatcacaaatactcgtcaaaatgagtgaggaaggtaaaatatagacatgaaagggaaaagcagtatagcaaaactttgaaaggaaaagaagacatgttaattaagccttgtatcttacgtctctcttctcgaagaaattattctttgttacttaattcaatattttgcagtctaagatatttgcttcatgctaattaactacctgttttacaggtgaaaagatgtgttgtctctagggaaagggagggagaagaatgtgctggaagtggtagggggagagcacagaccccaaagtcagcacggactctgcaggcggcagagtagagcgttcccatgttgagggacctgcgggtgtacatctcaaagcatgtgaatgtgctctgttggtggaactagcacttctctaatcccataactgagcatttctctcaattattttgtagaccaaaattgtcactaatcggaggatcctagatccctgtgtaagtgtgggggtgatcttgcttttcccagccctggtgactgaacccagctctgtagccatatcacactgagcacagagccccagacccagcttctctcagagtacttgcttgagtggtcccgctgtcactgtgctctgggcagtgagaactgtccccatggctagatggaccagaatatcctggacaatgttccagatgacgtttgtatcagctaggatacaaacatgcaagggactcaattttctttttttctaataacacccagagtgtctgcctgcccagagccagcttcctctcctatagctcccactccctgagtcttctggcgtcctttgaacaacaacagtaagtgccagggaacatggacaaagccgatttctgtccccttcctttagacatggaccggttactcagctgcagggctgacaactgtaacaccctgtgatataaataaatgctgcctggctggcgtgcagcctccagagcggacgtctttcacaccccaccccgtcccctcctccttctctgccccagacgccctggagtccaaagtggttgggtgcactggcttcctttctggagacgtgcttcctgctccctctcctgggacacatcaagacggctgtgcttaggcacagagcgagtgctcggaaatggaagatgtgctgggctttttgctttgttaaagttgtcagagtgttgttcagtgaggaataggaggcaattccaagccaaggagaacatatccttgatttgcatgaaggttgagaattaaaagaacaagctagatagttctggtgagctgtctgatgtagtcaccactagccagatatattggtatgtaaattaactaaaaataaaatttaaaatgcagcttctcagttgcacttgccacatttcaagtactcagtagccacatggggctagtagctactgcattggacacaacacagagagaacattttcatcatcacggaaagttctactgggcagtgtgggtttagagcaatgatgtaagtcttaaagggctagacaaggatcaaaaggagaggtaagaaaaagaaaaagaaaaaaaatcaacccatagcatatgtgagtactaaaaccgaaacgggtgcttacatctaactaaaaattattgcctgctgaagaggttgaattgtctttctactcataaaacaccgcagggcctgatctatatttagggctgggggttcaacaatgaaaactttttgctcacaatctgacaggtgagaaaattgtggggttctagttgtgtgtctcaaatgaaatttaagatctaggctctgatgggggagaggcttgtcctcaggcaggcatgagttgttcagaggggcagaagagaaactcctgtgaagggaaaacatttagaaggggagccctgggatcataggacctgctgcccctggccctgcccgtcttgctgaggaaacacccagaaatggtggtgggagccctgccttctcataacctcagtggtgagcatctttgcagagttcctctgtcctgtgccagactctaggggaaggtgtaggtccgcttcctcatttgaatttttctagggaaatggcattttcagacattgttcctggtcctcactcaccctacagagcctgctttctcaagctctcaagaaggaacaacacatatatgaggcctgagttccaaggggatccaaaaagcatcttctcggggtttctgggaaatttctctgaagatctggagaagctggcaagggtgctgttttctgagctagtgctgaatgctggctgggggcagagacagctgtcttgcccagtggagaaccttccagggcaagaagacagtcttgtctcaaccagtcattaacggccctgagtgtgagagtgtgaagggccgggccccagccagctctgattccctggtgacatgctgctgttcaggaaatggtctcctgataacttctattgtgatttgttcagggaaaatgttgtttttacatttgttaaaagcagccatggtgttctctgaaattccttgctttcaaggggttgcatggaattttaacaaccaaaatgaatttcgtcagatagtatctacaagaagtcagatgctttcacaggcataatattctttagttgagtctttgtaacatcctggtgagtggtttccagtttgctatttggggaactgaggcttacagagttacacgccttgttcaaggcccaccccagcctgagagatcaatgcacattcactgggggcttgtgtcagtttgcatcctttaggaagcagatgctaggacagagataggagtgtgagagaattgttgggggcgggtattgcctgtgaaagacaaatggggaagttggatgggacagagagagcctctgactctatgcagatctgattaaagtctcagtcaactcaacagagatcactgggcagaaatagctgtcctctgccagggtcaggtattggctggagctgtctgggaagagcacagcctcagctggaatcctgcagcagatcccaagaaagctgcagctggaggctgtcagctgacattccgccttgcagctgaacagcatgaagtgacccacacctctgtggctgccctggagcctgccacgcgtgaatcactgtgttgggagggtgtgagatgtgctccttggcctgcagtgtggctggggatcatctttgctcatacctctgtaatcagtgtgtggagcgtcaggactgacagtagggccattgggactggcccagaaacagaatcctgagcaatcttgccaccagctgactcacaaggtgcctctttctgatgtcagagaagtcacaggtgatggatttcagaagaaaggagctctgctttacgctgagccaccgagttctctgaactgcaaatccttttagccaagtggatttggcgatcaaccaaagcagaataaaatgttttatcccaaccttcctttttgccagaaggagtcctaggaagccgatgtaagtccaagattgggaaaaatctacagtctttgaaaccacgggctcacttggtccaccaatgtctgttctgaccaaaaaggacttctgtgttgagtttaaattagcaacagtagcaacaataacaccaaaagcagcaacagtgtatctgaatattcagtagatgtcaagtgctatctacattggtactcataccagctcatttaatgttcccaacagtcctttcagctggtagccatttgggctgccataacaaactgttataggttgggttgcttataaatgacagaatttatttctcacagatctagagccttggaagtccaagatcagggccccagcagatttgctgtctggtaagcacctgtttcttggttcatagatagtggtgttctcactctaagctcacacagtgaaagggatgagggagctctctggggccacatttataagggcactaactcattcataggttatatcctcatgacctaatcacctcccaaagtccccacctccaaataacattaccttggggtgaagatttcaacatatacattttgagggaacacaagcattcagtctgtagcagctggctatcattttatccccattcatggaggggaagctgaggtacagaggcattattgcccaagttacatggctaatgagttgtcgagcacaggcctgtgcctttgcccacccaggctgactgcctgtcaggaagtcaagaatccgagtttgggggcttcagggcgctcaaacatctgtcttgtgaagttctgttctgcctgctttcctggaaaagttattgaattgcaatagcagtagcttctctgcggcaccctttggggatgcttattcatgacccactggctactcttggggggatgctagggttctgttttctggagatgtttgatcactgagtgaacagggacccaatgattctgccagggacatttgaagggcctcttctcacaccaaggctgtctagcattaagacagaagtgtcccaggaaagatggagtactctgcaatattccatgtatccctctaacctcctggggctgctttgttactatccccccatccactctgagttctactggctcccaccacttatttaggaatctctgaattggggaaggtagccatggtggccagtgtttcagaatcactcctgggtttgtaactttattaaagaaacccacacagagtcaaacttctgcaccagtgaccaacaatatgtgagaggatgatttgtatcctcaaatatttgaacacttaataaaaggcatgaatgggtacaaaaaattagaaagaatgagtaagaatgagtaagaactagtatttgatagcacaacaaaatgacaatagtcaacaataatttgattgtagtttaaaaataactaaaagagtataattgaatcacttgtaacataaaggataaacgcttcaggtgatggataccccatttaccctgctgtggttattacatattacatgcctgtaacaaaatatctcatgtacctcataaatatgtacctactgtgtgcccaaatcttttttttttttttttttttgagatggagtcttgctctgtcacccaggctggagtgcagtggtgcgatctcggctcactgcgagctccaccttctgggttcacgccattctcctgcctcagcctcccgagtagctgggactacaggtgccccccaccacacccggctaattttttgtatttttagtagagagtgggtttcactgtgttgggcagaatagtctcgatctcctgacctcgtgatctgcccactttggcctcccgaagtgctgggattacaggcgtgagccaccgcacccggactatgtgcccaaatttttaagaaaaataaaaaatcacggaacaaatttcctccatcttagctgatctgttggtgtgttaaggccacctgggagatggcctttcctaccccttcctatctagtgtccaagtgctgtgatgtatgtggatcccagagtaaacttggtgttgtgcagtacacaccagtaggcagcattgcagagggtcttggcacctcttttgcaccaggatgggtcctagagggtggatgttccagattcagctgagtagtgttcctgtctctaccttcattgaatccctggttccacagcaacaaccagatccacgatttttgtgccataaaagggggcactgctgagatgcacaagtgcctggtggccaagagagtgggctccagcattagccctgccctcagcctgccttactcagctctctgcttaggagctgtgtgatcttgaccaattacttcagctgtttgaacctcagtttccttttctgtaaagagtaataagggtacatccctcattaggttggtgggggcattaaatgagatgatatctgcaaagcccagagcacaacacggcacacagtaagcccttgatagatgctcgtagttatttctcttgttacttgatctgatttatgaaaccaatggtctttttcatcctgacttgagatgctgagttttctttcagtatttttgttgattcattcatttattcatcagactttgagtgttgacactcaacactgaaatgaatgagatattctaacatagacacactcttcattatgtgtggcctctaacatttttgttatgctctacataaatctgcatttttgtgcattcatttacaccctgtctgcttccaaaaaggatctgagatggctactttaaatggagatctttgggattgtaaatcctagaattttgcctgcctgtttcttctctgtgctcttggaaagccaaggagcagatgggaggccacccttgttatggggagctccagctcccaccccaggctccagataagtctgggaggtagatctacagttccaggatgggatacttttttaaaaagtaaatgtaaatgtattgccatatttctcttgaaaaaaaattatcacaagaaaccaacaagaagatatcaaggctttttcttagatctgccagaagtctgtaatttgctctatcccttggattttagtgttcacttgctgctttcagatgtggaaggaaaacctcagtccttttgccttgcctccttctccagttgcctcccctcagtgtgtctgccaagacctgagccccaggccagggcagcagcctctgacctttcactccctaacacacaagctggggaccaatgtcactccaaggttggaccctgcccccgtgcctctgcttttcccagttgggcatggactccaccaatttcattctctgacttagcgttatgtggtgtggattgtactgctctccctccatttactgtaacctaggctctccaggataaaaattattattgccaaccttttatgaatactttctatatgccagaaccactgtgttcatagttccctttatgcagagcaggctaccactcccgaagcacagagaagccaagtcacttgtccaaggttacccagcaagtaagtaaattacagagttgtgctttgaaccaaggtgggactgatttaatgctaaactgactgttctcagggttagccatgctaccctccctacctccacctccatcaaggccctgtccaaggtatcaggtttctaaggaaaaaggagaagggccctgaaaggaaaagggcttcttcggagggcatttgtgtctgctcttggccttgcagataaaataccataatctactcttgcaaatcaggccatcctggggtgcatggtcccccaaacactttcatctgccttttccttttgtgcctcatcactgccttgggagggggatcatgcatttgttattatccttgttttacagaaaaggaaaggaagggtcagagtggccaggggacttgtctaaagtcacatagctgtagctggcacactcctgggtgtgacttcggatacactctttagggcctattctactactccaccatgcctgtcccatctcagggccttcagtaaaagtctgtggtcctggttggtgatgagattcctttgagggagggaaaggagaccaggtagctagaggagccatagcaatagttgtcagctgcatagttggataattggtttggacttagcgggaattagtgggcgatggaattaccacggtccagattccgtcagaagtggcatgccttagcttgatgacgtatctgttttctatcaccacaatattgctgcatccctaacaaaccaccccaaaacttagtggcttaaatcaaccaccacctgtagcttattctctggttggcagcttaggttgggttcagctgggtggttcttctgttctctccaggactcactcatgcatctgtggtcaacttctgggttagctggttggctggctggcaaaggatggcttcagctgggagggcttatttttgctccatatgtatttcatcctcttgcaggctagcctgggcttgtacacatggtggttgggtagggtaccaacagaacaatcagaggcttgcatgatttcttgaagcctaagctcagaagtcaaaccatgcccctctgccacattcttttggccaatgtaagtcacaggtccagactacatcaagaggaggcagaaacacatttcatctcttgacaagagaagctgcaaagtcacactgaaaagagcagggatacaggaaggatggggaattgtggccactttgtaatatattactggtggtgaaagcatcctggctgtccctgaattactgtgacagtctgaataaattcctgcccagcgcaccagaaaagggaacaaggttctattaacctaaatagcaaacacagagagaggctctctaaaagaaaatgtttactcaggaatagggcattgcagtgggaatacatgtgtcacagtaatctgcatgaatattcagggaggtaaaggaaaacaaaggcttttaaaggaaaaatgaggattacttaattgttttgagataattatctttggatacaaggatcagtgacaagggtggcaccagtttgaggttggatagagagttgctaggtagatttcctcacagaaggtgtgagtgtgtgtgtgtgtgtgtgtgtgtgtgtgtgtgtgtaaggttgtgatggcctttgtgcaagattgtgtttttgcagatttttttgtgctagttcttgttatcagttgtttatgcatgaaaacctttccttcatggcgtcccacagctctatttgtcagggttttttttttttttttaaacataagtgactccattttgattctgacaacttttgcaattctaaggatctatgagctcttgggtgctgccaggagttagaactgggatgagttgagtgtcaaggtgtttgacctactactgcccagcagtctaacatttctttgaacacctactttgtagcaggcactatgatgggtgttttataaacattcttttgcttaaaccttacaagaaaccttcttaggtacacttttattcctcctgttttacagaagaggaaaactgaggcttggagtgtttaagacacttgtctaagagacacagcttgtcagcagtagaggcaggacttaaaccctatgttactgcctgtgcttcttacactttatcaccatgcataactttcccataaagcttagaagccaggtagaactactggcttaaaaccctagaaagcagtcagtatccactgcttaaataccaggagcctcagtttccccaaatataagaagagcttatgaggcctttcaggtcccatggctccattgggcaagcattggtccctagtgagtcccctccctctggaaatgaagggtttggtgtggtcagaggtggctatcctggcaccagctcttcctttactcaagcctgggctgctttctgcccagtaagggatgcggacaattcctggggtttccccgtggtggacacacagtgaagaatttgactcatgtaaccaaaacgtgggtccctggggaagctttggctttgggatcaaatgctgaaagcaaacctaatgggtttaaagtttttaatccccagttgctgtccttgatctggctataattttgcctgtggaatcgctgctgtggtgtttgtggggagggagggaatctttgagacactgtcagttctcagtcctgcccagggaggcagctgcggctcagtccttctctgtcacccgctctccagagaatttacctgcagattaccctcaaaacatgagacaggttcagagcgaggtgggcggctggaatggagccttcacagacagcttgaccacacacagggagctcaggaagcagctttgttggaaaaatgcagggcacttaaactgccacaccaggagggggtttggagaggctggaaagagcatgccattggacacagacactctgggttcaaatcccagctctgccacttactggtggtgtgacccaacatctctgaatggaaaacacatgagaggctgcctgacaggatggccatgagcaagaaagcacccttgtgagcataaccagtgttggtgcatgaaccgatgcacccacactgcttattaagagaggcaaacctctggttaacaccatgacagcagtgtcaatgctttggaaaagcaaggtgattgaagttcaccttttgagtcacctgagcctgatggggaggggaaggtcttttctcttccaaaccccagcatgccctttgacatgacggagctttcacatcagagttctcacttcagagctgccctcaaaggctcactggggcttgctcaggtggggattacatatgtgagtagctggcaccagagggggcactgggtacctgttggttcccttttcctcctttcaggctgatgtggggtgggtagaatagggcacgggtgatgtatttgactactggggtgcgtgctacagcttggcatcttaacatgaataaccatcttaacctcctctggccacctgcttccctatctgtaaaatggggataatattagtacctcccgtagggttgctgtgaagagtaaatttgatcctgcccgcaatgagcctaacccagcacctgcacactctatgtgcctgctacatgctggttgccctaattagaagtttagagtcctgcattgatgagaggacctaaaaggcttatgaggccaggcatagtggctcaggcttgtaatcccaacactttgggaggctgaggcaggtggatcacctgaggtcagaagttcaagaccggccttaccaatatggtgaaaccccatctctactaaaaatataaaaattagcggggcgtggtggcgtgtgcctgtggtacccagctactagggaggctgagacaagagaattgcttgaacccgggaggtggaggttgcagtgagcggagatcgccgcactgcactccagcctgggtaacagagcaagacaccatctcaaaaaaaaaaaaaaaaaaaaaaaaaaaaaagggcctttgagtttgtggcatctttaactggggatgggataggaggagagagccttgcttctcaagggcaatctcttctactggctccaaatgaacataattatttgtaatcagtttagatagttacatagtacttcttaaactatcaatcacctggagagcttgttaaaatgcattctgatttaatgggctggggcctaagattctgcatttccgacaagtgccaggtgttccccatgctgctggtctgaggaccacacttgaagtagcaagcaaagcagagaagtagcttgatgctttgttgatggcagcctgttggtggggacactcaggcccttttatgtggtaaccatagcagaaaggaacatagtcttgttgagagtaccaggagagttggggcgatgtttgaagtggctaggatgtctttttataacttagcagatggcatcttttcagtggcttgttctgaactctgggccatggtaatctctgtatcccttgggatcagcctggtaaacagccagctgaattaacttcagaaaagactcactcatgggctggcctgcggtagtcttgctggatggtggcctaggtacagagcagtgctgggctgcggaggaagccacgatgttctgtaaacacatagatacaagcacattcccgcgtgccacctcgtgagtgtcatgcatgtgtgtgcatgcccccttatctctagcctgattttccattgcacaggatttgggaaaaacctttcatctgaccagctgatcagaagttttgaactgaaaggttgttatcagggtttgaatcagctattgttgttagaaccattgagtaccttgggcttggaaggaaataataattcagcaggttcctttccactttagattttggtgtaaactttgtccctgtcagtcttggctctaggctggaggaagcagtgcctgggaataagctctccagggtcccctcctgcttagataacctatgaatctgtgtctgtgaatttggagccatggcattatctgaaatttccagggttccaatgccagtttgggagacacagtggaggaagaacctgttgtttcttgcagccttttcccttccctcggacgtgatgaattctcactcttgtgaatttttttgtgatttttgtaaaataaattacaagtggcaattagtcactgtgctgatgtaaatttggagttggtgggaatttttggactctgctgtgtggccctggggtttttgagtggaagaggtattttatgctccccaggtcttagaacctgacctgtggaaaggctgaggatgtttcagcagtttagacagggcaaactgctaattcttctcacctgtgaaaacagctggtcttatgaagcgcaatatgtgacttaccccagtggctctaaagctcagccgctacagcaagggggaaaattgatcccttaatgtggctttcttctcactggagttttgttttgtacgtcattgtgcatttgagttacagcagacaagggccagccaaactgctcttgtgtgggtgagggaggcaatgtgatctgtttgggaaagtgcttgctttgatttccaaagggctgtgggttccagccctgcttctgcttgggaattctgcagttgtgcccagcaaacacctggggaggtgcatcccagggcattattgaggagccgcagggcagcctgggtacctgcaccattgggagtcttgcttctctcactccccagcagggcatcttcctcatggaatcagatacagaccctccaagactgacctggaaggagacactccagtgaggggtgggtctccctggctctttgtaccctccaattcttcaggttctaggtgttgagctcagggcagtgggaattaagatgggacccacacacattcccatgaaccttaacaccatgtctctgagccaggttagtgacgatgtcctttgtgatatctgccagcctttgctggagtcccctttgagggcctcagacttctgttgtatgatgtagaggccttgtttgtctgcccctttgcctagctggagtgttgcaggaggagcagcagcattccaagaccagggtgcagtgaatgactgagatcccaagatgaaggtggctttcagggcagagggaagggagcctgggtcagctttctacatccccaggaaagctgtccagggtcatcctaacctctgctaaacaccttttccacaaatacataatatgtaatgcactctattccaaggcatgtgggagatgatctatttcatgatacagaagaaacccttgtgaggtgaattccctctcttttctaggctgctggagataaggaacaacgcctgttctcactaagaagtggcttggcattttctactctttgaacatcagtgtggattttgtttgaagtctcattgtccaagaccttttccaaatggctcgtagctcagcacaaaccgtgcctgattagtgttgtttggtattctttgctatagatcttctgttgactgctttccggaaacaatgcataaaactgtaggtcagaattatttttgtaacatctggaggggagcttactgccatttcccccgtgttctgcactcacacaggcccaaacctgcctcttctgtcttctgggtgggtcttgcccctttcctgtagccgggggatgctcctgctggggatggcccaccctaggcagcttttcagttcaagatggaggatacagaggttcattcttgctcctgtttgcatgcaaactgttctatttctgttttgcagtgggagagaggatacggtttataattccgcactgctgctattttttttcctatttgcccctaaatgtccatgctgtgtgtgtggtgggtggtaggaggaggagagggagacagaagagaaatagcgtttctaaattttctatttgttactgaaatgtaacacatccaggaaagtgtccatatcatatacagttatcacaaatttgtataatgtcactgaggttgaatgacaacattatccgcacccccagcaattcccctccctaattgcaaccctgctttctcctctccagaggtaaccattatcctgccttctaacactatagttaaatttcacctgcttttgaactttagataaatggaatcagactgtgagtatgctattgtatctggcatcttttgttcagtattgtatttgtgcagttcatctctgtggttgcagttgaatgctgttcatttgttttcattgctgcatagaactctttttttgttttgttttgtttttgagacagagtctcactctgttgcccagactggagtgcagtggcatgatctcagctcactgtaacctctgcctcttgggttcaagcgattctcctgcctcagcctctcaagcagctgggattacaggcacctgccaccatgcccagctaattttttgtatttttagtagagacagggtttcaccatgttgcccagactggtcttgaactcctaagctcaggcagtctgcccacctcggcctcccagtgctgcatagaattctgttgtattgctgtaccatgatttacctgtccactctagcactgatgggcctttaggtttcttcttgtttttttttttttttttgatattacatatgcagctttgaacattttgcatgtctcctggtagaaatgtatgcatctctattaggtatagtcctagaaatggaattactgggtcaaagggtaggtgcatgttcagctttattaggaactgttgaatagttttcccagtggttttaatggtttatactgccactagcagtgtatgaaggttctagttactctatatccttgccagcacttgggattttcagtctttttggtttgagccttctggttggtatgaagttgagtttctctgataactaacatagttgagcaccttttcatgcatttattggccatttggctatcttcttttgtgaagtatctatgcttgtctttggcctattctgttgacttgtcttttcttattaatcaatgaggagtttttaaaatagattttggataggaaccttttgttggttgtacgtgttcccacccatccatcgcagtctcctgggtaggtgggactaaaagcgtgcgctgccttgcctggccatttttttttgtgaagatgggatttgccatgtcacccaggctggcctggaattcctgggctcaagcgatccacccgcctcggcctctcaaaatgctaggattacaggcatgagccaccacattcagcctccttaagctttaatatgcctgggaaagatctaacaggtttcactttaggacctctcccccaagcccacacagaaaagtataataatatgattttcaaagtgagcactcagagagcccacccgtggttgggtgaatacttagccatctgcctcctattttcttatcgtaggttgtgacagaatgcctttttctcttgctgcagggtccttgtgggcgcaccaaaggcagattccaaatacagcccttcagtgaagtctcctggggctgtgtttaagtgccgtgttcacaccaaccctgaccggagatgcaccgaactggacatggctcgaggtgggtgaccattactgctgtggtggaaatgggttctgtacccttataccttgctcttcttcttcccaggatggcctgatcattcactcacccatccatccttccctccttccctccctccttctctccaacaagcatgtattgagtacgtaatagttattaagcactgggatacaccagtgaacaaaaaaaacaaggatgctgccatccctagtcccataaattagtgggcaaaagagatattaagacaagtaattgagagagaaaagaccagagggaaggtgagtatttgatttaatctagataggagggtcaagaaaggtctgggacctttcgacatgattagaaggatgcgtagtcgttagctgggcaggtgcaggaagcacagccttcaagcagaggtgccatttggaagcacagagcgaggttgtgcagctggagagggagccaggagagtggagcacaggagggcagcaaggcaggctggggccaggccacgtggggcctagcaggccagggcaatgtgctggaattttattctgtgtgtgagtggggaggccactgaaatcaattttgggtattacattttaactagggaaagatatgatcagatggatgtttttaaaagctcactttgcgctgggcatggtggctcatgactgtaatcccatcactttgggaggctgaggtgggcacattgcttgagcccagaagttcaagaccagcctgtgcaacatggtgaaagcctatctctactaaaaatacaaatattagctgaacgtggtgatgcatgcctgtagtcccagctactcaggaggccgaggcaggaggatcacttgaacccaggaggtcaagggtgcagtgagctgagattgtgccactgcactccagcctgggtgacagaactgagactcttgtctccaaaaagataaaaaaataaaataaaagctcactttgatctagcagaaaatataagatctttggaatcagatggttctgactgcattcaaagcccagctgggactgattgggaatgtcctatagcttcttgggcctcagttccctcaccttcaagatcaagactaatatacctacctcgcaaggatggtcttgagaagattaagtgagataatacaggtgagtacacagaactgtgcttggcacatcagtacaaaggaggtattttgttataatcatgactgcaagcatttctttctccaaagtctttttgcataaagattttctaatttttttgttgttttttgtttgtttgtttgtttttgagacagagtcttgctgtgtcacccaggctagagtgcaatggtacaatctctgctcactgcaacctctgcctcccaggttcaagcgattctcctgcctcagcctcccgagtagctgggattacagtgtatgaccatcttcggctaatttttgtgtttttagtggagacggggtttcgccatgttggccaggctggtctcgaacttctggcctcaagtgaaccgcccacctcagcctcccaaagtgctgggattacaggtgtgagccaccatgcctggccaagatcttctaattattttttaaataaagagttattgtgattttctttagcagaaaaagaggtttgtgaactgtttgttactggtgcataacaaattaaggagcttacttcagaacataaatcaaggccctgcctctttccatgagaaagtcttgccatgtggttgggtgcagtggcttatgcctataaccccagcacttcgggaggttggggtgggcggatcacttgaggttaggagtttgagaccagcctggacaacatggtgaaaacccatctctgctaaaaatatgaacattagtgggatgtggtggcgcacacctgtaatcccagctacttgggaggctgaggcagggcaatcgcttgaacctgggaggcagaggttgcaatgagctgagatcgtgccactgcactccagcctggacgacagagagagactgtctcaaaaaaaaaaaaaaaaaaaaaaaaagaaagaaaaagaaagccttgctatgtaaaaaaacagttgtctggattaaacagtatagtacatagtgatggagttgatttacattttgtggaaagttccttatttcctcatagggctgtggaccaccctttgaaagcagccagcagaacatcactcctcaacccaagtctggctcttctcctctttctccagggaagaatcggggcacgtcctgcggaaagacctgccgggaagaccgcgatgatgagtggatgggggtgagcctggcccgacagcccaaggctgatggccgtgtgttggtaagtccctcctgggggtgctgtgggaagggggtggcactctgagaatgaatgatctgttaggaaggctggatggcatggtgacaagtgcatggctttgaggttgcttattctggactactgcttagacaaatgacttatcttcttattttctttatctgtcaaatgtgaataatgtctgtcccaaggtgctgagatgtgactattgaaaaataaaacatatgtgaaaagtgctttgtacatctcattcattacataggtatttgtgtgtgtgtgtcttaaattgaggtataatttacagtacacaaatcttaagattacagtcttgattttcacaattgtacacacctgtgtaaccatatgcccactgagatatagaatatttccatcgtcccaaaagtctccgatgtccctttccagccaactcctctcacctgagacaaaccacagctgtgatttgtataatacattacttttgctttttctagaatttcatataaatggaatcctacagtatgtgctcttttatataagacttctttcactcaaaataatattttctgaaattaatccccattgtacgtatcagtagttcattcctgtttatctctacataatattacattttatgaaataaatgttatttttaactagttatttatcggacctccaaagcacctatgctgtattttgatccgtaggtgctttgagggagatagaaagaaaagtctttgcatttgagactcctgagatcctggagttgtgctgtgcagtaaggtggccaccagccctgtgtccttatttaaacttaaatttatccaaattaaactagaaattcaggtttttagtcatattagccacatttaagtggctcaataatcacaaatggttactggctactctattggaaagcagagagagagaatattttcatcatcacagaaagttttattagactcaacacgaaaggaatttctaacactgcagaggttttgtttttgtcaatttttcctttaagcttttctatgaggtataatactaaagcacttaacacacccagctgtgagtgcacagcccgatgggttttcacgcatgtacacttatgcatccccattgccagtactccggaagaacccctgcaccctttcccagtcagttcctctgcccttggtgagtgaacaactattctgacataggctttctcttgcccttgacttttatcagaagctgtacgaagatttttgttataaaagcgtaagctcaagaggggaaagtaatactagctgccgcttatggagggcttcatttgggtcacatgctgcaaagctgagggtttcgtgtgtattttatcccagggaaacaggttttccttaaggcactaggcaaagtgtttttgtcccctctctaaggagcccacttttgtgttaaacttcttcatggcataagctgttaatctgaattccgtcctcagcacaattaagcatctcccccttgtcgggccccttgggagaggaggaagcagctggatgctgtcgccagcatggtgggggcctccctcctggaagccgttgtaggtcctgcacaggctccctgagcccgctgtttgccttggtttccagtcctttcatcactgtcatggctggccctggaccctctccaaacttccacattcctccaggcatggtggcctgaccctgactggacaaatgggccccagaggggctgaacccttgtctgccattctggggaaagaaagggaagaagctgactcatctgtaaatcaaagggtagcccaaggtcctgattcagaacaaaaaggaggtggtggccccgtggcagcataacacaagatgctcttaagggcatcgagcctagagtcagagtttgctcctgtgaaaatatttcctctctgcaaggaaggataacctctctgtggctgagggcttgtttccagaggggcaagacagaattctgtgttaccacagatcagtatcacaaaggagtcatttctggggacagtgaacagcaatgaggaccacagggaagatttagcaaagggagccaagaaggcagcactagagcatttgtggataatggtgccatggatagtcctgtctaattaattgcatgcaggactatttttttaatgttttatgaagttattgcatcatccactcagtaagccactgtatatgggtgctgggcaaagaggagcatctgacaccatctgctttccttgtgccttttgtttgtttttctaattgtggccaaacacatgacataaaacttaccaccttaaccattttgagtgtacagtagtggtaaatgtatggcacattgttgtacaacaaacctttaaactttatcttgcaaaacttacatccattgaacaacactctcctttttctccttcccgtggttcctggcaacattgtatttctattaagagtttgactactttagatcttatgtgagtggagtgtggtgttcgtccttttgtgacgaacttacttcatttagcataatgtcctcaaggttcatcatgttgtagcatgtgaccggatctccttcctttttaaaggcagaataatatttcattgtatgaattcaccatgttttctttattcatctattgacggacatttaggttggttctatctcctggctgccgtgatgaatgctgctataaatgtgtaccaatatctctttgagatcttgttttcagttctttggggtatacacccggaagtgggattactggatcaaatggtacttctatttttaatttttaagaaacctccatactattttcccaaatggctgcagcattttaagttctcaccaacagtgcacaagggtttcaatggctccacgtccttgccaacatttattgttttcctttttttttttaaatagtggccctcctaatgggtgtgagataatattttattgtgattttggtttgcatctccctgatgattagtaacattgagcattgtttcatcatctgcttgttggtcattttatatcttttttggagaaatgtttaggtcctttgcccaattttaaattggattgtttggtttttattgttgttgagttatcctcatggcattttgcacatgggcagtcttgctaggaaaggcttgtcctaagtcccctctgcccctgccccactctgtcctcggcacttctctttcttcccctgtatgggctctgcctccttcgtgaagcctgttaagggttttctggaacaagctgagcatcttttgtgtcattaggaactcaacatcatcttattacttatattgtgtgtataatttattttgtggccatatgtccccttttatggaagccacttggggatagagaccaaatctacccactttcattctcagcatctggaggacatctctctaaggaatggcatctgaaagtgtgtttgaataatacagggactgagggtcaatgttaaaacaattagaaaccaaattagttgccatcttttcttggtggctgattctaagtggctgaaggaaacaccaggaaacattctgtaaaatgttccttggaaatggcaggcaaaaacaagatacagtgagtgtccctatttacatttggaggtctcatagccatttgcttttttctttaatgtttcaaccctacctgtcagagctttctgggaggcaagtatttacttttaaattaaaaatgggaaggatatgtgttgttcaggtgcattttgagaacttgagaagtgcctgggggtgtaggcaagagaccagtatccccaaggagcacaatattggattccaaggttgggtttgaagagggagaggtgggctagctcttttgaaagtggtgtctggtgctgatagaaaacctaagaacaaatggagaatttgaaagctgcaatggggcgtgaaatgtctcagtgaccaaaggcattatgtggaccatggacccagcaaccagctctggcaaggaccagattgtcaggctggtctggcaggttgaccttggcttagtgcctgcccatctcagctccatggacactgttgcacctcccaggttttccccagaaacaaatgatactggatgtaaagatagcatcaggattagaggcaagccccttcccttctcactctctcatcctgagcttcctgtgtgcagacgacattttaagaaatgagcggggaggggaatcacttcttgaaataaccactgaacaaactctgtataggcactgactgctgctcagactttggaggacaactcaaaatgttcaagtctaatgtcgccccttttcatcagacttgccaaggctcagacaacaaataatttaagcttctagattatttttgtgcagaagcagtattctctggttctctttgtcatttcctttctaattatcagggctgtccttatctgttcagtgcttcccatctgtccatttttttttttcaaagccacagggtacatttttgcatttacttctgttgctctgtttcctgattttttttaaagtgaactttttattgagctgtaacacacatgcagaaaaaggtataaatcatcaatgtatacctcaataaattttcattaggtgaacgtcctcagaataacattttcacaccccagcagccccttcccaatgcccctcctggccacttcctcctcggttggggagcttcttaggggagtctcatggcatctcagcctctctgtgatcctgctccccaccacacaccattcttagcagccaggcccagttgtggccgtgcactgtggacctggatgcatgacaaaggctttggccatctctatggcaggtgcgaatgtaggagggttggcagggactgatgtgcctttgtggccgaagcacccggaaagtgccattacccacctctaggagggatgtgttgtttccatacaacaaaaaaggcctttgaaataaagtgtttattttctttctctttttcctcttttgggaggaagagcaatccttataccttgaaatgtgtcagattctaatatttggagtgggacaaggccctccttcccctttcttatgattagttgaaatctgagtttgagcaagtcttgctgttttcagagaatgctctccttctcctgttcttccctcacagccgaactcatttggagagattgatggagttactaatgctttggagacagtccctaggaatttttttaaaatgtagtggtcagattgacatgtgtgtatatataatgataatcaaggctaaacacagtcttctctttctgtaatttatattcagagacactttgcattgttttcctacatgaatccttcctttgacactttgatctctgacctcccagaatgcttttagtttagtatgaaatgcaatatttggatcttctaggaattttccaagatcaccccttaaatagtttatggcacttaaaaaatgagacaatacaccagacattaagtacagcaaagccttcctataagtgtcagtgtgcagctggctatcagacagcaccatgataaacatccgcctcttttcacagcccctccaactcagaaatacaataaaacatggtcaacccttgaagccaagggctttgctaagtccaaaaacttagcaaaaccaaaacataactgatttacccacaaattagataacaataagtgattcaagtttgcgagccataagaattgagtcagaactttaaaaatcaattatttagcagtatggagtgattatttacttagtgatatattttttatagttctctgcctcatatcatttcagtctatttagaaacctgctattttagcacaaaacaatatcaaggagaggagtgaatgtggtttgcagcagaaaaaataacaatagattgttttctgtagtttaatgtcatacgacaagaggcagaatgtgggcaagctcaggttttgagagtcattctgagtgtgtcctcttttgccattgggcagagagtggccttgtccagggccttggtggcagtggcttgaaggatgaagagcagagagcttagaaggctgtgatcttatcatagaatgatgtcagggagaaccaggccccaagagccccctcactcactcggtgacgtggggcattccattcgaccccagagtggttatttcacatgtcctgggacatgtggcaggggggctgtaaagaggataaagtcaccaggcctgccccagggggtgggttttgatggcctctcaggtaggaatgagaagttttaagatggaaaatgcttcatagtgaaacaaggaagactcagaattcctggattccagtgctgtttgcagcacttactagctctgccacttaggcaaagcactctttgatacatggtgctcttgtacagaaaatgggaattctaaagacacctctgctcaccttccaggattgcagaagaggtcagaggtaggccataagaacgctaaatgttatcacttacgaaaacaatgcgtttgagggaggcaaaccaagatgttaaaaactgattattttcaaaagcaatattttaagaaaatgcattcactggctggggtgaagtgaactgatatcagaagtgagtagtgaatgcccaggagaagtggaacgggctgggcagggtagagtgtgtgcctctgagtaagcagctcggctcttcatcagcacagcagtgacatctggatgtgcagagacatgcacgggaactggggccactgtcatgtccaagcagaaggcaggggcatgtttagtgtggcagaaggacgatccaggcctgcatcctggctgctggcactgctccagtgtctgttagcagagctgccctgcctcatggtgtcttgcgtggcttcgaccctagtgctgagaggctcctctggagagctggccaatgcatctgtccatcttcttcgccagtatgcggagctctcatgcaccccaagacccttggccatgaaccttccttcagctttctcctcagagaggccttccttgacctgcctggcaaaaccagccactccctggcatgagggaactttctggtgagatggagatgttctgtgtcttgctagggccttggtgacatgagtgtgtacatttgtcaaagctcatttgtgcattttgctgtatgtaagtttccataaaaaaacaactctccacacacatttacttctagttaatgagatgcatgctgaagtgtttctgtgggtagaaacatggttgaatatcagccattcctcccttccctgctgtctccacatcggttcagtcccttgggcctgtcagctctgaagccacccccgtcgcccatctccactgcccctcctggtccagacctgcatcatctctcacctggtgttcatttgcacttttgccctcctgcagtctccaccaagcagccaaatggtctttccaaactgtcacttggatcatgcttctcaactgtgtaagactctccaccacttcccattgcagatctgctgaagtcacagccattcctacgtccccctgtggtccaaccttggccgcctctttgatcttatctccttcccaccatggtcactccagaccggcctttctttctcttgagcctctgagcctttctcacgatgtatcctttacattctgctatcctttgaatcctcccagaaccctcttcccctcatgcttcaggccttcccgacctctggtggaaactatccttcccactcccagattctctattctataaccttgtttctttccttcccaatgctcaggactagctacaattctcatttgttgatatatttatttcctgtctcctagtaggctcccagtggcttgttcctgttcatgcagttttctgatgcccagaaaagtgcctgttatgaaggtgtggctttctggtccctctgctcctctcttctcccacagaaagaaacatctggcactgacaggagtctgctttgtgatcttttggggccaactttcctgctctcaactgctctctatccctttaggcctgtgctcatcgctggaagaacatctactatgaagccgaccacatcctaccccatggcttctgctacatcatcccctccaacctccaggccaaaggcaggacgctgatcccttgctatgaaggtgagcatggattgatttttcctcatccccctacccacctcatgccctaagcccgccttcccacctctatgcaccaccagctgaacatttccccagctttccacatgctcatgatagggcagcactgtttgctcccagatggtctcttggtccccaaggccctgcccagagaagaggcaggtacagagggggcagcagtcccaggcctttccaaccctcacctgacttggctgcagagcccacggtgcttaccaagcattatgaagtctcagggaccgaaattcaccaagcctcagccaagtgacctaacagctgccttggttttctggtaatgccaggtgctgtgttgccttgggaaacttaccttctctctctggacctcagtttccttgtccgaatattcagtggttggcccagatgatctctacagccccaggcagctccaagtcagtcattaggctcccacacagcttctggctgcactgtggacagatgtcctgaggctggggggagaggagacccaggattcataaagcaacagctggacagaaacctgacactctgaactttcagcatttcatgacatttgaggtctgactttccttcccatgtggtcctgcagcccaggcagatgctggagaattgggcgcatcctgaatgtggttttaagagctcctcgccaaggggcacttggaaggaaaatgtatcctctcagacttagaaccttcaaatgcctgggcatcgaggacagtcactaatagtgattgagtcagtcactatttagcccagtcgaatctgagctttaagcgttcagaaaacacggttattttcttcagtttgatagctcgtagtttcaagttttctcagcctaattttgggtaagctggaacctgctccttctgtaagtgctggactatttatttcttaattcccctcctactttatttggacagaagtctcactggcttatgtccacattgcctttgggcctccctgggttttcctaggtttcaaattttgtggacactaaaaaggattcatgagaaacactatatggacactgggacccttctgggtactgaggtgacacaggtagggtgctctgggaaacgtcccccacagaagagccagcaagatctctgcaggaggcacaaaccctctcccctatagagtgagccttcctttggtttttctttctcctctgtatcagcatttgatcagctctggctgggccatgtagggaaatgaaactctggccctgtttatatctgtattgtcccaaacagaagaagaacaaacttcatcttaaaaatagaggatgatataatcaatcaagagtggagggatcgttggtttcagaaacgcaaagcatgtgtcaagcctgggtttccactgccccagtttactcctcctttttcctaaggaagaaaaaggaaaagcctctggaacaaccggtggggcagctcttcaggctgagaaggagcgatgggctcagcagggtgatggaggcagtgattgttgaaccatactagttatgcataggaccagtactttggttttcccagaagatgacatgttgtgacagggacacatgatggtccctgatgattcctctatatataccacaagcacaaggacagccctctgaagagggaggtggagttcaatgtccatgtgtacgcaggtccacgaggctcataattctgcattactttctattaagtagctgtggatcatcagtaggccagtgttgatctgaggtctttacacattctctcatctaatcttcccagaagctgtgaaaaatgtttgtttcttttttttcttgggtctgattacaggtattttattttggaaattgttctagaagacaccagtgaggcagggggaagtaagaatgggaagggaaggcagcccatggaagatgtactcctcagcacgttacctgggcgagtgggtgcagtctctggggtgggtgctggggccagtgtggagcacacatctagagtcctcctgcctgagggctgaggggaaggggcttcctccacctggcatcctgtcctgccatgtgtgtgggctgggaaagcctccaggacagaggtgctggcaggtggcagtcaggccacatcataggaacggtggtaggagctggggggagacaggtgggatgcccaaaggccagcttctgtgttgtcattctcctgtgacaggagtaagtggagactcagagtgtatgtgaattgccccaggtcactcaaacaataaatggtggagcaggattttgaagctggcctctgtctgactcagcaaaccattttgtgtcctggtaattaatggtaatttctgttagtttgttttttagggtttctaatttaaatgagaagtaaaagccagtcaacaaccctcacaaagcaagaaagggtgactgaactatcccaaaaatacaatggacttaatgatggttaaatggaactggtgaagaaattagcaaaatgattatgcccctgcccaatcttccttcccatgggcgcacacacacttttatatgctaacccattcattggcccagggtgggaaataagggatggatggggctggcatgtggagtattggggtgtaagagcagccccttagaaaaatgggggactaaattgaaagtttctgtagttcttggccctgtaagaggagaggggtagaagatgctgagtatttttctagaagactggactggacgggtggggctgggaggatgccggccgtagtgagagggctcttgtctgtgctctgttggctttaggcatctccacctccctgttttgtggtttaaactagacctactatggcttttaaggccaccattatttcctcaatgtggagaaactcagtaatgcaagttctctgttccacgttaggggtcacattatggttaaagacaatgggaagattttagagtttgacaggacctttcagataccacctagaacagcctcctgtctttcatgaggtccagagaggtgatggcctgagtttttctttctaatctgttattcacatgccacacaatggagaggcagagtagcttggtggccaatgcacagattctggacacagactgccggagttcaagtcccggctctgctacttcctcttattaacagtgtaatctcagatgggttatttaagttctctgtgcctaaccaacctcaagggtctatgaagaggactgagttaatgcttctaagtccttagaacagtgtctggcatatacttgctaatatatgctaagcatatatatactaatatgccatgtacaacatactgtattctgagcaagtgtttgttaatcatcatagggtgactgacttgtgtaccgggaatagaatccacttaatcttaagtacttgttagttgccagatagacaaaacccaagtgacacagttccagctaccaagaagctccccatctacaggggaaaacagagaggggacagggtgttttaaaagtgggagggccgtgtggagagagaatttcctgccagtgtgtactgctggagcccgtccccaagggcttgagctgcatccaagtgcaaggtggcattatttcattttacaattggaaaaactgaaacccacttaaagtctgcaggctgttgagactatggaagagagggatggtggaaattcgagactggtcatggtggtgggaacagggcaagggaggagggggacggctgcctctaaacccacttcttgtgggatggtggaaagaccgtgggaggggctgtgggttgaggacggctctgctgcacttctgcccctttagcctcaggcctgtcacttggcctctcagtgggagtcgatgctgtgatgcctccactgcatttaccgctttgggttatggtgaggagctcccgagaaaactcaggtgaaagtgctcagcaaggccacccattgttctataactgtggcctcatggtaagtctccatatgggccagctgtgctcctttacaacattggaaggtcggtttggttgcagagactctaaatatgtggggatctctccaaaatgtctcaagcttttgaattcttaaaaaattggtctctggtttggcactaggacatggcttctcaggtgcttcctgtttctggttggatgggaaaagctaccagaatatcctgttggaaccaggaaaaacagaggaaatgggaaataaaaatgaatttaggacataaactcatggagcatatccttcagtcagtttagtttgtgtttgtctgatgtgagaacatcattacctaccatatgttctttggttttatcagaatgtgtgagaaaacgagagctttggtgggacgatgtatagggaaaactacttgtaaattaaagggcaagcactataaaacattaattactattaaccaagctatgatattttaggactccgaaatgttaagtcaatgcatgtgataaaatcaagtacagagatttctttcatcctttgcccttgagaccactgaggcaagaagccggaacttagcaggagtgagactgcaaacaagttgtctttttattgtgaccgaaaaacctgatgagtgtggaatagtttgggagcagcatggcaaattaacaaagcctgttcaagattaaactctgagaaagaaatgcaagaggtaattatgatgccatggtatgttagacctaaattgtggaatctggctttactactcacttattgctatgattaaacctatatgctcctactttctgacttagtgaccttaggcaagctccatgagcctggtgccctcatctataaaatggggagattaagatctacttaagaggtatgtgaggtataaagtgcctaccacagtgctcagtcgagagtgaatgctgctcattgccttcaattagaaaatgtaaattttctaattaattttcaagcaacataatagtattcttaaatattctcagaaggtgtctaacatatcctgttttagtgactagataatgaagggtagaaagctggatattcctaaaatgattttaagagcccttggcaagttataatttctcaaatactgttgaagatcatattggcacaatttggttggtaagtgttccttccctctttttgtagatgacctaaaactttaactcatgccatgtttaaatgttcttaaatttgggattgttgaagtctgaattttactgtgctttaaaattgtgatggaaaaacttcctatggattccaaagatttctgtaccactctattatcagggaatgactggcttttatttctagtgtgtgtttgcatttcctaggacagtgatcatttccagggaaggaaatagattacccattcaaaggtgaagatttttttcccctttaatgttaaaagtggtctccacaagggataaaaatcaacgaaggtccatttacaaatgaaaaggaattggggttttgttgtatttttgttttgtttttgttttggagagaaccataaaaggctaagttgatccatttaaaaattcaagaacaagcctcataaatttttattaaataaagacctctacatttacataggattttatggtttccaaggagctttaataaacatatcttatttaaataaatagagcaaattaaagagaagaggatgcagttgtacattatggccagttaaacagagagggattctgagggggaggaagggagggaggccccagaggacagccatggctgtaaggaggaggccagaggtctccagcagggcctctctggggctttccaggtttccttggagccaagaattttaatcttgggcaaacctgtctcctatacttcaaacgtgtttccatgtattacgtggaattatagactacctaaactgcatcttttgtttctctcagaaaaattcacagattcagattcacctaatatttattgagcacctacctggtgccaggggttgtgctaggtacttaacatttttgatcttactgagtaatcacatcattctcagataagtattcttatccttgttatacagatgagaaaactgaggcccagggagcttgatgaaggtcacaggcttattagtcagaggaggggttgacggcttttaagtgtgtagtaggtttctttgtagctacctgttctgttgggatcctggttttcttggtgattactgagtgctgtggcctatcacagaaaaaaaagtcatattttttttcaatggcataattttatgaatttttgggacactacactatagacttgttaagctatgtttcagttttgcaattatagatacactctgtagacaagtcccagtaggtacagagggcagacgtgggtcctcagactgataaaatgtagccaggagaccaatctgctctagtctggagtggctgcttactgggaacatttggtttcagtatctgcacagcagtttgtctgtccatgctttggtgccagttatttcatgagtctttttatttttattttttggttatatagatcagaggtttccgtgttgcccaggctggcctcgaacgtctagcctcgccttcttatgcgccaggacaacaggcctgagccactgcagctccctatttcatgagtcttttagctttggtcccaaaattgaattctgctcagttctgagctggggttctcactgaaatgtgactgtcccatgttcagggtcacttttttttttctgagagtagagcatgacataatgcatagtaagttgcatgtctatatatacattattatgtgcctgtattattacttgctgctgaagtagggagttggcaaaatgggttgctaagttctaggtaaagggaacgctttaaagattacaaaactccttttttggtaatattaaaaaattattggccaggcgtggtggctcatacctgtaatcccagcactttgggaggctgagactggcagatcacctgaagtcaggagttcgagaccagcctgaccaacatggtgaaaccctgcctctactaaaaaatacaaaaattacctgggcatggtggggtgcatctgtaatcccagctacttgggagggtgaggcacgagaatcactggaacctgggaggcggcggttgtggtgagccaggattgcatcactgcactccagtctgggtgacagaatgagactctgtctcaaaaaaaaaaaaaatattgtaaaaaataaataacataaaaattaccattttaaccatttttaagtgtacagttctgtagcattatgtacattcacactgccatgccattatcaccaccatccatccccagaacttttgcatcatcccaaactaaagctctgtacccattaaacatgaactcctcattccctgcttcccctagtccctggcaactgccattctactttgtctctgaatttggatactctagacacctcatgtaagttgaatcatacagtatgtgcccttttgtgactggcttgtttcacttagcataatgtcctcaaggtgtatccatattgtagcatctgtcagaattttcttcctttttaaaggaaggaatatttaataatattccattgtatgtgtgtgccccacatttatctattcatctgtttataaaacattttctttggatgataagaatgttttcactggaaatgtgctttgtgaagcataagggagtggcagaagcagatcagaagttgggagccttgctcttgggtcctgatgctgaggctaatcagcagtgtagctttaaacaaaccacttgctctttctgagcaaaaatattccatttgtaaataaatggacagagttagagttattaggcattccctaaagatcttttccccttttaaaatctttctttcatttaattctaagtttctggctttatgcactttgtgtttcatgcacaccatagcttagtcatcagttattttcataaaatgttctcgcttcctctttaacctagctgtttaatttatttacattttttcccccatttatatggtggtcccttgtaaactgagggtagttttattctctcttcatttttctgtataattgcccttttttttttttttttttactagagctgtgtctgcccaaatgcattgtttcctgtattgtacaattatcagttatttagatttgccactctgttagaaacaaaatgcttgttcctcagtgccacaatgaaatagcacttgaacataaatttaattttctcagcaaggcaatttttacttctactgaagcgtgcgacttgtggatggagtaatggtgagagcacacctggacaggggaggggcaggggttcttattcctgttgcaggtagcccctactgctgtgtcgttcccctatttcctggggttcaactgcatagtctgagctaattccaactggctgttttaaagagagcagactacgatcctgagtggcggggtgagtagtttggtgggaagggtggttacagaacaggtgactcaggatgatttgggtcagagcaagtgaccaggggtgactcaagatggagcaggtaaccagggtgacttaggttaaagcaggtgaccaggggaacagatctgaactactgattagaactggcgggaaagttgtttactgaaactagaggcaagggggccaaagagaaccaggaagttaaactttaaaatggaaaatcaaagaataagagagctgaacatattgacatactgattctttgaagagaaacttggaattcgctataacaactccttggtgaaattcagaataaagactggcaagctatttttcccccagtattttatttcagagctaagctaaggaactacagaaaaataattgtaaaattgatgtgttaaaaagctttgaaagacagaactttctcaaatgggtaatatgaagggagattattaggaagaatatatgttatgctgtatgtgaatcttgatctttctgtggaatggttttatcctggtcttttggaaagggtacaggaagtgaccccacccgattggtggtctgcttgaattacattcattaatgtaggctccatgcattgagttgcggattgtgaacatttggaaaccagtattttttttcctctctgaattgccttctgtttagacagggcttaataaaaccagcagctaaaccaaggaaaatactcccatttttagaatggaggagccatacgacttaatgaattaaagcatgtaatgcaggccaagtaattcaaacccacccatggcaggaagagttccacaacctggttccagctcctctaagtgacttctaagtccccttgttcaaccctatcttttgggtctcagatttggcttcccccccgctttttttttttttttttttgagaccgaatctggctctgttgcccaggctggagtgcagcggcatgatcgtggctcactgcaacctctgcctcccagactcaagccatcctcccacctcagcctcctgagtagctgggactacaggtgtgcaccaccgcatccagctaatttttgtatttttgtagagatgggggtctcactttgttccccaggctgattttcaactcctggactcaagtgatctgcctgcctcggcctcccaaagtgctgggattacaggtgtcagccaccgtgctggccagcttccccaaatgtaagggttaggtttgttacagtgcctgtgagctgctgtcaggcaaagcctgcttttcccctgcttctttgaggtggataaatgttttgttcagtagtggagagggcactagctattgtagtcctctctgcagggccatgtccctgggggcatttggagaccaagtagacatgcccaggagcagccaactgctgggccccacggcctttgtgtttgtgcaggaaaagttcttcctgggaacacaggagactggaggtcacccccaccccttcccaggtccctccaccctgcacttcctggacttgtcaatggagggagggtgtgtgacccaggcttgttggggatgttgtttgtggggcagccccttgcctctctctgcgcctacctcacttcccatagctttgtgatataggctgtcctgccatctcaggtctagacaagcaaaatcaagttgtatttttaagttttttagatacgagtatggtagaataaccctatgtacatactctttggggaagaaaggctcgtacatgaacatttagaagatggattagggagaaacctaaacctgccctcttgacatatatatgaaggaatcaggttaaaataatagtagtgcccttaactcacagaaatagcattcaaaggagtgaaaacaatggaaagcatgcttgtggcctaggctgtggaaggtgtggaatgtgaaactgtctaatccaataacacccactaactttcctagactagagttgccaggccccacaactgcccccaaagtgtgtgtggcagggatcggataggtggtagaaggattagaactggattctactctaccttgaagggattaatgacagtcacagaagtttctgggaggctgggacatggcctgctctctgatctagatttgattataggagccagtcaggggcccccattgtttgattccttgccctagagcatcctgagaaggcagcttagactttgggtttcagaaacatgaaagtcagtgatggtaccgacttccatgtgtgtcccaggccctcagacctctggtggggcagtcccagcttgggaaggcggaggctggcctgaaaacagtgcttcatgctgcctgaaacaggggtgcctttaagggcttccccttgctggccttcagcctgggccagaagtggggtattcttagctcccagtgaggctgtcaccacctcggaaacccgaggtcctgctcccaacatagaccacaccaagtacagtttggggaggaggcactgaagttctcaaatctcccattttttggagaccttgtcataaagagaccttgagactgctttaaaagatgaaagagtcccacacaattcctattcatgtcagaaatttatgaggctgaactggtggtgtgtcttgcactatagtttcattcagctcatggggtctgaatttcctttttatgtttcattttttcaagagttacaattgggtgtttagtctctagagtcagtgggatggatatgctttttgccagacttttcacatttaatatgtaactgtttgtttaggttgagacattttgatcctttttgccgttgtgctatttgatgcaggatttattattaatttgtattatttcttgctattatgaaatttgatgcaggatttgttcattgctttgcactagtctcactcgcagccctggtgcaagattctgcagggaacaaacaagttccttttgtcactggactgctttctggcaggtctagcagttgtccttataataaccggacaaggcgggagaactgattttatcctgcatggaagaggagtaactcaattgacattctttgtcatttagcagtcagttaatggccacttactggaaaatgttactaggctctgtggtgagtgttgttagaaactgaattactctgtatatttccccagggccctttttccccttgcctggagtagacactcagaacggcaggaagtggcactgtgttgcaatcatagtttcattgttcctttgtattttgcatttcaaaaataatgatattgcttttaatggtaccagagacttgccaggagcccagggggtggtacagggtcactggggtagccccagcctgagggtgcccaggagtggtctgtggaaggtctccagcaatgtcagcctcacatgtgattaatttgagtcactgtgaacatctctccacctccttgactttacccatgaaatgatttccaacatccagtcactttcctgggtatttttagtcactcactttgcagaacctttgatggtctacagaagtgaaggaatgggtttctaagtccaagctgaggtagaatcctggcattgccatttactagagctgtgtgaccttagacaattcacttaacctctctgagcctcaatattcttacctgttaacaagtggggatatgggttcccagggatgagggaccggtgaaatgatatgcctggagacagctaacacaatgcctggaaaatgctaagcacttgtcaaaagtttcctacccctcttccttgccagcttaaaattataactgcagcagcagaacgcccccatttgttgggtagcagtgttgtgagctgagggggtggaggagaaaagcttatctgttagttttctttccacctggagagatcttccccctttccttccacacagcaatagtgtaaccgaatgccagagcagtcccttcttcttgcggtcctctgtggacggcttgtttctttttggatggtaggaggcatccaaagcctcttttagggaagattggtcttcttccaggagactccacactgggatggccacatcattccatttctgggtcacgttttcagctccttgggcctgcaagggatctctgtcccttctggagtaaatgaaataattgtcactagcctcccacttaatgactgtggctattgctcctctttctcgcacacgaggggaggaagtctgctggggcactgggcagcctcccttcccgatggcaccagagcctggatttttgaggtctggtggattcctgagactttccttcctcaccccagtctggatggcatccctgggcccagcctgccgcggcactcgtgggaagtggctggctggctctgctggctccacgcacagctggcatacactgacatggctgtggtttgcttctctctccttccttccccctagagtataagaagaagtacggagaggaacacggctcctgccaggctgggatagcgggcttcttcaccgaggtgggtgtctgctgtctgggcatttctgttctcttgtgggtgttcatttccttgcttatatgattttggcaacccttagaggtgggacttctggagtcccagatacttgagcctcgagggagcagattctggtcctcacaccagaggaggctatttctacctgcccggagggcaccagctggccagagaccactgggcagaggaggtggggtggctcatctcgaggctacccctatttgatgatttctgtaggagtctgcttgactctgagacctggggaaggagtcgatttggggatgtgtgagtgagatgacattcagtcaggttgtgccccatcattggcggctgtgcagatacatgaagcgtgtgagcatcccctcctagcagccttctctccttagtggagagacttgtttgtttttcgagacagagtcttgctatgtcactcaagctggagtgcagtggcatgatctcggctcactgcaatctccgcctcctgggttcaagcaattctcttgccttagcctcccggttataggcgcccaccgccacacctgtatttttagtagagacggggtttcgccatgttggccaggctggtcttgaacacctgacctcaggtgatctgccagtctcggcttcccaaagtgctaggattacaggctgagccaccacacccggcctgagagacttggttttacacacaactctaaccattccttttcccagattcagaaggacaggacacctgcatgcttatgtgcccgtgtggtagtagcatgacttttggctggtagtacatttttagggactgttttcttgtgtcattcttacttactgtaagtttgcccttcgtatcagttcctcctctctcaaacactttcatgactgcctgctggcactgtctatccatgtggttgctcaggccaaaaaaagagtactttttacttctaattcatctgcagtcctgttgttttagcctccaaaacacatcccaaatatgacagcttttattactattacaatcgcctccattatcaccatcatgcttctagaaaggccaccaccatcacctggaggtacactggccctgattggtcttcttatgtctattatgcttttttaaaaattgtggtaaaagatgcataatataaaagtcaccactttaaagtgtgattcagtggcattagtgcattcacagtgttgtgcacccatcaccatgggctaggttagaacactttatcacccagcctgcatccattctgacctgtgaagtgtgctttctgcatactagccccagggtccttcaaatgaaacccatccttctgactccgaggcttcccagtccatggaggattacaatgtaaagctcctcatcctggcccctggacttggctccctgaggccacctctctcttttcctcactccaggagagcagagagctggggaagggcatgggacatggggggtggagggaggatgaagggtgctctctggcttccaaagtgagggcccctcctgagtcaggagcaagactgcctaccttcctttcagaaactgctgtttaaatccaaagagaacatagacagttggcaatatagtgtctgatccagaaagcaagaaagaaaaggcagaaagtctgaagttttattttcactctcaaaccaataaataggagatgctaccctccaacccccattccgcaccctcagtgattcttacctcgctggagaatcatttttatgacagtcgacagagttctatgccctgggaatggcaccgccaatcatcctaaccattgaggccgaatttaaagattgttctctcacctcactctcctacttctaagccaccttgcaagtcccaccacctcctatgccctcaaaacctctaacaatgacatccattgccctccacatcctctgccaccctacaaatctaagccatagttgtcttgcttccaacccactgcggaatccttctgccgtcttgcttccacccttgcctctggacagactggtccccatgtagcagccagaaccaccttttacaaacaggaaaaatatcatggtgctcccttgctcaggactttctggtgtcttctcatcctacttagaatgaaatgcaaatgccttcccttggcctcccagccttcatacctttccaggctcatctcctacctcacccactacatggtattttcagctgctgctaggacatgccggactcccactggtggcattgcactggagatccattcacgtggctccttgtacacaagtgtttctttagaagagacactaatggaggaactgctgggtccaaaggcactcagatttgaattttgatacatgttggcaaattgcacttcagacatgtttaccagttgacactcccctgcattgcttctgtctctatcttctctcactcagactttaaatttttgttatgaaaaaacatctcgttttaatgtcactttccctgattattaatgtcatttaatatccttttaaaatattgaccatttgtatttgttttcctggaagttgcctgtttatgttctcagtacattattctgttttgttgttgttgttgttttcctggtttttaggaacttgttacatattttcaacagtaatctcttacctgatctatgtgttgcaaattttttcatcagcctttttcttatgttttaagtttgcctatgatgtctttatcatcctggcaataaacatgcacatttggccaaatctatcagtctttttttttttttccctctagattctaaacttatctcttaagaaggttattccttatgtatactgcaagttggcatgaacagctgggcaggagagtgcccgggatctacaacacatgtctgggctgaacaaactcccatattttatacttatattttcaatatacttgtatttttaatagcactttcataggttgtttttaaaaaagatttcgatctttaatctttctggaatttgtgttgtatacattgtgtgatagaaactaactacgttatttttctaaatatatagttggttgttctgatactggtttgttaaacaacttttcctctccccattgaaatgccatcctgccgtgtggcgacttcactctcttcttccatctcagcaaacatttagattgtgtgacaactatggctgttgttcctccaacaggcctgtctagtattgtatgacttgagtcaataggcagtgggaaccactgtaagttcacaagcaggtgacacactggcagatggcagtgttgaaagaaaggctatttgagctgggtttgcccagaactttgggagtggaagggcctgaagggaggcctggtaggaggccgtgatgtggtaggaggccgtgaagcaacaggacagtgtagagggaggcttaaggaataaaaatgattgggggaggcagagaatatgaaggaaatgtcaaggggctgggtggccagggagctgtggggtagaggaaggagggtttgagccaggcttctggagaatggtggtgcctctggtgaaaaggggttgcctgagaaagaacccattgggagatataaactgccaagtctgctttcagacacagggagtgtgcgatgtttttagaggacgtttggacttagggactggagtcctgcctggggcagaaacttagatttggcccttgctcatgactctcttaggggatgagtgtgcttagtgtagggcatgggggagacacctccctttagatgggaggagaagctagattgatgggagacatcagaactcaacggagatgttgacagagagccgaggagaaagtgttcccaggagggaagtgtcattatgtttgccgcagcagctggcaagtcaggcattgggctgagtggaggcagggagtggtaggaggaaccggcggggcaggagtgtggaggggaagtccaggtagctgtgcaagctcagggtgaccagaagaacagaagacctgctgaaatccaggctttgggatttagaacctgagggaaacatggggtgtcagcatgtgctggctgtgctcatggtacagcaaagtggggacatggtgggtgtacagagtgtccggggagggtgggcagtggtgagtgggaaggcagcccctctgggcgccactctgtcctctgaccccggcctgctgtctcctggctactttggactttggcctccgcttcagttcccaggcttttggcctccttaaacaggaggtctttgaactcactgcctgccttgtttctggaagttcagctgtttgtggctgagcaggaaatgtggttgaagggtccaggccagcgcgactcccctcctctgccctcttgctgacctcgccacttgggcttgccttttctgtgagctgttgtcccctcccaagctggacatggatctgtggccttctggtcatagctatgttgccccaaaatattttggcctaaggtgcctgcttgacctacaggtcagtgaccctgagcttaacaaagccttcggagctatggataccacctgaattttagcctgacattgaggattagagagaatttcctgggaggtttatttatttttgtagatgaggctaacagaggtagtagatactgcttagcagcaagagaggatttggaccagctgggctggcgttcacgcctgctgtagaagcctagaggcacttgggtgggagtttgttcagcacggacttctgttgtagatcccgggcactcctgcccagctgctcatgccaacttgcagtacacagaggaaatatatggcttctcccaggcccacctacataccccggttcctctaggtgttctgctaataaatgcatcttgggaaaaagctgcattgcttattgatgggattccacaaatgtgatttaggtagtggtggcctttgcttagagaagctttcatttgtgtgtgtgacattgacactggctgttcctgcatggtggggagctaagtattagtcactttttcctagcacttgtgaacagcaccagaaaggtcacaagcatcatccatagggaacagaaaaaacaactatgagggatttccaggaaggcactgtccctcccttcagcctcagccctgagggtcgcaggcttggccctgttttatgtagtatgggctgaagggagaggggtgtgagcactgggggcggagtggcgtggtgcggtaaaaacaagagctgttggttttaaaggtttttgaagacaggaattactttatcttaccctgtttataatgtttgagaggggatgcagtggtatggtaggcatacatttttcaacttttatcctgggttagtctaaatcatcagaaagcaacatatcccatccctgcccccaatgttccgaagagcctttgcaggcctgtgctgatgctcaaagctttggcctgtgcaaagctgcaggtggagaaagctctgcactgaggatacatctggggctgaggaggttgctcattaggttcttcagtgccctttgtattatatttggacactgattacaaattcctttccaagctcaaggccaggagaaaaagtctctcctctgatgaacttatttctgttttttgtactctttctagaactagcgtggtctcttatgcaggacagatgagtgtaaaaagaatgagtggatggatgctctgctgtgtttcccagtggagcgtcctgactgcagaaagctatctatttttataaaacagtgagatacccctgggaacatctggcttatcatcaacagcttccttcaaggggggtaggatctcaaaactttaaaatgaagtgctcatcaacagtcatttcttgtctacaccctcctgaattatcaaaaagcaagcctttccggcgagaatctagtggcttttcttccatctgtgttcctgccctatcctttgttaaggctcttccccaaattaaccataacacgtattgtttaaggcattgccctcttgcctgcaggctctatcctcctctctctattttttttctttaggtacttctggcttttgcagacacttgctccctgagaattcagtggtgactttatgaattgtcctcagaaattctaaatctctgcggcaggatctagcctccagggacttgtcagagccagcagcttctgccagtgcgtgggctcgtctctgcagagggagatcaacctgaaaagatctgtttctgaaatatatgtgggtgaccaagggacggggtgcaggggaattctgaaggctcaggggaaggtcaggtgggtttcagcagtgagagacttgacctgcacagcatctgttatccccatgagccttcatgaccagtatctttggagttttgtctatagctgaaagatttcctctagaaattttgttgattttaacctgtttgcatagaatttttttctgaaatactttgcacattaccatgctgtcttaccccaagaatgatctacgaagggactttatttatctttatatctagtgtgaactctgagatataatagtaggtgcccaataaacattgttgagtgaaaaattactgatttcattagaaaaataattctgattatttcttattgcagtgtcgaaactttagaaaataaaggtaatccaaaagtagggattccctgttggggaaaggaaggactgaaagccagggacctctgatggatacaagcacagcctgcctcctagctccagcacagcctctgcacaatgggagcttcgtcttaatgcttgtaaaatgtcatctcattagcatgttttgtgtttttatgtgatgacttccttgttagtgtttaatcactgttctggaattttaaaaagtcaagattattaattaaaaaaattaatacatataataaaatacactattttaaatgcagagttcgatgagttttgacaaatgtgtataccatgtcgtctctgtctgaatgaagatgagaacatttccatcactttgggaagttcctcatgcccctttgcagacagtgttcctcctctttactccaggtacccactgatctgacttccatcagtgtggattggttttgctgattctagaacttcctatgaatggagtcatttttttctcatcaacatttggtctaggattcacccatatttcaactgagttttgaatactgcgaaagggttacacaagcagaggaagtgtgagggcattgcacagatggagataaaaagatcagagggagttccgaagaccagaattagtttagagtgtcctaggcatgcagtctgagggggcagtggcaggagaagagcctaatgtggttgaaatagtggacagtgttgaattttacctgagccctgtactcttggaaaacagtgtggtctagaattttgaaaaatgcaaaggaaataaactttgggagtgagagaacaggggatgttgattgatttccattatcgtatcacccaggggaaaaccccagcagatatctgtgctgacttccttgggtgaccaaatcatttctgggaacttagggttgttgtcagcattggtgatggttctggggcacaaacatgctctcagccctgttgaccatttccccctgatctaaatgctgaagacagctgtgcctcttatgttcttgagtctttttttttttttttttttttggcagagtcttgctatgtcacccaggctggaatgcagtggcatggtcttggctcactgagacctctgcgtcccgggttcaagcgattttcctgcctcagcctcctgagtagctgggattacaggcatgtgccactacacctggctaatttttgtatttttagtagagacagggtttcaccatgttggccaggctggtttcaaactcctgacctcaagtgatccacccgcctcggcctcccaaagtgctgggattacaggcatgagccactgcgcccggccttgagtctgtttttaacagtgataccgtctattgctgccttgtggtcccctcttccagtttgtgtttttccttagttgaccttgctggtctcttggttttgttcttccatgtttgcagtggactgtaatgatcggaaaaccatgttctagaacgtccctgagagggtcttgagtgtggtctggaggggattccctggagtactagtgcacagtttcctctcgctacgcatcaggtcgggggagttgaatggtgagcctggagtccaggcagggtgcggtattgcttactgcttttcatgagtggtgttccccagaatctgtggttgaggtcaatgtcagctgtttgtcatttccttgttagagcctgatgtaaagttgaggaaacgtgtgtggtctcatcgtggatagaataggggcctggcctgtcgtgaattctgtcaccttgctcagtctcttcacatctttagtcctgataatcccgtctgtataatagattccataatgctgatgaatctggtgaaatctgtttttgttgcttagctggggaaaaaaaagttcttggtgtgaggaatttctcctttgttgtgactgtggttctcattgcattcccctcctcccctcctcacttccttctctgcttaccgttggatttctttttggtaggagctggtggtgatgggtgctccagggtcattttattgggctggaaccatcaaagtgctgaaccttacggacaacacctatttaaaactgaacgacgaagtgatcatgaacaggcggtacacctacctgggtgagtactcagggagagaacaggtaagaaaggggaaatgggagtgattcccaccagattcacaaattattgcttcattgttggaaagaggagttagttggctttgacgcctgttgttctaatgacttacatctttagccagggcatcttcacatctagctccacaaacacaaggtagagaggaaaaccaaggagggaactgaattaaaactgtatgctttaattaaaaagctgacagttgaacctccagggaaataaacattttattttctcattttatcaattgttgaagttcagatggtcaggtagaaatgagtgtgatggagtcttgattttccacgggcgtccctttggatggagtccttgctttctgatcacaaaactggtagcaaatagaaagataagaactagaaattatcatgacagatggcaacctaatgctgaaggttaattaaaggctcagaaaaatttctcttgctttcttaactcttttaatcttctggaaagaagatagacacaatttaatgtagctatcaggcagaatgacactgggacaaggtccatgccaatttaagaacagacataggctgtctttgcttgtgtagatgacaattacaagactcttttctttaatttatgccctaaatgctataattctggattgaaagcgaagctaaatttaggaaggcctaatgatgacacacaatgctctttcgcactcatgatacataacttacagggaaaggccctgactccctttttgcatagcgtcactgggaacttcttgttaaatggggttagggagtcgttgacttgccttttcccttctaactacaagttttttgcctggtagcatagacccaacaatccttctactctggggtgtttgctcctgtaggcacccagctgcctagtgctgttgcttattaagcatttaccctatgccaggctgtatgtattatttctttttaatttctgaaacaaccttatgaagtagctattattatctacattttatagataaactgaggagcaaagaaattatacatcttgccaaggtcacatggctcctaagtagcaaaattagggtatgagcttgtggtttctgagtgcagagtctaaatgctgagctgccttccctgtgggtgcgtctgagagagcacctatcactggtactgtacttctcactgggctgggagcaccttgaagacaaaatgtgggattgtgtctcacatttggtatagtgcctggtgtatagtagtaactcaacacatatttattgaatcagggaatgaagagagagcagaagaaagcccagtttggatgatgggtttggggtctagaacagctcctttgaagcttcgagcctgtggtttctctttgtatacacattagaggctcttatcagctgcagggattatcaaggatccgttcaggctttgatctcactcagaatactcttaggtactatcagtcgccagtctgagagaaatcagccacatggtgaggaagaattgatcatgatatgatgtcatcgcgaaactcaaacaacttacaatcactttagggttagagggtgatgacaagtttggggattatatggcagcctgtacaggatttatgctggccagaggagagctttcagcctgctagcaaggctctcagaaagcaggagacgttgaggctaagcctaggcaatcttttcctttgtttctaggttccttttgcatccatattttttcactgaccaccctcccacccatccacccatccatctacccaaccatgcatctacccacccacccactgacagcttcttttgccttcttgtaggagggagtgtggttaacagcaggggctttagaggcacagattagatttgagtcttgctgtgtgatctttggcatgttgtttaacaggtttttctaattctgtatctgtaaaatggaagaaacagtcatgccttcttcataaagtttttagactgaaagagatacctaaagacatgcataaaaatgttggtagcaaccttgttcatattaaccccagcctggaaacaacctaaatgcccagcaacagaataaacatatgacatatttatataacggatattactcaataataaaaagaaactactactgtactcaacgatgtggatgaatgtcacagatgttatgttgagtgaagttcaagaaaaggcaaacctaatatatggtgatagaaatcagaatagtggctacctgtgtggggcatattgactgggaaagggcatgagggaaccctctggggttatggttctgtggttatagtcacttccttgatctgggtggtggttgcatggctacgctcatgtgtgcattcattgagttttacacgtcagatatatgaccttaccgtatgaaaactatgccttgaaaagaagaaaacagatatatagtatttcatacagtacttgtccgaaagaagacactcagaaagccctctttcctgccctgatatccttgtgaacatgactttttgtgagatgagagccatttcagcatgagaaggttgacagctgccatttttttcctggtagtttatgttccaagagtagggagcatgcttgagaaacattttcctctgatggatgtttttttttcccttcccttctttttcaaccgtgtgcttggtttccgcccatcctgttcaggctacgcagtgaccgctggccacttctctcacccgtccaccattgatgtggtaggaggtgccccacaggacaaaggcatcggcaaggtgaggagaaacatctgtggaatagctggggtcagacagaagaggggagcatgctgtccctggtgcagaggtttgccagctgacattgacctgaacattctactgggtggctggtggggaggtgatgaggaaccccctgactgccccactccattggaaagtttcccttgaaagctcaattagagtgtgagtatactcacactctcgatttcctgcacactctcatctgaggtttttcacagctgaccatgtgtgtgtgtgtaatttataagactgagccctggccttatggtgtccttcaaaagaatggcatttagtgctgtccaacttcaaatcccaaacccttcccaagtttggctttgatttaatggagctaggtccagtctcagatatctttgaggctttattcatgccccaaattattctcgtatttatttccccagtgtttgagaaggaacattgggttcccaagactggttcagcccaaaggctggactggaaatatgtgggtctggctttccctaaactatagtatctgccaaaaaacccaccccctggatctagggctgcctgaattcctttgggaaacatgacctctgaggggcctgaattgtgaactacgcttgttggttctttatcatgaaggtacaggaaatccagattgagtaggtacagatggatcaggaacccacatttttaagaagctccataggttgtctgatgggaaagactgagtgaacagaggaatgaactttggatctggacctttaggggtagacctgtgatagagtctggtcatatctcccagggcttggagaagtggaatctggattctggattagcccagatgagctgagaccactggtaattggagccttcagccaggaggtcaggatgatcagggagctgacgaactttccagttgactaggcttgactaaggataatttctgtggatcctcctgggcagaggttaggagctgctgctcacgtttctggagcatgtgcctccctcctccctaacactgatgctgtggaaagaggttcttcaaaactgaaaccagataaaccagggccctgagctggcagggaggagggatcaagcaggtgaccttcgatcacctcaagaaagaggtggttctttctgagttgcatgaatttatctaagtagagaaagaagcactgagagctgttcacattgatgttgtcttcttggggaggggctgcgggctaccgggcatctctgtagaaatggtaaaaatgcctacgtctagttcacagtgatgcgggtgcctctatgctaatgatagcagctttcttttctccctaattgcagaaaacatgatccagttttatagtttttccttcagatgattgtgatgaacttcatagtccctgtcaagtcttaagatgacccctccgcaaacccctctcactggctatctggggggtgcaaggtataaagttaaaaagttgagaatggtacttataattgatagagccagacagcgggactcctggacccagtttataaagtacataaaaatgcttctttcaattagaccacctgagaggcatggggaaactggtcatagtgacaaagttgctgacaattccacattcccagggattggggctagtacagacttgattcccaaggacccctggccttcaggattttgctggatattctagtgtcagggcacaaaagcactcacactaagatggcagttccttatctcatgggaaggttatttacactggttctcatgagacactcttcccacgagatgtaatccaaaaaaaagaacttccatagtcaagtacatttaggaagttaaatgtcagtgatcgtctttgcagtggcgatgcatagttcacatgaacatgctaaaggctctaaaaagttccacagtcaaagaatttacttaatgtttaactccacatttcccaaatgaaactcatttttacccaggcagatcacatgactctaatattacgtgaaatcactttgggaaactgctttgtctacagtactcatctccacctatccctttatcttctgttgtaatgcctggtaaagtcttactgggaataaagtccaatccataccaccaactaattttaaaaacaggaataaaggaaatatttcaagaaacaaaatactagctttttctcagagttgaattgtttacttgtaatttggaagcttcttgggtcttattgtgtgtggcttttataagtattgtggttcaggagcagtggaggtgatgtctgcctcaggattgaaggacccttttttttgcagggctggtaaaatgacagctgacttcttcatgatcatcagctagcataagcacatctgctgtgcacctggctcttaagcttttaaataggactcccaggagagtgctgataaatatctttgatcattgatttcatcctaactagattttttttttttcattccataggtttatattttcagagctgaccgaagatcaggcaccttaattaagatctttcaagcatcaggtaaaaaggtgaggttcttggtataagtgactattttttatttgagagatgtgatcatgtgggagtcagtactttttagaaaattggtttgaaggccctacctgtgccctgtgtttatatggcagtgctgtctgcttgttggtgtctttaccttctcagcggtatgtgtaatctgtacattcatgggattcatactcgctttaggagacattctgtagcaagatgagttatatggggccaagttacagcacagagttttaagagattgtccgtagttcagactgtcatcaaagtgactgcatgccctgtctctctgcctccatcctttctcaacgaatctccacctccagagagagcagatctttctgagtacaggtagcaataaatgcttctcactgagcctgtttcaccagcccaacattacccccttccctaatcctcagccctcaactgtcattgccaaggtgactgttgccacacaaagaaaatccaaacacaggttgcctgattcctcttagaaccttgaagcagaaatagctcagggtgctgccctaaagttagcctgggtgagattactctgcctgggtcctccccaccctgtccctaatcctctctctgctttctgaaagtttccattatactgccctgttgtctaaaattaagccaattagagagtcctgctattaataagcaacagttttcatgagcttatcagtcatgcacttcttgtgtggcttagatcagcaggactgtttggctgagcttggctactctaagggacacaagtttaggctgggagctgtgggggtaatttggaggtcttggtggaggccttagtgggatctgggaagaagcataggatgtctgggacatgggaggaggccatgtgcctcctcaattctgttcctgccgagttagaactgctgtacgccagcctaggatccttccatgttgttctcccattcaagtagacctttttgcaattttaactatccgaataggtacacttagtgtataattgtcattatcttttgaataaaaaatgcatcaccaaacttggttttgcatttttcctcagaatggctctgccttcccgagaactctgctggcttgtgttattttaacatttccaaaaccccaaagcaacagcactggaaaatgactgtgagccattctgcaaaagggttttccaagcacccttaaagttagaaaagaaataactctgtgctacttgtgatttacaaaagagagtttcaaagagcaagtagggtatgagtggaattaaggctaacattttagatcttctgcagaagataacaaatgggtgaatgtatctagcatggaaacaatctccctcttcccttcaaatgtacctgggtttgaaagcctaaaggtaaaggattcctttttttttttttttttgagacagagtctcactatggcatgatcttggttcactgtaacatctgcctcctggactcaagccatcctcctacctcagcctcccaggtagctcggaccacagacatgtgccaccatgcccagcaaatttttgtatttttttttgtagagatggggtttcaccatgttgcccaggctggtctcagactcctgggctcaagggatccacccaccttggcctcccagagtgcgggatgataggcatgagccaccgcacctggccaaggattatttaaaatgaattgtggagtttctgagtatctttatgttcagttgtagctgtgcccccccaaactgcttttccttccctgccctactccttactgtctgtgccctggggaggtccggttaattcctattgccttcgagtaattaacaatctgtaattgtgccctctctcctccttgaaaacctcttggtttggatgagaacctatgctcaagttgatcaggtttttgggggtagatctgagagtgggtggtgcaaggaggatgagattaacctttgagaacccacttgtctaaacttcctgaagacttctgccattgagttccaggacaggttcaggcctgaatgtctgcttggatgtccttatcataccaagatacatcaggttccctgagaagggacagaaaggcccaggtattcaacttcttggcttcgtagccatttgactttttcttttctttagggctcttctggccctaacctttgcaccattccataggcaccccttctttctgccactcactcacagtcctcttgccttcacttccttctactagtgtctccaactagatttaccctgtcatcatcgttctgcttttgaaataggccatgacctttctttatacaacttattctacttcttgccagaagaaatgagacattcatgtctttctgacttctccattacctcctacaaaaggacatgaccccaggctttcaaaggatgcctttagatttatccctatgtccagagtcacatagacaggagggttctaactcagcaaaccaccggttcacttctgcttccgtttggctagaatttggtcagatagttctgtatcctggcttcctataagaagaaacaaagcaaaaagattaaaaaaacaaaaccaaacaaaaaaaacctggttcttgtctttattggttgactttctccaaatagtacacttaagaaatcaccaacatgtgtgcagttcagatgttaatacagacacacatctccacatttccaggctgatggggagctctgatcatcggacacacaccccaaagcatgtcattgccatattgaagttttattgaattaacggagtatgtgaagcatttgtatttcaaaactgagataggaaacttcacatatagagatttctaatttaacattgatgaagatgccaagttaaatagtcctttggaatgaaacaaatagttcccctggggctcagccagtgagcgcagccagcagcttggctctttgggtctttgcctgtgtcttactgatttcttttaccaaagctcagatggggagattggcaaggccactgaaatagtgactggcaactcggtttctttcctcctcaccctctgtgatttcaaccctttcctgctccgttctcctttgagaatgggtaatcagaggggaggaagatggccttggcatatcactggggaaggatttctgagcggccactacaaagccctcctgtgaccctgttagctgcaggaaatagattggagtgtcctctacctctctccctcaaactccctgggtcagctgccaacaaactccaacagtaaaagaaaaggcttgttcatgtccatcaacccaggggccttttattagaaaacatttattttaaaagaataatgctttttctctttcttttcttttcttttcttttcttttcttttcttttcttttcttttcttttcttttcttttctttctttctttctttctttctttctttctttctttctttctttctttccttccttccttccttccttccttccttccttccttccttccttctttcttttcttttcttttcttttcttttcttttcttttcttttcttttcttttcttttcttttcttttcttttcttttcttttcttttctttctttctttcttctttcttttctttcttgacagagtcttgctctgttgcccaggctagagtgcagtggcatgatcttggctcactgcaacctccacctcccaggttcaagcgattctcctgcctcagcctcccttgtagctgggattacaggtgcctgccaccacgcctggctaatttttgtatttttagtagagatggggtttcaccatgttggccaggctggtctcgaactcctggccttgtgatccacccgcctcccaaagtgctgggagtacaggcgtgagtcaccatgcccggccttcttcttttatttttttttaaagtagaggttgcaaactgacagcctttggaaagaatacagcctacaaatacttttgtttggcttgcacagtatttgtttattgtttttacacacgaagaagttgcgagcatttaaaacactggcactttaaataaagttttaaatttttggcttcttttggaaaatggaaaggttgctcctctctgggtcagcattcctcttggtggcagttagctgcagctgggttgaagctgctcctttagccaggcttgtgggctccagtttgccacagtctccaccactccctattgttatgtagacaaggaagacaagtgtcacttgccacattaattttttttcttatgcctgttatatcacctgcctggatcctgttggtatttgggtttgagacccctaattaagctataattaaaagtcaatattatcttgctctgttccctcatcagttaaacagtcttaaaagttgtacctttttctgtcacttcagctcatgccttcctaaccaatctttcacctgtgcataggaccaggagagaataacctatttccccatgtaacatttattttcatgcctttcttgtgttgtgagatttcatattcctacttgcttggccttgtcaaatgtctgatataaggagcatttttattatggttgtaacataactttgtgtcctcagcttgcatttttaaaaacagcacctcattctgtgggcatcaatctatttatcttccccttgataggactccaggaatgggggactttgggccagttagctttgtctcacattgactggggccctgccttgctgctggaagttgggtatttcactctttgctaggcattctggtttagggggcagcatagccatccagcctctgagggatgtttctttttttttatgtttttattttttagtatacattaagttttagggtacatgtgcacaacgtgcaggtttgttacatatgtatacatgtgccatattgatgtgctgtacccattaactcgtcatttaacattaggtatatctcctaatgttatccctcccccctcccccaaccccacagcaggccctggtgtgtgatgttccccttcctgtgtccatgtgttctcattgttcaattcctctgagggatgtttctaaagccaatggggtggaggaaagcgagggcatccttgtgtgagagcagacactgaatgctttgttgcaactcaacttggttgcagatgggctcttacttcggctcctccttgtgcgcagttgacctgaatggggacggcctctctgacctgctggtgggggcccccatgttttctgagatcagggatgagggacaggtcactgtctacatcaacagaggaaatgtgagtacaatactgggcaatgtgcggatgggtgtgggggagggacatttgtccagccagcagtggccgagcacccctctgggccggcactgggggcaatgttacccagaggagatgaaaatatgtgatatctgtcttgaataagctcaatggcccattaatggaaagttatatacaatgttacaactgcagacacccaggggccaaggaagaatcttaataattgtcttttgagtgcttactatgtaccagggactcttcttcctgctttctgcgagagatttctatgcaatatacacatggtatcaagggtgcccatttttcaggtggaaaaactgaggcccagagaggttaggtaatgtgtcccaaaccacacagctaagaagtggggctgggatttgaacctaggcaagctggctttagagctggcatgctttgtctcaaggttatgccacctctctgggagcatatgcacattttcccagggaagcagaggaggacacaatggctggggaatcttgaagaaggagtaggagttagcagacaggcagggtgggctggagcagagctcccagtgcagagctgggcaagtgggttggggtgtgaggtggcatcaccactcatttcagcatgggggggcaggggactgcatgggaaccataatctttttgttcgtttgtttgttttgaggcaaagtatcactccatcacccaggctggagtgcagtgacgcagtcttggctcactgcaacctctgcctcctgggttcaaactcttctcctgcctcagcctccccagtaactgggattacaggcacttgccaccacacccggctaattttttgtgtgtttttagtagagatggggtttcaccatgttggccaggctggtctcaaactcctgatttcaagtgatctgccctacttggcctccctaggattacagacgtgagccaccacgcctggccaataatcttggtgtcccctattctgcagaaccatgaaagggacgtgacatggacagaaagatgcctctggccctctgtagctaatggagggtgggtgagtgggggctgggttgggggacagcagtgcatcgtggaagcaggagaccagtgagaaagcagtcttttcaggatctggaagtacaagtgttcaagtacaagtattcagcaagaacaacatggttcaatgaaaacattctggtgccgcctaccttttctctaacatgagaaaacgcttatggagataatcagtggaaaaatgggatgaaaactgcatgtacaaccagtcctcagaaatatgccaaatacatagaaaatgtgaataacagctctctggatagatgtttagttttatctttatccaaatagtgagaatataatttcatatttaaaaaaatcgaagtgtactgttaagcagtggctgagatgctaggtatcccagttgggagagggcagaggtttagctataactaagtgggcagatgccagaaaggaaggaagcagtgaaaggagagccagggattgttagagccttatgttgcgtctgaggttttcaggctcttcaggaagtcagatctaaaaccagggaggtttgggaggcccaggtgggaggatcacttgaagccaggagttcaagaccagcctggccaacatggtgaaaccctgtctctactaaaaacacacaaaaaaattagcctggtgtggtggtgcttgcctgtggtcccagctgaggctgaggtgggaggattgtttgagcccaggaggtggaggctgcagtgagccgtgatcatgccactgtactccagcctgggtgacagagtgagaccttgtcaatcagttagtcaacaagccaacaagcaaggtgcagtggtggttgcctaggaggctgaggcgagaggatcccttgagcaccggagtttgaggtggtagtgagctatgattgcaccactgcactccagcctgggctacacaatgagactctgtctctaaaaaaaataaaatatctgggagggaaggtgcttattggtacctgttgcaggaactcttggcacctgcatacccactgacattccaggaagtcagggcagggtgcagggagaaatgaaggggacattaaataaatgagtgctgtgggcattcagtggtgcctgccattgtatttgcaggagactgagacatttgtgtaggagtcaggtccaacagccagactgtgtgtctaaatcagaaggtggactcttgaagcacaagaactcccccaggcctccactgggcatgatgcacccacaccctcccctgccaaccagtgtttcttgatgttgtatggttattctaagtaccagagtattctcatttctgttgaacatcagccatttgaataaagatcggaaggcagtgtggagtagtggaaaaaattctgactttggagcaaggtggacctgagtttgaatcttggttttgccatgtcctagcctgtgtgatgtggacaaatggcttgaaattggtggcccaatttcctcatctgtaaagtgagaggcatcataagatcttccttatggagtcattgtgtgatttgaatgaggagctggctgtacagtacctggtacataggagcaatcagttgctggtgttcctctcctcttccccactacactgaaagaaagaaattaatgcatatttgtgttttggggtggaggtttcattcatccaagaaatcatctcaccttgactgttttcaaggtgtaaattgtgtttatagtgaaaaagaagacttggtcatgataaaagccagacactcgtgggatggcctgtaggatatagtgggcccagactgcctctgcactggggaatgcatacatcttctcatgtctcaggacatcagattgcattgtatcactctggtcttcatgtgtcagtgatttggggtgagagtaggtatgactttttcccccaagttagatgacttttcctgcctttgtacaccattaaccccctccctctgttggttagtattttctcaggaaattcatacctgagccatgcatgaataataggcacagtgacgtctgccatcacagccaccctctggccaagaacgactgggtgcttggattttctgaaccatgactccctctatcaagataactcatatatgcactttgcaaaacagttttataaacttgtaccaaaaggcacaggaaagaaaaaatagaaaaatgtatacccttttaaaacaacattggggaaaaagtgctatgccttaaggacgtggagagcacatgggggaaaggtgggtagggaggtttgcttgtgtgtagtgtattaggacaaggcagagagtgtagtcattggctaccatgacattctccttccctcaaaaatgcatctcaggctatgggagaccatcctgctaagcaggtaaaagggacgcattttgccagcaggagagagaagtttgggttcctgtaattctgcccaggtgtttcctgtcaatgagtgtgctctagcagggcagcattcaaactctggttttttattgatttttattgtttgttctgtttgtttttgttttgttttccattttctcctccatcctgtttcccagggagccctcgaggagcagctggctctgactggggatggtgcctacaatgcgcactttggagagagcattgccagcctggacgatctggacaatgatgggttcccaggtgagtgagtgctcctggtgcacggagcccctccaggtgcagcacgctgctctgtttcagaggggcagcctgctcgctgactgtccatctctagtggcatgctcctgggtctactgatccccttcgaaggcccatcaatgtgctgtggggagataggacacgtttagaggtgctctccctgtagacacgcagggctgagcttccagcccactggagttttgcctctgcataatcccttctcaccagctcagtgttctttgttgtttgcagtggaagcaaaccttggggctggtccatttgggacttcttatggcaagaagtttgaatagcttcatcctgccatcaactctccttgtttctgagcctttgatgctccatcatgctctaccatgttgatggggaaatgagtgaggagagaattagaaacccagacatcttctgcctgattatagcagcagctagattgacttttgagagtgtacgcgtgtgtgtgtgtgtgtgtgtgtgtgtgtcttgggaggcatggaggcatatgtacctaatgcctaggtctgtttggacagcagtgttcctcacagcctcttggcctctctctctggcttgtttgagcctcttcacctcgctgcatacacagcatacagacgtcgggaggcagagcaaccatgtcaccagggcatgtggtggtggaggtggggcaacccttgcccaggccagccatccagacgtctttgatacctcctaccactggctacagtgggcttcattttcctcccccttggcctcacttctgcagacacatgactttgttagaagcaagggaaaaaagttaggaagatctaggttttgttctaggagttgccagtttgtgagagtaatgttatttcttgtgtgtgaagtgaatgcccttctgtatatttcctttatccaggaatggatttattatcaaataataataaggaatggtcctttatccaggacctcagactttctcagttacacaatagccattgtctatggaattctccctgatggaaattatggcacgtagtttatatttgcatttcttttattggatgggtcagtggtttttcttacgagcataaggtagaaacttttttggaactaaattcttctcagtcagcttctatagttttcactgtactttttttttttttttttttttttttttttttgagatggagtctcactctgtttcccaggctggagtccagtggcacaatctcagctcactgcaacctccgcttcccgggttcaagtgattctcttgcctcagcctccagagtagctgggacaacaggtgcgtgccaccacacccagctaatttttgtatttttagtagagctggggtttcactatgttggccaggctggtcttaaactcttgacctcaggcgacctgcccgccttggcctgccaaagtgctgggattacaggcgtgagccaccacactggcctactttttttttttttttttcccgctgagggatcttgtccccaaattaatgcttgaacaatcaacaaccaataatttctggtatccagggactcagacatgacaaccagaattagggaagctgcacttgtattattaatgtggctttttaacccatagctgtttttttaccctcagatgtggccattggtgcacccaaggaggatgacttcgcaggggcggtctatatctatcatggtgatgccggtgggatagtccctcagtactcaatggtaattagtgtgagagtgatatggcaactgttcatacattcattcagcaaacatgtatggaaccttcattatgcaccatgccctggaggtacaaagaaaaacatttttcttgccttggccttcctacccttttgtgaaagatacaattaatattgcttattaaatactaaaaaaagcattcttagaatcccaagttcgctaacactcagggatgcattttgcctaaagaagataattttcaactcttactcagagttggagccatttatttaagaaaggaaaggaagctttctctttttggtgactactttgtcaaccgtctatgctaaggcaaaggaatatgttttaatatataatctagaagaaaaatggtccatggtggaggggcctgaaactgatcacagactgtcgtcccagctggcctcaaaaccaggagccagttaggactctgcgcttgcgccctatacttgggaacatggaagtggtgagttctgttttttgccgtatcagcttggtgttcaatcttgctgatggtgtcaagcccagcccatgggaaaaaaggaagtcatgctctcagcagaagcattgtcaggatatttgtggatgtctgcctgtggagtggcactggctctggtctttctcccagtgggtcagagacagaaggggacacacattgagaaatttccaatcaacaaatatttatttattgaacacttactacatgctgactacttcctactcatatgtatttgtattttaattttaagaggcagcaggtaaatgcaagtacaacttctacatgaataattgtccttggcagatagagataaactagttaagggtggagggttggttggttgtcattcgtgcctcagatcccctctctactggcctcctgctgagctcagtgcctcacctgcaggagacagggctttgggaggcgctgcgaagaggagggactgttttttgggtgcctactctgccctttctttacctttaatcctcgcagcagccatgtaagatgggtctgtttattatccaccatttatttatccacgaggcccaaggaggttatttaacttgcccaaggtcataagtggcagtatggccacagaatctttgccagtctgctgcctgaaacttgttatcgtaaccaccatcctcaactccacattgcaaaaaggaacgctcggaaactcagtaggaaaacttacgaatatggaaactattttgccatgaggcatacatagtctgaggggcatttatctatccagaccatcctcttttcattagaagtacataacaggagattaataaacttcggtgattcagcccacaaggcaggaggaagagagctttgggcacagtttgggggccacatctgagtcacaagagctgccctaggctgcggcagggatgctcttcccagggtgacaagctaaaagtcacccaaggagccccgtgctcgggcagcggtcagggtcattctccacgcatcctccgggaagcttgttttcctggacctcggaagctaatcacacagtgaggcaacctgtgagagaccccagcttcccctcctccggggccctcccagtgttttgtttggttgctgggtggaatccctgtagagaaccacagtataactcttgtggttagcgtggagcgtctttagtgggaagcagggatagcatctggaccagcctgcctttgtcagcacgcaggctggctcctttgctttgacaaagagaagtggttttgggctcttaaggaaaaaaaaagaaagaagcaactatgactgtacgttcccaagctgctaatatgcatatgataagggcagagatttaaaagaaaaaaaattctttaatggcagattcttgcaggcccaggtcctggacagagcaggcattgtgtgggtgaactagaggaaggaatcagaaacaactctgggcaatggaatcactttgctttggcccagatttgtattatttctgctgggtaaattgtgagatcagggcctacacttcttccacattgctctttaactctctctcgagtttaccacggagagtgtttattttaagatccttgtgtgcctttcccaatgtgagagccctctgggcatatggcggcccctatgatccttctcttgctggaggggacactgcatagaaacctggtcaagtggaggtttccagggctcctggttttcatttagggttattagcactgggcagacttatcttcttggcttttagcataatggcctgcagatgtctgtgggataacttaagcctgcatcaccaccccagatggaccaccccttcgctctgcccctcgtcccagccacagcataccttagaaatgtagatccaggggcaggctgctgctagagttcttggacttcagagccaagagggtctgcttcaaaacgtggcttttaagaaatgtgcagacacacgtacatgtttgtttagacagagccatgtgggatgtagggctttgcctgttagtgtgaaacatttcttcagtgtttcctacagtgttctgatttgtactttggtgcttggacatttcctgttggatggcttaacggaggatggcaagcagccttctctgatcacttctaggagggttatttgcagttatcagctgctgggggtcagggggcatctctcgtgcctccatctgtagatcctgtgaaaactcccccctccttgccttcgtgacttctctgcaggatgactcgggaaagagaaggataaggaaagaaagtcaaagtgagcccctagatagctgtaaacctggttctattgtactttgaaaacaaagcatttctcttgtcctccacagtgaggacatcaggaagtgagcctcccctgggggaccatgcagataaaggcagaaggagtaggtcagaccccagaagatgggacttttctgattcaagaagttcagtatctttgtgaggaactgcgccacacgaatgttgatgcgcagcttcagtgtgacaaaggctgtttgtacaataaatattgttgaatcagtgctgcctgtgtggatatgtgatgaacttaatgatgaataagaagtgagcacagccaggagtggtggctgtaatcccagttccttgggaggctgaggcaggaacatcgtttgaggcttggagtttgaaaccaccttgggcaacatggcgagaccccgtctgacaaaaaaagtaaaacagctgggtatattggagcatgcctatagtcccagctacttgggaggctaaggcgggaggatcacttaagcccaggagtttgaggctgcagtgtgctatgattgtgccattgcattctagcctgggcaacagagcaagactctatctcttaaaaaaaaaaaaaagagaaagttttttgtttttaaaaaacatataaagtaagcatagatgctagtgtgtcccatggtgaagttgtgaactctggttggttgagggggctgttttctagaggggagggcagggcatcttcttcagctgagtgcttttgatttcctacagtttaagaagtgttcaggaccatggagttctagatttactgggtaaaactgttcactcctgtctgtgaagctccagaatctatagatcatctggttggctggatggagaggtagtttccacatggccatcttttccagctggacatgttaattacctgtctgtctagggaaagactctgtaatgtgtgcctcttaggagcagagtgttaaatatttagtacatatttgggaagaaagatacaagctaaatatgttcttagaatttcagccagctacacctgtgtaaaaacaaacagaacctgcattaggaatggaagttaaactttatccattttgaatttcaacatgtcaaaacattatcatggtagtctaggtggatttttttcattaacacagaacttagaaaaaattttaaatgatgacgtttggccaagacaagtaataataaaggagtgtgtggccttcaactgcctgctaaagacttgctgatcacattaggattactttttttttttctttcaacaactttaagaccaagtgtcctagggaagctggaataaagcagtcacagttcttatttgtgactgtggtcttttcctgtgactccatttccctattatctgtttcagaaactgtctgggcagaagataaatccagtgctccggatgtttggtcagtccatatcgggaggcattgatatggatggaaatggctatcctggtaagctgtttttctttaaaggcacatgagataaatgaagataaatgcatgaagtagaataattttcagtctggttagcaatcatcacatccatttaggattaggacaattcacacaatagaatagggtgttttgcctggtgttcaattttaaggtgaaaataatgttgatatttattttggggttttaaactgatctactctgaatggcttagcaccaggagggtggatttgtgtagtggtttctggggcggtaattctaatgaagaaaaaaagcactggccacatctaaaatggttgaatagtgaaacctcatgttttcctttgtatttaaccacattcaaaggcttcttactcttgagagggaaaaagagcagcacccccaccgccccctgcccctactcttgaaataaaatgatggagaaagatttggagttaaaagaaaaccaagtcctcttgcgtgtggacaaagcagaccttcaccattcaatgctggctggcttggctttagagttaattattgcctgtggtggttgtggctaactggataaagatacatgatttcaaacccaaccccaagtgatatctggcctaggtcaaattgcctgggtggtggagtagtggttcttcaggtgtttcaagatggagtggggtaaggtaaggaaacaacagtaagaatttgaaaaaatccagaatggtcatggaattcaggaaacatttctctaaattttatagtcatcttgcttttgagaaatatttctttccactaaaatttaagaaaactaacgcagtcttgtatgaggacaccacattgtgtatttttgtacagataggagttttggaaattcctcaagacaacagagccaggaggaagtaagggaatagaaagaagtcagtgttgaagcttttgtcccaagaaagacccttgtgggcctttttaagtttgagaaagcagttcttgttctggaaaatttgtggccatccccaaataataccttatatgggtttagcatttaatatgtacaaaatgcttccacatgcaatgtgcatctcgcagtgaccccagcaggtaagtaggatagggtgttttccccactttataaacaaggatgctgagactcattgtgaggggctgcccagagcctgcagtgcacggggatccatgcttcccagtggttcagctacttttctgtaaatgtgaggtgagcaaggtgttcacagttcacaatggatctgaatttctgatcttgtgtttttcataagggaaattgacaaattcatcaggttcttttatttttaaacatatagcaaatttaaagactattgaagaacaaaattgatacaacacccaagtggagaaattttaggaacactataattcatggatttgccatttgtttttccctaatgagggcatcatatagatgctcagtgcatttagtgatgtacagattcagaccctcttggactcagatacttggttctgtgaagtagtagtgggaaccccagggccagggatttatatggccgggttggggtggtagggagaaaggcatagaaccactggaagagtaagtacttcctaaattaaagttatttaggaataaacattaccagttaaaccagggtcttggtttatagcttaccaagtatttccatgaatttactgacttaaatatctgatttcatatatttaataaatatttactataaatctagtgggtacttaatgaatattatataatgactaataaatattttctgatttaaatgtaatgaaatattatcagcttttgaagaaggccctggggataattatcttcattttacagacagggataccatgagatactcaggtcacatagagtgaggggtggagggtgacaattccatgttcttcagaacctagagcattttccaagagtcactgaattctaggtatgtctttctctaattcactgatgtgaaaagaagtataagccatatgtgtaatctaaaatattcctgtaattacataaaatgataaaaaaggtgaagttaattttattaatttttttagcccaatatagccaacatattatcatttcaacatataatcaatatgaaagttattagtgaggtagttaatggttttctgtactaggtctttgaaatgtggtgtgtagtttacactcacagcacctctcgactgagactagccacatttcaaggccccagtagcctgcgtagggattggctgccacgtcagagagtgtggcttccattcttacaagatcattgtatagcccagacagtggtcgtctgagggctctccggcctcaaggctgggtctccatccttgtgagcgcattcccagggcgcggttgtgtatgggcttcagcaagtttctgaacgctgtaaacttctcattttcagatgtcactgttggagccttcatgtccgacagcgtggttcttctcaggtgagaggccccactcttgctccttgaattgtgctgttcagggtgagggatggagccattcaccattcatgggctctttcctctgtcctgttccttgtaggctggaggtgcttagtaagtggaaatgctaccttattttctcattctaattattctctatcccagagtttctagctgtggccttgaatggcttgcaggtatgagatgataacatcctgggagcttctaggtaggggttggggtagcctaactcttaagcctaaggtaggggttggggtagcctaactcttaagcctaactcttaagctatttgcttttggccaagaaccttccataatgtgccataaaaatattttataatttcctgcgggtgctgggaagcactgttcattctgtctcttcatctgtacaccctgcatttgtacctccagtcagtccacaacaccctggggaccgggagcctcctgcccgttagacagcacgtcattccctgttggctgcagaggtgagggacatgagctgaggcccagagcttgctgaggcccgtgcagtctgcatctctcctgcaaaggccagtgggccgccgccaccacccgtgaaccctctccaagtatttctagctgtatgagtcagaggaggcagaattacactttggagtgggagccaattcttaggttttgttaataacctgatggcagaactttctaaaatagactaataggatctcagagctggaagggatcccagaggccatgtagttccacaccccagatccttcttattcagcggtaccttctgctggtctccactgcagggctacacagcctcctgtttgagtgagatgccccatgagtgggagcccagttacttctaagggaaccagcttgccccgggtaacattaaatcttgaattattaaagaggcagaagagccttgaggttgaatgtgaactcaggggccaggtggccgggttccagccctgactctgcccttactaggtgagtttcctgggcaagtcccctgacctttctgtttcaggattctcctctgttggccaggacagcaatacagatgctccttgacttaggatggggttatttccagataaatccattctaagtcaaaacatggtagtttcaacttaggatgggtttatccagatgtagcctcatggtaagtcaaggagtgtgctgcattcctatggcttttgcaccgttgtgaagttgaaaaatcataagttaaaccattataagtcggggactatctgcagtacatgtaaaatgttcagaacagtgcctggtttaactgcttaataaatcttagcaagtttgatgtaaattgggttaaatttgcctccctaaaattctgcttctcagtcttgtgtcttttatatagcaaccctttagtatctgaagggggcaattgtgtcccccaagtggtgacttcactaagataaggcctccctggttcctgtaattatttcccatgtgactggattttcactttctttatcagcgcttcctctggataaaacagcttttgtggctccaaatgattgaggttagatttgtgaatctggttgctctagttggtgctttcatgatgtcatctttgctctcttcattatcctgagcatcttactttggtttgtcaggattcttctcaaataaaacacactcctcaacttttacagttgaaaacaggctttttttttttcttcttttctttttttgagatggagtcttgctctgtcacccgggctggagtgcaatggtgtgatctcagctcaccacaacctccgcctcctgggttcaagtgattctcctgcctcagcctcctgagcagctgggatcacaggtgcacaccaccacacctggctaattttttaatatttttagtagagacaggtttcaccatgttgatcaggctggtctcgaactcctgacctcgtgatctgcccacctcagcctcccaaagtgctgggattacaggcgtgagccattgcgcctgacccaacaggccctcttaaaaccggggccatctggctgaaggtccatcatatagactctgctttctcatcattcttgtattttttaatcttcctgctgtgagcttaatccaaagggtattttctttttctcttcttcatggtgagggacagccttctccaggagtttgctcacatatggatgtaaagtaaagcgaggcagttacacaatgggtgggagaccccagactccagcctaggatggagggttgaatctggtgagttggagctcaacagggacaaatgtaaagttcttcaagaagaactccagggagagcacatatcaagagaagagacctaggagaggagcctggggagccctgccctgaataagagcatggaaggcccaagaagagtggtcgggccatgacagctgtagagtagcatgcaaggatgttgtggtcacaataatccattatcttattcattcagctaaggtgcattgacctgttgagatgcagccatgcatcagatcctggggatttgatgggaaacctgacctagcctgtgaccttagattatagccagagagccatatgcaagtgaataataatgcaaccaatgtttggtaagctcctaccgcatgcctggcacagtgtgagcacttcatttgtgttcattctttgttattgttttctttctgtattaaggtagaatttgcatgcaataaaatgcaccaatttgagagtatgactccatgagttttgaccactgcatacgctgtgtgactaccaccccaccacaataaagaatacttctgtcaccccagagagtttccttgtgcctctggctggtcatacccctctcctgatagacaaccactgttctgacttctatcaccatagatccatcttgcccattctagaatttcacattggtgggaatatacagtatggactcttgtttctggcctcttttaatcagtgtgatgcatttgagattcgttcatgttggtgtgttgcttgtttttccccttactgagtagcactccattgactgaatatccttgagtttgttcatccatcctcttgttgacagaacacatgacaactcttagtcttcttaacaatccatgacataagtggggctgttatccccattttatgggtgaggagaccaaggacatgcagatcttattaatataaaagggaaggtgattccagatggtggtaggtgctgtgaggattctaaggcagggttacttggtcaggcagtggtgtcaaagtcagcaggaagggccaagcagagtgaggcctgagacttgttggaggtggcagggggaggtcaggggtgcccttggctgtggtggctctagagaagtgatggggcaaaagccagatggcagtgggtgggtgagagaagaaacaagaaggacagtgactcttgactgcttctccagaagcttggctgcaaaggagcaaatgggaccagcaggtagttcagggaggtgttttaaggacgggaagctctagatcagtgattaggccaagaacgtctttgagccattttctggtctcccaagtcccttaccctcttggaagagatcagaggtggtcaccctcagcttcaccctcatctatgtgaaccctgatgccctaaccctgtgcctacacccaagggtcctggagaggttgaagagacaagagggaggatgggaggctgctccagagatgagggatggggggatgaggttggtgagagtgatggaatctggtacatgggctgggggcgaggggccctcatcttctgagccaggccccaagataggaataaggtcagagcaaggttcagttccggtacatgggctgggggcgaggggctctcatcttctgagccaggccccaagataggaataaggtcagggcgaggttcagtttgggatgtggatgaggatgaagcagagggtgaccaccctggtctattccaggaggacaagggaatcagggagagcagggaaggcttcaaagacaggctggagcccctaagagaggaagcaaggtggggcaggcaaaggggttgctgagcatgtctgaggggccagcaggctggatgtctgcaggggcagccgttgataaagtcccaggattcagctgagcagcagtgaaggcctggaggcatcagctggctatgttaagtaggggcttggctcagcctggcctaactgatgttagattttgagttactttaggttttgggtgggactagaaaagcagggagggctaggagaccacgcatgtgcaagcacacatagatatatattgcccatcgttcctaaccctcctaagggcaggaggccagaggtatgtgggttaggaatgctatgggctgcagctaagagaaaacctggctgaggctttcaactatatgacctcaaattagctccctggagataggtggccccagggctggcttagtaacctaacaatggcaccagtggcaccaggggtgaaggctctttatctgtccttgccttgcagaaggccaaggcaccttgagcaacatgtcaaagggcatcccaactggttgtattatttaccttgaagtgaagtgacaggatttgaactgtcagccctcagggagaagtgttccagctaccaggttttttttttttttttttttttttttttttttttttttttttttttttttttgagacggagtctcccgctgtcaccaaggctggagtgcagtggcgcgatcttggctcactgcaagctctgcctcccgggttcacgtcattcttctgcctcagcctcccaagtagctgggactacaggtgcccgccaccacacccagctaattttttgtatttttagtagagacagggtttcaccgtgttagccagtatggtctcgatctcctgaccttgtgatccacccgcctcagcctcccaaagtgctgggattacaggcgtgagccaccgcgcccggccgctaccagcttcttaagaaaaaaaaagcactgaaagcgcttgtggtgctgtccttgggtgctcctttgcttttatctcagaggctggcacatttgtaggcaggactgtgagacacagtctcccctgcccccaggagtgtggctggcccgctctgccctcaggaagtttgcttccctcagattagctccggggcaggtcctgtgtcagggtgataggcacacggtgctctcccattgaaggtcacaggaagcgatcagagaggcctctgaaagatttctgggcttttcttcatccaaaaacaatacttggagttgaaacaaaaaggttgaagggaactgatccgacagctgtgggaaggagatgtacctgtgaaggtccctgtggtccatttcaaaggatactgtttttccaacttccactgaggtcactgtgtctgggctgcccacgtctgtttcctgcctgccgcactgtcttctgcagagctcttttgtgagaggaggattcggcctcctccctgacgaggtggcccctggggatgatggggcgggctaggcttttcttctgtaccatgaccaggcgcgtcagggaccaggcaaggtggagaccagctcttcatggtacttctgtccatctgtgaggctttggacactcgtggttttcagtctcctaggctggagtaaaatttgtacttatttaacaagggtgtttgcacatttattatgggaacgagaggatgaattcaccggatcccagcccttgcagggtgctgcaggatggtggggcaggtttggaaatagacaatgactgttcaccttagtaagtgggggccagaggtgtgtgtacagagctggaagcacagagagggaggatgcctgtcaggggtactagagaaggcttcctcagggtgggaacatttgagctggctgttgaaaggtcgacggggttttatagggtgtccattggcatctgcacaatcacactggccaggggtaagagatccactttccgatttatttctagtatcctataaggatgaacccagaagaaaatggaaagactaaggtgttggccttctttcaggcactgctattgtctgacttccgtttgtcctgtggccagatttgctctggaagtcccgcagttccactgcctctgttatcactactctctgttgaccccatctcccagcatggtggcagcagtggagtcccctcaccctatctgtgcctcgtgtctcttcacttcctttgttcacccagattttccttaacgctttcttccattggagttggtgtgggtcatcattcccatccgccctatcaccctgggctctctttgagggatcattgtacacaggggcatcattgttctcaagctactaatgccccttaatcttgttatgtcaccccagtggtgtgaaggccagggctccttagaggtaaaagggtctctttgtgaggcctggaggggagaaggttgagcggtagcttaggtgaatgctgcctgagcagatgtctgcagtgggagcagaatggtgtgatttactctttgtttttgtgggatgtccttggggagcccacaggtgctgtccattcatcaagcactgggagatggtccatggcagggaggagagtatggctatttattgagtttcatttggtcataagactgggcaggttgatttcttctgccctgaagcactttgctattaccagctgggactccacttatcaagttcttttaggaaattacccaatgaattggtggaggtaaatgatgcaggaggtttgaccaactgcatggggctacaacattgcagttcatgctcataatggcagcaaatgcttgagggaatccctgagtatgcatctatttcttgaatcatggcatctgctataggaaatcctcttaaatgtattcttatctccctaataaaatggaaattggtacttaattggtaaaattttaaataattacccagcatctggtggttcatttatggcttcaaccagatgcgttttattaacaacaaacttgcttttattattgggacgctaactattaatttactaggcaatatgccccttctaaaaccagaaaaaaatgctcacagaacatactagcccttctctcttgggatatttcatgctttaattaaatgctgggttgaaggcctaggatttatcctgttggtctagttcttgtttggttctgagagctgctccttaccacgactaagtcaccttcctctcttgccctgcagagcaaggcctgtcattacggtggatgtctccatcttcctcccgggctccatcaacatcacagcgcctcagtgtcacgacggacagcagcctgtgaactgcctgaacgtcaccacctgcttcagcttccatggcaaacacgttccaggagagattggtaatgagccaccaagtcagggctcaggatacccgtttagctggagtgggctagtgggatatttccgatgttccctgtcgctgttcctcccagctggttttgcaggcagcaggcacacaggctggacatcctttccctctgaggttcctccccttctatttcctgcttatcaacatgtttctaatgtcacacaacctccagctctaggacaaataatgttggaccccaagcattctttttgcaaatatgagggctagactgaagcctcattggaccacaggtcctatgggactggtggagatatagtgcccggagcctggcccttagggaacattcgagcagttagaaagcagaagtgacaggactttggaggctccttattgagcttgtagcatcagccagatgtcaggggacttataccatttactatggaattggagaccaaagatggatggtgggattcggatgctggtgttacagaggcttaggtttctaaaagaggggtgctgctttggcagctcagaattgaaaagaggcaggcattgtcctgacagctggtaactgtccctgccatttttctggctggggaaaatcaacttgctagcccagctctagagactggattaaaccccagaacaagatagaaccagtgttgattggaattcagagcacgtgatcacctgaaggaaatgaatctggagctttatgcatattactaggtgcttcatttttatttaaaaggctgatttaataatagaaagaaaaactccaggcaaacaaaaacactaacagggacctgaacctactgacgttcttagatatttttaatgtcatgagtgactccttttgctactcacagtgtagcccctggcctagcattgtcagcatcactgggaacttgttagaaatgcaggactttgggctccgctttggacttctgaatcagaatcttcattttcacaagagccccacaagattcctgtgcacatttaagtttgagaagcactgctgtggagcacacatgtgtgcacacacgcccactcatgcagaaatatttacgtgagctagttcattcctcagccacacctcaaatgttctaccttatttaatatgttcatccttcttggctgtctcattggcaatttctcttgatcttcaggtatattgaataagctcaactattaaacatatttattttatcattttttaaaaagagcttagaaatttcaacattgaatgaaaccataccataaaacttgggaactggttagtgagggaggattaacaacattttcttgtgcagctcaatgagaaagagcagctcactcaagatcacacagatattgttgaagccaggagttgaatttggatcttatgatacttagttttgctttctaacaactatttctcaccacctccataattgtttaagatactacagtcttaaggaaaaaagctttctgatagttctgggactcgtgtgtcctccacataattaagcagtctgtcttctgtccagtgccagctcatcacgtagttggactctgttaaaaaacatttttaaagaatgaagattaattttgatacacataagaatgagaactattctagaactctcaaaaagggcaaacgagtaatagtttctgtgtatgttcatttgacacatgcttattatgtatccacatgtgccaggcactggagatatagtcctgccctcatggagcttctaaagggagttacaaagagtttctactattttggccttgaagcagtgttagacaacgttcacttatcgctgttgtgaaagtgaaggtaaattggcatagctgaagcagagaagaagaaaccaagatgcaagttagagcaagagtgattcagagcatgagacaagtggtagagcaaactctgatttgaaggttcatgagctgagcgcagaggagatgtgggtgcctcctcatgctgttcccgaccagtggctctttctggggccccatctagcatgagcctttcacagactgctaagcataattagaatgaaggtctaggcttagccatagccccagaagtgttggggtaaagtggaagaggctggcagttggatggcatcttgtactgtaccttgtgggcaatgcgaagcaacctggcttatatctgacattaggtggggcccattcagcaccagtgtaccctcccattaatttctcttccctatcctccatctgccacatgggttcatagataaagtcaaacatccctttacactctaagggtgtgtttccccgataatcaggcttaaaggggatggtaactggagaattttgatatctcaatataataaggcaatgcagaaaattattcatccccagcatgtttctgtcactttctctggcattcatatctcaatctttgcagtagaaagagaaatgtagaaatctgccagaaaatgtgctggcagtgaaatggagagtttggggagggaaaaatgggcaggccttatggaaatgtgataggaaatgaggtggaggtgaaaggtcaggtaactgtgggggcccagctctgggtgaggtgtcctagaattcagcaaggaaggcagcctcttggctctgcacagtttggaaggtcagtcttcagatggaggaaagatgggcacttccaggacacagataccctccacttccatccaagctcagcagagggtgctggccaactctgtcatctccaggcctctgcctcaggaacccacagctgagacactgggttaccagccttcctactctttgtgctggcagctgcagaggaaccatgtggatgatgactttgtccatggaatgcctggtgaatgagtgccagccctgggcaggccttccaggcacctctcaatgtctgcatatcttgggctgagtttgttagcaggacggctgcatttgggcagagcaatacacagatacctgtggtgggctaggtactgctgtcagaagtggtatcttctgtggtatttatctgctgctgtcttcagctacatgacctgctctctgaggatggttttgagagccataagcagctgatgttagtcttgtgcctttggtttcttcttctctacctggcagggttcaagcctatgtacagagaagggacaccaactgcctctttatttcctgctttagaaatgggagaccacagtgcctacttggtcatgggagtgttcaggaccagctcattagcgggacacaagctgctgtagcctctgtaaatactgtaggaaatacagactttctctgtaggaggtgaatctgccttggcctctgaaacaggcagagtccagtcaggaaaacaaaaaccataccagttattttaacagaggaaatttagcactgggaatgggttaaacaggtcatggacgacctgggagtaactgcaggaagcagctgccgcctccaggtctgcaccagtggatctcaaagtgtggtcccagaccagctgcattagcatcacctgggatctcattagatatgcaaattctgactagaaactctgaaggtgggacccacatctgtgtttttacaagcctccagatgggttcaatttgagaaccactgttcaaggttatacttcgggttaaccacttccttggggttatcagaacctatgagcttggagaaggggccctgcggagctaggacctgaacctctgaggagggggctggtgctgctgatctctctgagggagtgcaatgaggctggctctgggagaatggggggaaaattgaaaactacaattaactgctgttggggccagctgccgtgagaaactgttgctgggataagctgctaggaataggaagcagggaggaaggagcgagttcctttgccctctccagccttgcaggctccctccgatgctccatattagcagagcctcacagcaagcctctggcaaaacaagtgaggtttgcagggtcccagctccagtgtcacagtgcagggtagagaagggtgggttggagctgaggacaacagcttcataaaccagcacagcaagcatccagttacattgagttgctgaatccctgttgggtcattcaatcaaacaataataattaaggtcctacagagtgccagacaccctgcttatcctggggcacggagcagtgagcaggacaggcaaagtccttgccctcatggagctggcattctagtgggaggggggcaggcagacgggacaaaaacaaccagctgctctcttgctggcttttctagatgagctccgggccccttgtgtggcatgcactgtgcttagcactgggacacagacagacacagacttctcactccgactgtgggctcctccaggagcaggtttacaacgtatttcataaagcactttaaaataggagttcttcctgtccctaatagtattattcatcacttcattcttggcctgggaacagcctgtggccccttggagcctcctggctagcataggtgaaggtggtgaatgctttgcccaaggggaccctgcccctcacccgtggacggtgcttgtacctactcactggccaggctgaagcctaaacttgcttgtcaatctctggaggctgggaatcaagctggcagttctgggctttcaccagagtgtgaaacgaaaaccaggaaggggcgctctctgagtgattgcattttgcactctgacccagtgctcctgtgtttccatggttagcctgaaactcgggaaggagaatttgttagaatttcacagctgaaatcttgttctgacggagagcaggaattaatcaaaacttgctgggagagaccagagctagagttgatgagagacagctggctccctcctggcccaggcccgtgcaggggggctcctcgggaagcagccgggggcagggcagggaggtggctgaaagtattactcggggctgatcagcttttccatcaccatgacatcattcgacatggcagggacacaagctgccagaaggaaaaacctaaagatgtgaaatgtgctgttggagcaggccctaatcagaactagcagcctcccagggacagacaggggctggccaggctggcttacctcatggccggctgtgggcaacttggacagcctgatccacccaccttcccagggccctgaccgcggagcccgggcagctgatcggctgcttcccagacatgtcctctgcttccctttccaccagaccctttaccagtgggtgctggtaaaactgccagttccgctcagggctttggaatgagtggtcagcatttcttcttgcctcctcaggcagggtctctcgttgtgactcttgctttcttctagaggagacagtctgatgtagaagtaatttcctttggggtaatttaaaatgtcaaaatttaaatcaaggaaaagtactaattaggcagttctagagatgaaatgcttccagaatgattgcacttggtgaattggataatgcggtatgtctgtgattgtatgttttaacattttagagaaatctgaaagtttaatgtgctggcatgcacacaccccgctggagaggagcagcagttgccttgtcctcagctcagtttctgtgaactgtgggttgtttctctcttccttgagttgcaagagatcagtacttccggatcagtacttctgcagtgagatgaaactttggaggagtaaagttggtgtttgtaaattatctagcacagtgcttggcacacgttgcaggttgaatttatttgcttttccttacttaccctgtgttaatatgggttctccccaaaacagagcctgggtcaaggatctgagtgcatgtggttgatacacaaatgatcccaagaggtaccagtaaggaaatgggacagtgagacaggaaaggaaggcagttgcaggcctcaggcttctccagagaaacagaatggagagagaaagaaatggattagttggttgattttcaggaattgggttgtgagattatgaggtctgggaagtctgaattcttgggggcaggccagtaggctggagactcagggaagagttgatgttgcagctcaagtctgaaagcagtctaaaagcagtttatttttttgggaaccttagtctttttctcttaaaaccttcaacagatgaggcttgcccacattttggagggtaatctgctttattcaaagtctactgatttaaatgttaatctaatataaaaaaataccttctcagtgacatctagattggtgcttgaccagattctgggtactgtggcccagccaagttgacacataaaattagccatcagagcagccaaatagagggtgtcttattgagcaggttaccactgtgggcagctggagctcagtcctgctggggaaccctggcagtcagtgtagaccgtgccccagaattaccccacatcaaggggcaagggagctggggccctgcattatggagggctgctctggggacttgagttccctggcactcctggcttgccaggcacatggacagagccactagagaaagccctcaggagaagagatgcaggtactggcagttgcaatttgggccggacagcagagaaatggtaaaagccaagaggatatgggtgggggagcaataccatcagttccatcttcctgtgttcctttccacccaggttttctctgagctcagctagttcatctctggtaagatagtccagtctcgctgttctctccattgtctcccttcctgagggaaggcagccattcacctgggaaggaggctggtcaggggaccccgaggagagtctgctcagcagctgcctccaccacattggttcacccaactgtggcctctggcttgtcttccagcaatgtgtatctgtagccatgactttgcttaagcgaacttggaaattcacttcatttaaatgtaatctttcttacttcagggcagttgttcagggaagttgtgatcagtagaaagtaaattggctagagttcagttgtagatctctgcacttgtttggacctgctatccatgcattcaaaaaaatgggaggttttggtcaagtaatgtacaacatgcagcaagaacaagtgtggtgggaatagcctggcaccagagattaagggagtcctagattcagctgtttgatgggtggccctctggcctggagcaagtcttgttcccttttggggcctcagttccctcatcttaaaaaatgaaggtttttgagcttagtggtctccaggattgcctcaaagctttgccagtctgaatctacccttttcttgctattgtccccattggagttggtgtgtgacacttgcacaggtgccagtgttttctgtgtgggagcactttcctgtatgcattattttcttcttaataatggcacctcctgagagtttccaggtctcagatcccttctggtgacacagccttgccttgtaagtcaactgtttgctggcgttaaacaagttggggcagatggctctgctgactaggaatttgccagctcggcatggcaagatccctgagatggcagaggcccagggaggccattagaagcatcaaaaatacgccctgtggcaggtgcagaatgcccattcaggtcaccttcctctctgcctgttcatacctcccctggtggctgatcccattgatgtcattaaaagccggagccttccctaatgcctgacttcacttacttaaatgccagtgggctcggggctacttgttactgatgcaaagcccccagattctaagaggcaggtgtgtggagacagggcagggctgggtcatctgccttctgttgcttagccatcttgccttgtcattccagggacagagattcctgttctctcactttaaaaataacatatttccttgaatccccaaaacagttaaaaaataaaaagggttacggaggggatgacctctggcacagaaaagcagtaaaataggtgtattgacactgaagtcatatttctataatgaaatacatacctatctatttacttattgactctgaaataacagaggtagatccttccaggtttatctagcctgcatttgatactgtgatcatcttttttttccttctttctttcttcttttttttaaattcaagactgtgttacaaaagttctgccatctggcatacacattcaggtatgggggtgagttattctttgcaggagaggacctcagtacaggccctaccgtggtcatagttttgttgaaaggataggcactacaaaatgtttgatcaccacactcggctacctgggaataaaggcaactccagccttcatctgggttcctgtgcatgtaaactacctgaaggcaggagtttatgcctgcgttgttcattgatacatcccctctacctttagcggtgcctggcctatagttagtgctcagtaaacgatggcgggcacatggtctggtccatgtactgattatagagcacgactcaactttgttgagatgagttaaaattatcagacgagatggttcccttgtgttgggcataaaccatgtgctttatagaagtcagtattacacaaagccttgataatttcagcagcttctggtaatgttctgtaggtttgtcatgatgttttgcttgtcaggacactaacctgtgttgggtacaccttgttaatgggcatattgctggctcagttgatacctcatgatggcatgaggtttaaatcagggagagccgtgaagtatgacacaaggagagtcattagaaaggcagaggacatcatgcttctctctcgattctttgagcaccctggctgtgtgctgctttctgagcaagtctctgcttggggctgcagtctcctgccatggaagggtaggtatcatatgagatgtgcatgtgatcctgtgacaaggaaaagaggtggcctcatcacagtgtgtcggtcctttctgacattttgacctctcatttattggcaggcctgaattatgttctgatggctgacgtggccaaaaaggagaagggccagatgcccagggtctactttgtgctgctgggagagaccatgggtcaggtcacagagaagctgcagctgacttacatggaggagacgtgtcgtcactatgtggcccatgtgaaggtcagtcctctcctcctttttatcctcaaactttgatctctgcagatgttcacttggagctggtggaaactatttttattatgtattatgtgtgctcttccaaaattttatttcacagggaggagcatatccatttcttcttttcttttaaagttggcctctgacagcccttttatttatcttactgtgttgatttcagcctttaaggggggtcgtggtggtctaggagaccagtgatggtccctggctttgacttgttcttttgagaggtttctcatcctctcccctctatgaggcttggtagccttttcagaggagagccttggaagcatgtgcctctgggtctgcagtgatgctggatcacactgcacctgatgcctttctcagtggtctactacaaattagctcatggtcacagttaaggcattttaaaactggttggactagattcttcccccttgactactttctatttattttaggatgcattttttggcaacctttcccctcgcactctaaataaacttgcaaatgtttttctcctcttgaaattgtttgttaaatacactttgctgctaattcaggaggccaggctttgattagctacagagtggcccttgcagcaggcgctggcagggtggaagacctggcagtgcctgatgctgcaggaatggccagacactgacccatgggcagggtcagagagcggaggaggtggaagaatgcacttaatccaggccacatggtgggtggaatgagcatgggttttggagacacatagatccagtgtgtatccagctggacacataattgtgacctctccctgtctcagtctctgcatctctaaaatggacacagtagtccttaccttgaaaggtggtcatcaggattaaacattacacaatgaatttacttaaaggaccttgaatggtgtctgataaatagaaagcaaccaaattattattatttggttgggctgtatataattgccaatattctttttgacttacaaaaatggaaatttcatatagctcaacccaatattgtttattagccactggatttctgactgatagtttgaaaagtctgcagattagagatgaagtgtcctcctgttagtgccagagcagaagaataacagctgcttctagatgcttcagggctgtgtatagagagatgccccacacacccatggcccagagcccatgagtccatgcccctcagatgcttctcagtggggctgggctgtgtcttctgccaggactcctgcaggggcctgcccagaccagctgcctgagggcttgggatgctggccatttataaagctgctcctgtgcctgttaagccatacagccccgccccgtcagtcttagattacattggcttgttggtgcctttggtggggtgtgaggctgcgcagtacaggctcgtatgcaaacactgtcaggcctttgaatgcctgtgattggtgtttttatacctgctggggacagggcatcttctctcgggcctcttcttgctaggtctgttcacaaaacctttcctttaggtttctttgcagcttcttgctttggctgagaagttatcctttgttcctagttaccaagggtactggctatgagatgccacgtagagtggcaatagtgaagtgcaggccagaggaagggctgtttctatggtggccctgagggttactgggaaggatcagggttgcgcaaggggttggtcctgctactttctgatatctagggttgccagacttagcaaataaaactatagaactcctaattaaatctgaatttcagatcaccaatgaataattttttagtatgagtgtgtcccaaatattgcatgggatatacttatactaaaaacattttgctgtttatctgaaatttaaatttaacttggcatcctgttggcagattcaactctgctgatcttcctctacccaacaagtggcatttcttcactcaagcaaaacctggctgccaagaagagagattgagatgatggttagaagagtttggaggctgagctcagggctctcgagtgcagatccagcacagaccttgacgtgattattttggtcattctagggagagcaaaagagcaggcctgcttcagtgaattgggacctagagtcatttggatacagtggttgcttggccattttctcatgcaaggaggtgggagcggagaaatacaccagatagacacatgtctctgagacctttatggttcaagaggcaacattgttgccaaggtacactcaaggtggctgatactttatagccatactttataaccatgagaatgtttatttctggcagttactgtctgggctgtagcagaggactgggcaaatggcagagtgcacccgtaggatgagtgctaatggcctagctagctgtccacagaggaggcagcaggcaccgccccggcttactggctgtgggaacacagctatggaagctgaggcaggaagcaaggatgaggggaaggggagtggcagccgggccacctcctggagcaggaactggggcctggggggtgttggtcaggggtcaagagcaggatgcagtctctactgcaagtggagctttctcagtggagctggctctcggctttatggacaaatcaaagaagataaataaaagcattctggcttatcacacaccatatggctagcagacagtggggccagcatgaggggctgggcctgctttgtttaggctatctttaggtatttttttctttttttctttaagcctattccaatctttttttttctccctctccttttccctggaagttttcttgccatatatggtgataagtgactttatcatggaagaccgcacaggctaacacctgttttccaggctaactgtcttgtaccagactttgttccattcaccgtattggagggcacctccggagggtataggattttgtgataaggcacatcctcctgaggggagggcaggtactttctcacggcctcactgtggtcagcagagctgaggcagctccagccacttccttggcttctctgcctcagagttcacacaccccggcttatcttccctcttccccgagaccagcccagttttggggatggggcccctcccactagccagtcaggctggaggcctctggtggatctcacagtcacaggcgaaagcccaacacctcccctcagcatcgggctctccatgccctgcctgaccttacctttctagacccatcttctgccaccacatcccctgggccccagctcttgtcatgacctgcccctttcctcctggaacctgctccttacacttctttgccttggttcttatgctcacagaagtcagaggcccggtttgtgtcatattcatgtagaaccatctaccacctgcatgatttttacatttttttggtcttaaactcatactgcctgtgatattttctttcatatttttctctttaaatcagccaacttttggtctcaaataaaataatttaaaacagaaactttgtacctttctataagcagaaaaccatctaacatgtccccaaaacagaaagtaactgtaaaaataaatatattgaagacacaacagtgtcctagaattctagctggatttcattgtttgtcaaagttgctgataaagcgcccactccattcatgtgttagaaagggaaatgatcaagttctagggaaggcttaaagacatactagcaccgcgctggaactttcttcctgatgcaaccagaaggactgcaggggaattgactgggaacaacttttcaaatatgagagttgttttacagagtcatgcctatgtgccatggaaatccaccttgtgggcccagtctgggaagccctggccatgctctgctttgatcagatgtgccttgccccatcctgcctgctgaaggcttgctgttgttcaaggctcagtccacaggttttggacatcctcagtggcagctactgtcctaggccctggggatgccactgtcatcttcctgacttcttggagcttgttccatgctgcctgactcctgctttggggatacttgtcaggcagaaccttgttggagtgactaattgggttagctggagtgtggggtcacaaaggcttctgatatggagtggggcctgcttgcctctgtctggactgactgctgggaagtgatggcttgagatgatggagaagagaatttgggatgcatggtgtgtgccaaagaataaatgcaggtgtcctgttgttactccatctgtttctggtttatgtgttcttacctggatgacagctgtgctcatcctctaatcctgtacaataccttgagagcacaggccttttgtgagatcaaatacctatgcatgacaggcaaataagcaggctcttcaggaccagggaaacgatggcaacagttctgagtctgatgcagggatggcagagaagcccaggcagagtgcaggggcagtgatgtcattccctactgtgaggatcagtgacaccctctagaggcatttagggaactttttttgaacagaaccatgtgtcagacactgtcaagaaggccaataacggtattattgttaaaaacaaaacaaaacaatctacactagacgagggaatatgcacatcagcttttctgagaagctgcagatgttcataagattgttcttctatgttcctgaaggatttttcaaggaactttgaaacctaagtggctgcagctccttccttgcttttgtgggcagatgctcatcctggcctggcgaagggtgggacatcaccctggccaccaggtctcctgagagatcacaccctgggatctgcccaggtgttttggcctgtttccattttcatatccaacaaaatgccttgggaccatggcttcaatcacattacatgctgtgggtttagagtgttggatgctggttttcagaggtgatcaaaactttttttttttcttgtttaagaaacagatagttaagaaagggagattaagttggagttaataagaactctgagaaagaggagaaagaaaaacagcaaaagtttcttctttatctggaaaataacatgctaaatctccgggtcatcttgagaaatcaaagaaatagctaagaaaaaaacagttgcagggtttggcaaaaggggacgccaaccttagatatgaggtcttctgaaaacttttaaaatttgtttattttttgaatcagtagtgtgtatagttaaaatttttaaatggttataaaagttgtcaaagaaaggatgtctttcagctatcctatttttctcccaaaggcaaccacagttccattttcttaacgtgtctttcaaaagcttgtcaataaatatagaaatctgtgtgtgtacctccttttattttatgcaaatagtagtatactgtgtgcacactgtagtaaacttactttttcttttaaaacatccaacagcagaatggaggaacagattttggcaaatcgcacaaaatctagctgtaccagatgaaatacaactcagcaataacaatattatgttattatgatacacacaataacatgaatgacttttgaaagcattaaactgagtaaatgaagccagacacaaaaggctacctactggatgattcatttatatgacgttctggaaaaggccaactaaggagaaagcagattggtggttttcagcggccagggtttgggggaagggctgatgatgattgacttcaaagagggatgagacaactttctggggcgatgaacatattctaagatcgtggttgtagcggttgtatggttgcatttattaaaacttaacagagtgcacacctaaaattagtgaatgttatgtatgtaaattatatctcaatcaaacttattttgttaaaaaaagtttcgtggagattgttccatattggtgcatatagagctttcctgttctttttcagtagttctttttcactattccttgatttatttaacctgtccaggtggtcttctatatgtcagttccagactaacctgatctgatgcttgtagactagttatcttagtttgcttctccagaagaggctcctcttctctcccctagatccatagtatcctggctgaggacccctgagagggcagcatggaggggccctggtgctctctaaggtgaccttggacatatgtcctacagaggacaagcctctcagctatagggtgcccaaggaaaatgggagatttttcttgattcctgcagttggctttgtgcccttggcaggctctcctggtctgtaggtagcatagatggcctgaatgtttggtaaggggtgctggaaactagggcaagaaaagaggggaaggttgggatgcatagaactgatgtgtgggaaactaccttcatcatccagctcaggtgtgaagccgctgctcatgcgatatgctctgctcacacagatggcactaaggaaccgggaagctgggctttggagaccacgctggaagtcagctcactgagtgtgggttgccttgaccatctcctctgggaggccatgttgtgcatagctggagaacaaactggggatgaatcaagaagggaaagggtgtggtgaatgttcagcatgggagctgatatctccgatgagcactgtttggccattgatttatttcttgggtgcaatgaagggctcttaatcttctgcatttggacacttgccacagaggacattgtgattagcaaaggaaggcacaaaaattctaatccaaaggctttgcccgccttaagtccttttttgaaatggagctgatttaaatatgtaagtatggtcacagcattgacacttcagtggttatcgtaagcttatttgtacagtatgtgagatgcagtttgtagcaattgctatgggtaaaatttttattttaagaggtgactttctatttacagttattcatttacactgggttcatctattaatatatactgttgatgcccttttaacactggtattctttgaagtcacacatgataatgtgttctgttttattggttttgtctttatatttgagatgtgattataaagatcccttctgcctcaaaccttgaacttagatattcattataagcatgattcccttcaaagtaatcaccttctagtcattcctgttttgaaatttcttccatggtttgtttattcacttttatcatggtccatttttactctaggagttaattcaaattttggaagcagcaagatttctctgcaatcctctctagtagataatagtgtgtttggggaaaagtgaggtataataatacaggaattagtattaaagaatgtagtaattaaactccttttgaaaatgattttaaaagaattcccataatattcaggtaatagcgataaaagcagctaacactaatcgagcatttagtatgtgctggttactgtgagtcactacatgtgagatagttactgtttttatcctcatcttactgtttcaaagacaaggcatagaagagtgaagggacttgctcacaaccttacagttgacaagtagcagaggtaggatttaaacccgcaagtctggctcctaagacttgggtttaaaccactacattgtaacacccctcataaatacaagctagaactattagtaactagtacttattatatgccagatactcttctacaggctttacatgaagaaagagaggttaagtaacctgactcaggctatgaactagtgagagacttcactgcctcttcataatagagtcctgggaccttctctgtgttaagcatatggcccccagaggtgacagcttttgggggtttatgttctagagcagtgatgtgctgctaatgtttaacaactagctcttggaaagaggggacatgacttttgtagcattttgcaaatttccctggtgtaaatattcttatcatgtctgatttcaagctaccaatgagacatcactgaatgtggagttaggaagagatgcacaatagcacacagttgtttagtatttccaatagctctaaatatctttaagagcatagatgatagtaaagtatggtaaaataattaggaagttatgagtgttgagtatttattacatttatcttaatataatttacttatttttaagtttattcaatttaacttttaataatggctgtgtttaacaaccctggctcataaactttctgaaaatttaacagttggcttttggaaacccactgcagcaagctccagcacacaactgaatatgttgagggtttttttgttgttattgttgtttttaattttagattcacaaggtacaggtgcttgtttgttccatgggtatatcgcatactggtgagtattgggcttctagcatgtttgttaataagttggtcatatcactcaagtcatgcctgatacacagatgtttgattatcagagtcttttttctttcttgtttcctgtggctttttaagttgatgaataataggaaagtaaatttgtggggtcagttaaaccaccagacgacagcttttatgtttgtacattggttcagaggtactctgtattttgactggatttattggatagtgtaattgtttccatttaaaacaatggaaaagatttcatttaaatttattgagatcttatttttcaccctcattccgtgcacatttgggattctgttcgccagcccctctgcactctgaagatgcacagcagcctctctgtactctgaagacgcatgaattgctgactgttgggcttgcttggaggggactgggggttattacctcccacaggactgtttaagctctggaagttttcctacctcctgcaactgaatttagtcttaattagtacagagtgaactagctgtgaacaatctggttttcttgctttgtgccttgatcatgtgagacctaagggctggtcctgcccttttcttatccattgctttaatcagaaataacatatcaaggtggcccaaattgtgtcactattctttcctttgtcttctccacccattcccacggcatccattcctaaggtcatttggagaattctctgttccaataagtgggatccacatggctcaaggagcaacaggccttggaatcactctttgagtagtagctggtccctcagtctaccccaaagagctgcctcgccagacctccccacctcccggacatacagactccagatgtggaaaaagcccttgccatctctatcctccaacacagagctttggtgtccgagacacatccaagtgacaggcccaagagggcctctgaatgaagacggatgagccgtgtggacacagccacactatgttttcgtgaaggcataagaccatgggccaactttctgggcatccagggctggctgcagaggctggagtgagtggctttcaaggcaagactgataatgaaagtcgtgtttgggtgggaatcacaagcaggggaagtgggggagccagcttcccttcgtgctgtgtgtcacaataagataggacacagatgcaaaagcagatcgctacagctggatctgggtaaaggtggcagtgacgcgtcggtgcagagaattcctgttttgaggaaagattcggagccagctaaggttttctgagggcccgtcatgtctcagactgtcacacttattcctctgtcatgtatgcttaagtctgttttagatgaccccttgtaaagaaaggaagcctggcccctgaagcctcattgcgtgggataaggggactaacatattctgtggttgtaccagcaaattattatttatttcttattttataaaagtatagattttattcatgcctatattgttagagaaaatcattatttttagtcaacgtattagtattaatatcatggcctcttttcttctcattttggaaggggaatatttttagactctttaatgagagagtcattttctcagtaaatatttgattggcctgaagttaagtgggtaggcgtaaaaaattatggaagtattggacttgagcaaacttttgacaaatagcgctctctttctctcttgggcgtatgcgtgtgtgcatgcatgtactccagctctctgtgtatgttacacacacacacgtttttcgcataaaacatttttattttgggccaggtgtggtggctcacgcctgtaatcccagcactttgggatgctgaggcaggcagaccatctgaggtcgggagttcaagaccagcctggccaacatggtgaaaccccgtttctactaaaattacaaaaattagctgggcatggtggtgggtgcctgtaatcccagctactctggaggctgagacaggagaattgtttgaatctggtaggcggaggttgcagtgagccaagattgtgccactgcactccagcctaggagaccgagcaagactccatctaaaaaaaaaaaaaaaaatctttattttgaaataatagcagtcttacaaaaaagtcattaggatagcacaaagaaataccgtaaattcttcacccagattccctaaatgtcatttgctttgtaattttctatctattcgtacttcttacctgtttgagagtaagtcggagacgcgatgcccccttatccctaacatcagggatatttcctgagaacaaggacattcttttacgtaaccatagcacaattattgaaataaggaaattaagtgatacattactgttagcttatctgcagaactcactcaaatatcaccagttatcttcatgtccttggtagcaaaagaaaatcccgcactattgcatttggctgtcacatctctttagtctggaaaagtcactcagccttgctccttcatgtccttgacatttttgaagagtacaggtcagtttgtctgtttcatcatgattagattcaggatgtatattttctgcaggaataccacagaatacttgtgtcctatatatttaaaaacatatacatccaacatcactgaaggtatgtatttttaactcctcctttaaagtggttttccaaagttagttgccatccccaaaagggagcttttagacattgagagaggtgattatgaaagtacgatagcttgctcaccacctctctcctctgctcctgggagcacaggggagtttcaactctggggaaggtgatcatttgggtcattagtagcgctttgagtaccatggtgtctgcagggagttcccagttcttactgctgtctgagaataaaacataatatctttggtcttcacagaggtatcagacaggaattccactcagcttgcaggaattgagaccccaggacaggggcttaagcacatcaagataatttctctctcttctagaggaagagaagttgctgatgttggttcagtgactcgaggatgttctctgacctttcacttattcaggaaatgtgcattgcatacctattatgccgtaggctggggggccctcagctctgctgtgaagagacaaggatccttgtccccctgggagtttatatcccagtagggggagacagacaatagatataataagaagaaaattaaggtgcattagaaggcgatgaggctatggaaaaaaagaaagaaaatagagcccagtgaagcgggtttgggagtgcaggcatggggttatgggggtcagggtgacctcactgacgaggtgtgatttgagcaaagcatggaaggaggctggggagttagcacagcgggttcctggaggagggctcagaccagtgtctgagtgtctggtgtgtctgaggaggagcagggagaccagtgtgggcaaagaggtcagagtggcagtgatggttgtgagcgggtcatcttgggcttcctaggccttgggaaggatttgcctttactcagagggggatgggagtgtgtgagggatctgggcagggtggtgacctggcctgccttccatttttacaggcccctgctggcggctatgttgggaaggcctgtaggaggcggtagagcagcaggaacggggttaggagactgagcgttacccagggaagagggtggctccactggggccatagtggtaacattgtgagaagtggtcaaattctgcgtgcattttgaagggggatcctacagcatttcctgagggtttgattgtcagttgtgagggaataagatatcaagggtcactccaagcttttcagcctgagtacctaaaaggatggagttgtcactggtggtgttttcaacggaaggtgcaggtgagcaggttgaaagggggaagatctggagtttgtttttagacacactggtagatgtttaagtgtgtatgcgtatgtatgagtcttcagtttgagtagtagtctgagtaagaagtatcaatttgggagtcgccagcagacagatggtatttaatgccaggagatttgatgagatcacccagggtgtgaggggagatagagaagagagggggaccaagggctgagctgtggacactccaacactaagagcatcttttcctcctacccctaaaatggctctggggctccagccattgtatgtgtttttcatgcaggaagaagtgggacatgcaaaggggctctttataatctggtctgaggcccctgtaaagagcctccagtgacttctgcttataacgcattgaccatccatattttaaaagaggttggaagatgtctaagtaccagctagacatcttataaatcctatcactatagagttttgctctccagcagaactttctgtgatgaaggaaatgttccgtatcagcactgtccaatatggtggccagtgaccacatatgactgtgagcacttaaaatgtggctagtgccaataaggcattgactttttacttttctatacttttaattaatataaattcaaactgaaataacacatgtggctagtggctaccatgttggacagtgcagatattgaagtttgatttttaagaaggagagggacagacactggacagacaactcacagctcctgccacagtacagcatggagcctcccaaggcactagtcacacagatcaagccacacagccaaatggaaatacaaataatagattgaggtcacattgactgtttcacgttgtacttagacatgctgattaaaacctgagttgcaagtgtaccatggaacataatctctccctctagtgttttggaacaatcacacacaaatgtttatatccacatacaggccccatatacaatgggggaaacagaacagaagaaggttggatggttcaccaagttgagtgggtccttcaaaggatgtcaccatcttggatgtgatgttttctgttttcagtggcatagaactagataaaaggtggcagtgcagaggatggaagtggtattgctcagtgggaaagggaaggcattttaggtttgggacatattacaatattgccttttagcgtagaaaagccctccttcctgatgctcttgctagtgctgggtggaaagattccctttcaactcaacatgtgtgaagcacatgaactgaagcactcttcctgcttagcatggcaggggctgggccaggccagggtggaccaggtcttgctctgatcaaccacatggtctcaggcaagttgcttcacctttactgctgagcttcagtgtcctcagctgaaatggggagcagaatactgacttcttagtaggggtctggtaaacactgggcccctttttccttctgctctaccctgcaaatcttttcctctttctaactgcctctgcatttggaaggggtcaagactcgtttcatagttttttgggggattaaaaaatgattagaagcagatggtgagaagaaaatagaaagtatggagcaaataagaaatgtgggaagagaagagggcaaatggtaaggcagctctcggagctggcacgttctttctctctggaccagagcaagccagagcctctcagtcatcttcacgggctggttgacaaggactcctcacgttagcgtgcacacgaagaacctgggaccttgttcaatgcagatcctgatacagcagatctgaggtgaatttctagcaagctccctggtgacgctggtgctgctggtccatagaccacaaagcaaggagctcgaagacatagataccaaaagttacaggggaaaacggacaaagccaccagctggcagttgatgcaggtatcagaagcaagtgggcctcggaggggccagatgcctctctcctcacactgaccgtgagagcgagtgctcctcatcaacaacgtggggccaggcttgagtcagcagcactgactttatgtgacctagtgcagctcgccagcccacgctgatgtgtgttaatggagggggtgccccttataggagggtggtgtgggctataatttcttctgcattctctgcctattgcttgaaggacagtgttgtcagcagtcaactgactgagcttgacttttcagcagtttttttaaacttcactgcagtgtttttggacacagctatgtcagaaatctatttccccttctcagagaccaggaagctcttgaggtacaagctcttattaagcagaaaattttaaagtggttttccttctccttttcttgggtctgctttcttggggcaaacagaatacgagaagccagcttagaaattgcatgggtccttcctgcattttgtgagaaaatggtggcctcctatatttcttccctgacaggttactgtgggccaccagcctccttggtgacttctgttttgcagatggggaatttgttgattgtagtgagtacgctgtgtgcggcagaaaggattctgtcacctacagagagctagggaagcgcccaggctgaggaaacccaccccttcgaagcagccatccataggtagcctgggggtcttttcacaagacagccctagccccagttcatgggagttggaacaatggtgggtccaatggtggatgaatagtttattcacatgcatcccaggagatttgtgtgaagagggtgacagagagttgcttcttttaaaaaaaatgtattaagggctatgtaaataaaaagaagaaattaagttgtaacagtaacaataatagctatcttttattgagcatttactatatgctacatgttttacatgtacatgaagtccttataaagaatacaattacatatgttaatatgtgattatatacagaaaattgtatcagaattatatctacatatataaaaataaaataaaatctcattttaccattgagggatctgagatttagagcatttaatttatttaagatctcacagctggtaagcagccaagtcttgggtttgaatcccatccagcaaccaactagttctatgactttgaatgcaaaagatgatggcttttctcattattattacctagttagtctgagaaagagaaaactccattctggatggcccatttctgggtggattggtgctaggtttctcctggtcttggacgaggttgcacttttcagccgctcctgtgcacgtgtgtccgtgctctgaggtgggaggaaagctcaatgtgggtctgtgagtccagggcaggcaggagtcctggggactggaggttctctgcacttctgtttgatcttccctgcctgtctgtggcctctgcagtttaaacaatgactgtcacttaaacctcttctgaagagcttgaagtctggtccatgccttcagcccaccagcatgtgttgagtacctgttgggtacacagctctgtgtctggtggaggggaaacaaagattaaaaagactgggccctgtcctccaacagctcaggttatttcatgcctgcattcggggcactgtcttacttggcctagtcccacacttgtccctcccaccccttgcttctctattttcaattcacttctgtttctacacacatcagtgatgtagtgtcctatgtacaggtgtgcctgggacagtcctggtttatgcctgttgtcccagcataatcattaatagttctctatttcactctcaagtgttccgatttggatggcaccctatttattgagtgctcattgtgtgccagacactgtgctgggcccggggcagatggagactcgtaagccataaccgctgcctcccaggagctagtctgctggggcatccgttctgaataccatgacttggcaagtgaagcattcccatgccttccagactcctggctctgcctgtgtgaaacgtactccatttccagagccagctgccgagctttttcccctgggctgactttccaccaccctgacctgcgattcctctctgctaaccctcctctcaccgttctccccagggtgggctgtgggccttctggtgctgagctccctcacatctgagctgtcttagcaccttctttccacctgtatttgtgttacttggatatttgtgttttatcttctgtaccagagcataggttattttaaagcagggagcttatggcattcaacactgtcaccctgggaataggacccccaaaacactttatttctcaaataaatgatggagtaggttccagcgttgtttcttccttgctgtccatttctaaggatgagtaaagagttaacgtattgaacttgaaaggagagatttttttccctcttgtaataaatcaaacttttctgaatctggaaaagtgatggatgaaactatgtgagcacacacacacacacacacatatacaccccataaccattttgaggtcatttaataagggattgctttctggataatctcgctccttgggtataaatctaatgtgaaagggcaggggtcagatatttaccccaaagggttggtgtgaggataaaatgaggcattgcttttaaagtgctaagctcagcccactgaaaaatacgcaaatgcatcagaagagtcctctgtaaatccactgagctggaatttccaagcaggtgtccttgctgcctcttgttagccttttgtgagttaattctttgtttaataacaaagagctgccagatggtaattttggaggctcagatacactctgttgcacgtgcctgtccagcttacttaaaatatgtcagaaagaatgagggaatgactcaaacaatttcaggaaatggttcaaggctgtgtaacctttaaggaaaaccacacggagccattaccttgtgttgaaaggcagctccctggctccctgggaggcctggtggcaagcagtgagacacttgatttaggtgaaggggggccccaaggcagtggtgcctcccttccttctgcccagaattgaggtgttgtccctacagtggaaactcaagagcagcactgtctgatagaaatataatgtggtcacatctgtaattgtaaatttccttttttttaaaattatgctttaacttctagggtacatgtgcacaacgtgcaggtttgttacataggtatacatgtgccatgttggcttgctgcagccatcaactcatcatttacattaggtatttctcctaatgctatccctcccccagcccgccaccccccgacaggccccggtgtgtgatgttccctgccctgtgtccaagtgatgtcattgttcaagtcccacctatgagtgagaacatgtagtgtttggttttctgtccttctgatggtttgctgagaatgatggttttcagcttcatccgtgtccctgcaaaggacatgaactcatccttttttatggctgcatagtattccatggtgtatatgtcccgcattttcttaatccagtctatcattgatggacatttggattggttccaagtctttgctattgtgaagagtgctccaataaacatatgtgtgcatgtgtctttatagtagcatgatttataatcctttgggtatatacccagtaatgggattgctggatcaaatggtgattctagttctaggtccttgaggaattgccacactgtcttccacaatggttgaacgaatttacactcccgccaacagtgtaaaagtgttcctatttctccacatcctctccagcatctgttgtttcctgactttttaatgatcaccattctaactggcatgagatggtatctcattgtggttttgatttgcatttctctgatgaccggtgatgatgagcatttttttttctagtagccacattgaaaaagttaaacaggtaaaactaatttcaataacatatatcagtttgctagagctgccataatgaagaccacagacttgtggtttatatgaacagaaatgtatttgcccacagttctggaggttggaagtccaggatcaggtgtccacaggtttggtttctcctgaggcctctcttcttggcttgtagatgactgccttttccctgtgtccccgcatggtctttcctctgtactcatatctctggggtttctgtgtgtccacatttcctcctattctaaggactccggtcagattggattagggcacaccctgagggcctcgttttaatttaatcaacccctttaaaggcccagtctccaaatacagccccattctgaggtactgggagttaggactttaacacaggaattttgggggaacacagttcagcgcataaaaatgtatattatttagtccaatatagccaaaatgttattatttcaacataaaatcaataaaatgttaatgaaatatttgccttctttcctgtactagggctttgaagtctggtgtgaatattagccccattttatgatctcattaggcacacgtgggtagtggtgaccgtatcagacagtgcaggtctagtgtcgaacctcctaatctcttgggagaccttgggattgtcgtaaggaggcctgagtgaattcataaaacatatgcagttcctgaatcaactaataagtaaaagtataccttttatcacctgaggttctggtaaatattttggtattataaaggttgctttcacacttacaaaagttaagaagcatggttctgactttcctaaactggggtttctagagcccaagctccattagcatggtgatgacggcctgcaaaatctttccagcatttcagaaagcctggtgggatcacaggggttgccattcagctactgacaaggtcagcatcattgctttcagctggcgttttagtacagtttttctggtgaccttgtgctgatcaaactttccgcgtggctttttatgacactgtaacaattactggggtcatgcctggagaggtggcccacagttcatgcacaggctcgagtacaagccttccggggactcatctctcagccctgttattattctcagggatttggagggtgcagaggtagatgaagtaagcaagcactattgtgcttcctgtgttgaagtcagggaataagaatttcctctgtgccacaaataatgctccccacctgtatagaatgcctgggaaatgcaacactggccatccttcagctcttctgcttacagctgttgtgctggtgggtctcctcctattctcagagcagagagccacgaatggggcactcggggccgtgacaggcatcccttagctctggccttctggttgtgggcagactctgctgtgtccggcagcccatccagcgttggatggcatcagcaacctgaaagccctttcttaggctgaaccagagtctacctccatgtaatcacacactcccctcctatttctgccccggagcacctacagatatctgtctgtctgtccccatccccactgcctacttcctccagactcagcatcctgagttcctttgggttactagttcattttggaacttattccactattgaattatccgtattctttggttttatacctttattcctctttagttgaccttttagatacttttctaaccatgccccctccccgctgccccgaaagatcagggaaaataagaagaaattcaaacccttgttttgctcctcatcagcgacagtggtagggaagatgcccacggcacggaggttcagtggttgttttcattctttcctgttagccagtttcctcaaattggtcagtataatcctacctcttggagcgatagctggctggattcttctgccattttggcagttatatattggtctggatttaaaagtgatgtttattccatagctctcctgaatctgacatttgttcctctttcatcctatacttccctgggcatgatacccttctttccatcagctgtgttggagaaatgtggcatgtggcagatgtatccttgcttgtttaattaatgagccaaacagtccagaaacttaggttacaaccaaggtagtctggcaagaaatatacatgaattcaaagaggtttgggataattttattaatgataaaaccataaagaactcagaaaatattttaagatgcttggcatcaggaactatttcatttgtctccatatccccagcaccacgcagagtaattgacattgactaattgcccaataaatgttcactgaatgttaggagaagctggagtatttccaaaatgaacatatgctcaagatattctactagaagtttacaatgttatcttttacatttagattagtgatccattttgagttaatttttgtgtgttgtccaggatagtttcaaacagttgtgcaaaacaattctgtttgttggttatcatgggtagactaatacctgtcagatcatataacccgacagtcagctggaaacacttggtcacatgagattgcctatctacattttaaatttggcttcagagggagcagccagcaactcccttcaaccccctaaattttggattgtcctaatgaaatcttggactgaagcagtacatttttaaccaggctttctcaggagatttggttcggctggcactcagcccacactttgcttaactctgagcaaaggtgtccgtgggtggataatcccacctccccattctggatgtgccagcacttttcctactcatccccagttatggaatgtctaattctttctcattttctcctgtcactaccatgctgcagtgagcatcttgggtcacctaactattaattctggaggacagattccagccgtggctttgctgggtcaatgttacagccatttatgtcccctcagatgttgggttggtcctggatgctgccctgtaactccatcacacccatctgaagtcctgcctggtaggcagcagacactgggtgtggcttggtttctcatacctttttatttcagtccctggtgtttttgtcatcttgtgtggcagtggcagtgctccagctgatcatttttatgggacagtccttccttgatgagacccagatccctgtcacttgacaacataaagaatattattcttcataccagcatttcccaaagcattttttcaaaggatagtaacgacttttatgtcaaaaaacaaaacaaaattttgaattcaaattaattttggaacataattgaatttaacgcaggctttttattgcaggacttcatggagctttagaagcccaggcacgcaaggaggatgcactgtttggcatttcctaaatgtacttgaccacggaacaccatttttctcctgaggtttaggaaatggtgctatgatatagattagttttctatgaataacttggctttatgccttcatataccttttctctctactcatgtagaaactcttcttcagcttcatgttttaataatggaagaacttagtgatgtttcatatgtagagatttttctctaggtccttctcatcgataagacctgtttcaagatatggcaagccctagttctgatctctggggtcctcaccatttatagacttccattagtcctgttgtgacttaattgttttgttatatttttggtggcctcctacactatggaagactttctgaaagcccatatctcatgctaaatttagctggatttttaacagccttgattgattgctggtcttaatggaagaaaatgtgatcctttctcttcctcccttgtcattaaattattactaatctatgaccagaggaagcagccactgcatacgtgggtgtatttttaaaaattgtgacacatcatcaagatggatatacttgcccctttaattcaacaggcacctgttgaatgcctgtgcatgcaaacatgatgctgggctgagccctggggcttaccctgaagagctttggagcccacagcagaactcccagccaggctcatccaccactacagccacaaccatccctacctggagaaaggggctaaaagaagcccatgggattaacagacattctgaaacaccaacccttaggaaaggagtagaaatgggagttgggattaaaagcagaggtgaggttaaagggtttgaacaaaatgggcctgatcttgggcttctgaagtcctgtatagtgtaagtgctgacctgagggcctgtggctctcctgtagtgagggaggatccaactggagtatgacttccacctctgcatggccagcctggtgacgtgaagcacatttcttatgtcaggttcccagtttcctcttctgtaaaatggaggcagcatgggattgtaatgaggattaatggagctcatttacctgaacgccccagagggtgcttagcaaatactttatgcttcttgtgggtccattactttcccttgcctgtttttttagggaccctggagtgttaccttggcttctgattaaaagctaggttggcagatgcaagcacacatgcctcctatagtgttgtcctagactggggtggtgttagtggtcaggcaaataattgatcactctgtgttctcaagacaagcaatgggtaagaagacaaggccacggaggtcaaagatacagaaagataattgccatatatgctatgcagccagttcccctacctcatgtgattgtagagtggttcttacactagggtggcatagaatcacctgaagggcttgtttaaacagatcatgggtggtgggtacagcatttcaggtgcggaagatgaaaggttctggaggtggatggtggtgatggttgcagaataatgaaaatgtacttaatgccatagaactggacacttgaaaatggtgaaagtgatacatcttatattgctctccctgccccatcacaaatagattgctaggctcactccttatagattctgattctgtacctctgaggtggaccttaagagtctgcatttgtaacattcccacgtgatgctgctggtctagggaccccagtgtggaacccttgctgactgggttgggagtgacgttgggaactgtttcgccagaaatactggggacccttgagtggtaatggaattggttgtatattttagtatgatagttcttatagatgataaagacctcagaaaaatctcactatgtccatgcccaagagttccaccatgagcacatgccttgagggcagtgaccctggctcctattgtctctgtctctctatatctataacttttaatcttgaaatagtttaagattcataagaagttataactcataagaagttttaactcataaaaagtcaaaatagtacaatagtccccccttatccattgggaatacattctaagacccctagtagatgcctgaaactgtgggtagtcctgaaccctttatctgctgttttttcaatctgataactgagacagctagtaagggattaatgggtagtagtgtaatagcatggatgtgccggacaaaggtgtgattcccatcctgggcagtatggcatgagatttcatcacactactcagaatagcatgcagtttaaaacttgtgaggatgaggggaactactctatggaaagattcaggtaccctttacccggcttttcccaatgataacatcttacatatacatagtacattatcaaaagtaggaaactgttattggtttaatactatacattcttttaaaagagtgctcaactcaagattaggaatctatttttcaactaccattagccccactttggcaaggccaggtgggataagtgctggggctcctatggtgggtgtgctgcagtcttcagcagagcttggctacagaggagaaagatctaaactggaccaatttcatatggtcattgcctctggcttgtggctgatcatcttgttctttggaattgactgtctcatgaaatagtgagtttcttgtcaccagagagatttaagcaagagccatggaatccctgtccccagcactgagaaggaacatgaaccatgtattccctgaatgtcttattccttaaaaatcctgtgattctatcaattgttttgttagagtttgtggctgacattgattacactatgagtcatgtgacattccatgttgatgtagttgccaaaatgctcgccttcctgggttctgctttcattagtttgagagaggagctgagccacagaaaaggggctggagtctgctagattaatgaagatttgggatgtgtagtctgttttcacactgctgataaagacatacccgagattgggtaaattataaagaacaagaggtttaatgaacgcacagttccacatgactggggaagccttgcaatcatagcagaaagcgaaaggcacgtcttacatggatggtggcaggcaaagagagagaacttgtgcaggggaactcctctttataaaaccatcagatctcatgagacttactcactatcatgagaactgcatgggaaagacccatccccatgattcaactacctcccactgggtccctcccatgacagtgagaattgtggtagctacaattcaagatgagatttgggtggggacacagccaagccatatcattccgccccggccccttccaaatatcatctcatcacattccaaaaccaatcatgccttcccaacagtcccccaaagtcttaactcatttcagcattaactcaaaagtccacagtccaaagtctcatatgagacaaggcaagtcccttccacctatgagcttttaaaattaaaagcaagttagttacttcctagatacaatgggggtataggcataaggtaaatacactcattccaaatgggaaaaattggtcaaaactaaaggctaaatgcccccatgcaagtccaaaacccagcggggaagtcaaatcttaaagctccaaaatgatctccttttacttcatgtctcacatctgggtcatgctgatgcaaaagataggctcccatggacttgggcagctctgcgtctgtggctttgcagggtatagcaccccacctggctgctttcactggctggcattgagtatctgtggcttttccaggttcatggcacaagcagttggtggatctaccattctagggtctggaggatgggggccgtcttctcacagctccactaggcagtgccccagcaggagttctgtgtggaggctctgaccccacatttcccttccacactgtcctagcagaggttctttatgagggcccccgtgagggccccactcctgcagcagatttctgcctgggcatccaggcatttccatgcatcctctgaaatctaggcagaggttcccaaaccttaattcttgactttgtgcaagctgccaaggcttggggcttgtgccctctgaagcaacagctcaagctgtaccttggccccttttagccatggctggagtggctgggacacagggcaccaagtccctaggctgcacagagcagggggaccccaggcctggcccatgaaaccattttttcctcctaggcctccaggcctgtgataggaggggctgccatgaagacttctgacatcccctggagacattttccccattgtcatggcgattaacatttggctcctcagtacttatgcaaatttttgcagccagcttgaatttctcctcagaaaatggatttttcttttctatcgcattgtcaggccacaaattttccaaactttaatattctgttttctttttaaaactgaatgaatttaacagcacccaagtcacatcttgaatgctttgctgcttagaaatttcttccaccagataccctaagtcatctccctcaagttcaaagttccacaaacctctagagcaggggcaaaatgccaccagtctctttgctaaaacagcaagaatcacctttactccagttcccaacaaattcctcatctccctctgagaccacctcagcctagatttcgttgtccctattattatcagcattttggtcaaagccattcaacaagtctctaggaagttccaaactttctcacatttcctgtcttcttctgaaccctccaaactgttccaacctctgcctgttacccaatttcaaagtcgcttccacattttcagatatcttcacagcaatagccccctcctggtaccaatttactgtattagtccgttttcacactgctgataaagacaacaataccccactcctggtaccaatttactgtattagtccatttttacactgctgatagacactgagactgggtaaattacacagaaaaagaggtttaatggactcacagttccatgtggctggggaggcctcacaatcatggtagaaagcaaagacatgtcttacatgggtggcagcaggcaagagagagaacttgtgctggggaactcctcattataaaaccattagatcacatgagacttattcactttcatgaagacagcacaggaaatacctgtccccatgattcagttacctcccactgggtccttcccatgatagtgagaattgtggaagctacaattcaagatgagatttggatggggacacagccaaaccatatcatgggggtagagttgagggaaggagagaacattccagggataggaaatagcacatgcaaaggtcctgtggcatggcctttatgtgtaaaggagatattgataaaccttggtatgaaagactgtaggtctctgggtgcaaagtaatggctgagcatgaagctgaattagacttggccactagcttactttgctgttgacagaatgttggtacagattgagcatccttaatctgaaaatctgaaatctgaaatgtcccaaaatctgaaactttttgagtgctgacatgacaccacaagtggaaattctacaccttacctcatgtgatgagtcacagttaaaacttttatttcatgccccaaattatttcaaatattgtataaagttacctttataggtcatgtgtagaaggtgtatataaacataaatgaatatgaagtttagcccttagtcccatcctcaaagtatctctttattatatggagatatttcaaaatctgaaaaaatccaaaatctgaaagacttctggtcccttatatttcaattaagggatatgcaacgtgtacttctgcagctgccttgagaatgcatatcattgaataatgttagtgggaggttttaaactatctgaagatcacacaactgtgagagcccagctcccctgaaatgcgtagggttggtcagtgattttgctatgcgccaaagcagctgccttgatccctcagagccccggcatttctgcccggggtttggccacccctggccttggctgacttctcatggatgcagcaaaaacccagtaggatgcacctctcaagtggttggcagcttttactggacagctttagagtcctgtgggttattctggttgttgctattcttaaatattgagtgtccaaaagattcgtgaactgcatctcagctgggtgggaccctttgggacaggagtaggggaataatgccgtcgttaactgcaaagaggagttttgggaccaggttgtcttataggtttattttgaacaactgataggcttggtattgctggaagtggatagatttgggttgcctgtgtctagcaggtggcttccttttccagtatgttgcccactggtctcatctatcagactcacttgagagtatttcattattcatctaataaaggagtatgtgagattcccagaggaggaggatctacttctgtacttgacctgggtgaggaccactgggaacatttgcacctttcaccattgcaaactttgacatgtgagagtttccagaaatacagagattcttattttaatcctttttctttttaactgcagaagggaaataataatgggatagaataactgcagggagtagagagatgagaaaacattagaaaaaatagtacagaagtagagctggatgagaatccaagttatgagaacctattgatgagaggcatgcagaaataaaaagcccaaattcagtgatctaaatcagggctcagatgaggctgtttgtattgcacggtaggaatatatccagaaacagtgggccttttataaattaagcctgccattctccaattgcttaagacactgaggcccatcaggccagaaacatatgacccactttttctgagaaggaactttccctttaggagtggtaatttagaagaaaagaacaagcccaatgaatagtcccttatgggaggcatctcagcagaggccctttttgggggcaggagggattgcatagcaatactgcctacccagagttgttgttcccaggctagggtccaactcagggcagggagatctactggaggcagcgtatcacacactagttgtccaagagatggagagagagtgcaaaatctgagctgtgcttatgggaagctcggagtctcacaaaactacacccatgctgcccatggtttatgtttaatgaatgaaatgatgattaagataggacaattggacaaaaaggctgggccttcttaggtgggtattgagtgggaagtgattcaagaggccagacattctgtctggacattagctggaagtggggctggacaagatgaactagagccctcttgtggtcccatcattcaggcctgtagctttcatttgagaccagtggttcttaaacttttgcagggatcagaatcacctggaggacttgctaaagcacaaattgctgggccccaccccagcgtttctgattcagtgggtctggggttgggactaggagtgcatttcaaagcactttctggagatattgatgctgctggtcctgggaccacactctgagatacagtaatctagaccatgaaggaggtctggatcctggggagggaatccgctttctgctttcttaggcactaggaaggcaaggagatacttggggctggaaggtggcaggggagcatggaagggaggagtccttgtccatcgtgtctcaccatctgaggagctgtcatcctttattcatcctgcccttctgcttgccctcagtctcagaaattccaaaagacagcttatgaccctgcatttttggttaaagaaaggagggaactgaactgtctgctctatgaattctgggctagtggggatcatggggattttgtaaattattttggtagcccgttgagttttgtctcaggatttcagcggaatccaaaccatgtgacatggaccattatcattcagctgccacctcctggatcctgccctgtaaacatgcccaggggtctctgaggatggatgcgtgtcattcacacaccaagtgtgttagagacaacagaaaaccttgtttttttcctgtgttctggtgaaagtcttttctgtctttccctttgtttcttcgagggagcttgagtggcaggattattattaagagtactttttaagttcccaacaattagataggaaatgaactgaatgggagttcacattttatcttcaggaaaatgaccgcaagaaggccttactgtggggtggttaagagcatggcctggctttggaatgcctggattgggaatccttgttttgtcacatcatcgctgtgtgatcctaagccagtgatgtgacctccctgcacttcaatttcctcacctctaaagttgggataatactacaacttatttagtaggattgctgtaaggaccaaataagataatatagctcatgcagttagaattggacctgtcacttacagatagaaggcaatacattttagttcttactgtaagactgagacatccaaagacgtctcatactgtaatgtgtgatatttatgtatatgctttttaaggactacaatccttagtttcctacctactcaaggttatgttttgtagatgctaacagtgtacattctagagaaaatcagctggagggaggaaaatggcacagttctaaaattctttaagcctcgtttaattttttacctgttactgctttcatcatcacctctcactctcattttctaataagcctgaaaagcatgatggagtcataaatcatgtctgtaaaatgaagatgtgtaggctttggtaagatctcacatgtgatgttaataacaataccttacatatctggcctcacacttcacttaaactgtcccatttaatccctgaagtggtctcattagcttctgttagtcccattttacagtttgtacagtggagacttcagagaagaacctggcccaggctccacaggcagttaatgacagagctgggatttttttttgtggaggaataggggagacttttctggtaaagaccagaaaacctgctagacaaattctaaaagagccataacactcagagctgggattttaacttcatcttctgcttcagggaccacattgttcccagtgtgtttaaacccctggctggtttttcacttggggttctcattcagattcgtgattctgtttactgagagatgatgtcccagttactctagctctgtaacaaatgactccaaaacttggggctgtgaaataatcattttattttgctcatggattctgtgggttattcagactcagtgttccatgatatttggggcctcagcaggggtgattcaaccacaggagctagagtcccctggggtgtctttgcccacgtgtcccacaggtgcatggttaggacagggacctcagatgggctgtcatccagaacacctacgtgtggcctctcaatgtggtctttctgcctgggctgacttgggtttcctcagagcatggcaacctgattcctagtgagatttccgagagagtgcggttgtctggcacttctgtgatctggcaatagcttcaaggaaggaaatatatttttacattgaaagaagagaatatgagccatgtgtgccaggtacggggagccacctgtgaagatcctgagtagaggcttaggtcactgtggacacagtggcagcagtggacaaggacaagggatgccgggtcatgcattcaccccacaaatattccatctatctctgaactaggcagaatgagcagggcaccaatctaatggctcttctggataatcacttcacatgggaatcctaggactccatattatattcttatcctgttgaaaatttgaccttttaaagatttatttatatttagctcaggccttaaaagttccatgtactatctaaaaagggaaaagttcatcccagtcaatgtcctgtcttgcttatgtttaagttggataggaagaaaaaaatccacaccaggagaagattggttgtaaaagtttattttacatttatgtgaagtttatttttggttctgatattcttcatagggtagatatttcttttaagactgttaatagtgtatttcctttttatttgccactccccaccaaaataaaccctcttttatttttgaatcagcttcatatcttcagaacgtccaactttaaataatggttggagaagctccaggttaagtagagagtaaaatcctattgctttctgacctttgggttaggatcaagtgtggtgtaataaaatatcagtcccaagagtcacctttgctgatttttttcctattattctttcctgttattccatattcatgcaggtcttgcagccaaggattgttacattaagatccaatctgaaattaaaacttatggttttaaccaataagctataaagctgttgaactcccactgggatgtagttaccttttcctaaacttcctgcattgtctccttttagccccacagttgatttcttattgagcctttggaaagttccttgccgtttcacagccatttcccgtcagagtggggaatattgactgtgcaaaccacttaaggtcacaggcgccacagctgtgtttcttctttgcagaaggggggtttctttgggtggggctgtgctcagcccttccgggtggtgaaggtctgaggtcacactgggagagcaggtccatatcgggattggggctccagcaggatcagaatgacttcacccagacttctggacctggaactcattctcagaaccttccagaagaccctgccctggaattgctttcaagggtctttttcatctgtgtacagagtatatttccttggaggcagctttgctgaaggccccttgagtcaagggtaatagggtgggagcagctatacacagttgcatttcagtgtttgatgataaaatggtgtccgttggtgagcatcttggtggtgaggaagtttatacgaccacagatgcttctcaccccaaggtacccgtgccctgtgctgctggtgccactcatcctagggcattcctgcttggcagtagcagattctagattgtcctgtttgctggtttgggggctgcaggggtctgcagagtgccgcaaggaggaggagtcccagatcactggttgaccttcagcgggcatttaacagcatattccatcaggcctcacctactagtgttttgttgaggctgctgtgtaactttgactttctctgctgtctcctatttaagagtaaataaaggtagtgacagtcacaaaaatagcatcaatgatgacaactagcgtttactgagtgctgactatacccaggcaccattctaacctctttacccaagttgtctctgctagtcctcaccacagccctgggaagtgtgtgctgtcatatacccatgaagaaactgaggccaagaaaggaaagcagctctgcccaaggtgttataagcagagagcaccaagacaggacccaagcccaatttgtgttgactggggaatcagtactcagttctcttagtctttggctgttttgttgagtgcccaggtcatcctggtagaagggagacagtgacccacgtgaaaaaggatggctacagatgcatggctgcatggctgtgcatcatccaccctggagtatctgcttgccaaaaatagggctacctgcaaaatgctttgagcactgtggaaaccagccgttacaactccaaacgtttatttttctgataataggtcaaggttttcataattgagttttaggggggctaattttagactttctgaaaatcagtctcaagaaacaaaacccagagtcaagtaaaaggatgcttttggaactgatgattctcagaagaagccatgaagggctcggccataaccccgggaaagctcactggccagcagcctggagccagtggagcttcaggtggctttaattcttccctggatgctggtggtctccagagacacaggggtaaacaggtcagcgtccttgtcctcaagggcgtcatcctccagggaggacatagctggtaatgacaaaatgtgggccagcgccttcttgcagctgggcacacagggctaggggaactgagaggagaaaaggatgaatttggccttggcttggagcagccttttaacagaaacacgcgtaactttcctgcagatgcacttcctgtgaatgaagagtcttgatatatatttttctttaacaagagaaagccaggcttttgattaataatttatatgtcaatgttgggatcttcattttgttatgagagatttcagttacaacagtgtgaggtgggtggtcaggaaacattccccctgggctcactttttgcttagaaaagtcctgatggaaaggttgaggtgggaagagagtgagggggaagactccatggagcatgacaggcatgctgtgcctgccacagccaagcatggaggtctcaaccataatgtgtttttgagacaggatctggctctatcgcccaggctggaatgcagtggtgcaatcttggctcactgcaacctccgcctcccaggctcaagccatcctccctcagcctcccgagtacctgggactacaggcgcaccaccaccatgcctgcctaattttttgcattttttgcagaggcaggggtttcgccatgttgctcaggctggtgtcgaactcaagtgatccacctacctcggcctcccaaagtgctgggattacaggcatgagccaccacactccacctccaaccacaattcttgttttaaaaaatgaaaatagagtgaaacagaaatggtagaatcaagtcaccttgctcattcacagtcatgtgtggctaggacaccatgtggtccagtctgacacaggctgatcctttcccctcaggacccatccttggggtcgtccagtccttgggctctgttcctctgatgtggcacaggtggtcagtggggcagggaagacagaaagatgagggccacatccacagaagtcatttccttcctgtggtacagacatgacaccaccctgtgggatgaatggggattcccatgtttgctagttacatatggccaagcccttcagcctttctgccccacttccagtttctttcttgggtgggaatgccttgagcctcagttaattgtttgagttttcttgagtataaaaggaatcctggctgggcattgagtgaatacaatcataaaacccaaatgatgctgttggcctcatctgagctgagagtggtgttggcaccttcatagctgacatcaaatggatctccaagcccaaacactaacagtggaaccagctattgctgcttctggtgtatcatccaaatgggttttcccagccatcttctggtgcatttctaacatacccttaaaaggcataaaaaagtggcatagatgatggctggaaagattaagttctttctggtggcttctttaattttggaataaccagccttccttcaacccccttacatgcattagaaacttctgaactgtttttgttctgtttttaattaggttgtggtacaagaggagcaattaataaaaccttccatttccacatctactgtgaaactctgtgacttcttcccgtgtgatgatggctaagtgcgcagaacatgtgaaatttaagtagatttgtggaaacagaaacacatttttatttagtcatgagcgtcacttggagtagaaatagagccctttatgattcgtgtgctggtctttcttcctggagggcttcagtattatctcatgctgtcatctttatgttgtattggaaaaatctgggattctttttcccttggtcattatttgctttttaaaaaataatgtagttttaaagaattcttgctatttaatctcaagcccaaacatggtttttagtgaggaactgatacttaataaagtttgatatttttagttctagaaagaattgttttggggggtgggaggctgcagttgagaggtacaagaaatgttcaatgaggggaagacactctactgtggttccatttgctctttgaaaacttgtgtttctgttggaaagaaaggtttgattttggaagttttaaatgtactgcatgatgttgctaaattttagttcgttgctgggaagttttggatgagctcatttcataaggatttatgtgccttataggccagtgtggggtaaggggtggagaagcttgcctccttcagaagggtcttcattcctagagggatatggaatgacccactgctttttggtgggaaacgtaaaggccagtcagcttttggatgaattttcaaggaagacagcagctgtccatcttcagtcttgacttgccattcccttagggagttccttcctttcacccatctttttctccccatggcttggccatgccacagtggtccctcggcttcaacagtcttgcttgcttacatctactaactgggcaagagagaccattctcccattggccctggaccaccactctgatttggatttagatgggctcaggaattttgtttggaatccttttggccttaaacaaaataatgatgagagaaatctgcctcccataagtcataatctcagcaggctcctgtgtctgagctatttctgtatccaggtccccaagagggctacagggaaaacttcatcatgatgggagggaagaaagaaggtaagtcctaagatgtttgcttcctattccttgtaaggtttagccatgtatagtcatgtgccagtcacctagggctgagaaaggggagcaagcagagagggagaagaggaagaagccaaatgagatggttcgtaattgattagtggaagttaaataatgttaaggataggaggcttgtcccctccatcatgatttagtatatcatccttcccaagagaagttttgagaacttgtcctctggtatccaggaaatggcctccccagcagtgtgcatagtcccagggaagccgtctcatgagcccctccttctcttgactcctctcctaatggtcacatggtgccaccactctttcaagccaagtcaaattgcatgcagcagaaaacccaaataagtttatgcagtagaggtttattctcacaccgaagtaattcagcattggtatggtggctccatggacttcaaggatcaaggatcctttcctctttctgttccaccatcctcagaacatggcttccagtttcaaagttaccttatggcccaatgtggctgttggagctccagccatcacatccaaattccagataggaaaaagaaggaagagagaagattacaaaagaaaattatctcccagctaatttgtctttatttatggagttttcctggaagcctcacattatggtttctgcttgtatcttcttgaccacctcttctccaggggagactagaaaatgtcttttaggtaggcatattgtagattggaataaagttgagtttggttaaaagggaaaagtagagaatggatattggttaggcatatagtctctgccatggtctagaatatatgaagaacctcatgtgtgaaccttaatatattctgccaaatattctgtttataatatctaaccctcctatcagatcctaggccatttggaagccaggagcttatcctctcctctttgtatcaagccaggggcccacatgttggagttatagcccatctttgttcaattgattcagattcagcccttgcctcccatatccctcaccatggatatgcagttataaatgatttcttgttaagcatttttaaaaggttaacttcttcccagagagcttttacataattatccatttaatgtgtttttaatgataaagaatctaatagttatcaataatgttggaaaagtaattctaggcatgaaaattagcagtatggtacatatgaagtacataccaagtactacctgattccagatattaggaaaacaagacagaagggtttcaccactagtcagtatcagtagattgttggggagaaatctttatgaaaaatgccacttttcactctttttttcaagtttgaactgactgtggaaagatgggagatgtctgagaaaacttgtgtcagtacttcatgtttgtaaaaggacagggaatccttctgaaaatctagttacataaatttatgttccaccacaagaaaaatcagtggatggctggaaggcggggctttcccttttgctctggaagggaaggaaactctgacagccagacttctcagtcggaaagtgtctttggtgagccttactatgtgactggctgattcactttgtccgctaagtcttgggagaggtgatgtaaccagggactgcaacttctagggaaaggggaaaaatcactgttggccccaccctctagcattggaagcttaacagggctttggcccacagcagatggaagtttgagctgtgttttgtaattcttttttaaatgttcgccagagcatccattattcttcctcattttctcttctcctcttccctccttttcttctttcttaccttttctcttttttatcctggatgtgctcctgtatggccattctaaatcaactcaggtctgacctttggaaatacgtacagtaataaggaatcctaggggcttcctgctgtatttctgtttttgaatttgattaacatgagctaagaggttgagtagaaagaacttggactttggtgtccaaaagacacgggtatgaattctgactctaccattactggctctgtgactctggacgagttgctttacttctctgactctctagaatctcacctggaacttgaggttaattcctgcttcaaagcgttgttaggaagattgaacaaaataatgtgtgaaggaaaacccagcgagagggatgaagagcagagtgtgctgggctacataggctaaactaagaagtttggattttatttacagtgctctgggaagcagggaagtgacctgatattgtagatattttcaaaaaatcactgtgggcctgtggagtgaatggaggacaggagctggagtggaagcagatagcccagctaggaggcaagaacagtggacaagacggctggactagtgtggtcacagagggaacagacggaagcagtgattcttgagaacttttggaggtaaagacactaggagtagctgaagtcttagatgtgaaaaagggagggaaagagaacactcaaacatggatcttaggttgggtcttgagcgcgtgattggtgaggactgtttgacagtgtagcccaggactgtgcatggggatgacacccacaagatgttggctggctggctggattcatgactatctggaggaaagagagaatgcgtgttcttaggccatgttggatgctgaatgcagtgggacagacccggttctatttcttgctttgaagagattgtgttccaattatctgccctgtttagatggcagcttccagaatcaagttggtcagttttgagcaagatctggaaagcaagacaatgtctcaaaagcatcaggacccctgatatccaccttgttaacaccgtagatgacttcggtgccctccctgcagccgtctgctttaattgtcagaacaaagtgaaagcgaactcagagtgggacttgggatgggctttggaactgagcagcattctcaaagctgggtgctgtagtggcatgactattacaggtggggccaggaccccacttccacaaaattcaattggatacatctggtaggaggtgttcacctggaaatctgggtcttaaaccactttgagaaacactgtcctggaggtaagcagcccctgttctggttctttttcttccactttttaaaaaggaaatcagtttggtggcaaaatctccccttcctgtccataattcagactacgacagcaattagaggcaggcagcctcccctccaaggagaaagaaaccctccacgtgttttatgagtatattcctaataatgacaatagcagcaaacaaacaccatagtggtgatttcatactcatgaaattattgtcatggagttagagcctagataaaagtgtttggcaagtctctaaagcatatttcaagagaaaaaggaggccagaatttatagaatctaaaaatagcagttgaagtgcagctgtgtttagcttgtcagagaacctgttgagtcaagatgggcaggggattttatttctctggccctgaggtcatttgtcttgtttaagaaggggcagcaaacatttccaaatagggattgacttttaaggggaggaagatggctaaatgtatatggtatttcttgttttctgctcttactcttcctacctccaaccccattccaaatttcctcttaagaaaaggaaggagagtttgtttttctcagtagagtaagtagtgactgcctaggtggcaggattttggatggtagtggtgatgttacttattgatggcacatttgatgactgttagtccatggagtggtgggggtagactaactatctggtcttagtgggttctgtacaatcccattaagttgaaggaataaacctgtagttggagaaataacagtgtgacttctccaagactgattggctgatttttggaccctctttgtcccatttctagtcaggaattatgtcttctactgttccacaacccacaaaagaagatgtctgttccacttctggcctaagcaatcctcaagcctctatacttaacaacattggaatgtcaccatcttaaaacttgtcaaccagtaggccttcaaacctcctgccctttaatatttattgaaaccttggtggaaatgaattctgtttttggtggagtgcgtgaagttatttccctccattagtttgtaggccagaggttgaaaactagtggcccgcaggctgagtcttcctcaccgtcccactttgcttgcctggcaaagtgttaacctatacaattgccaatattggaaaactgggatactttgtttacaaatctttatttctggattctcctgggttgctctaatatatattcttggtttagatttcttttctggagaggtgtccccagactgctgtgcataggtccttgtcctcccagagtagctcacctgtgggtcatgatgagaaatagccactgtattttatttgaggataataagaaaggggttaaataaattgtatgttgagcacctagaaaacatatgcatgtgcatgatgagcaccctgtaagcattagctattattgctatcatcatcagcatcatcatcatcagcatgtttaatgtattttctgttgagggttccattgaggacattgttcatgacataacccaatgtcttatgaggcctcatgaaagacatgtctgtcagatctcagttccagaaaatagctgtccttcttctgaattactggttcatctgtaccttactcatgcccccaatcttatttctatctttgcactagctttgcagaagctcagaggcaactatgtagttcatgtctagcaggaggacttggattcgatttgttgatcccttggtttcacatgccataatttccttgcttctctacttttctcacttattttgttgtgagcattattgtaagcagccttaaatcctgttggaacaaggctgggtgtaaattaaaaaacaaatcaagcatccattcctctgagaggttatataatcactgagaataggcttccacatcaggacaggtttcatgtcttagccttgggactacatgttttctctttcccttctggacactactgacctctcattgtcatgttggacttgattctatcagttgtgctcatgctttcccttgaatctagataacctgtaacttctgttacagaatgagatggcttatttccctgggtagactgactgtattagtcagctattgccacataacaaactgccccacaactccatggcacacatcaagaagcatttatgttctcatggatctgtgggatggttggacagttctgctgcaggtctgcacgttggctggggaagctgttctccatgtctcttatctttctagaaccagttggctactggggcaggttcttctcatggtgatggcaaaaattcaagaggggcatgcagaaacatgtgagacctcttaaggggtaggctcagaactggcactatcacttctgccctcattccattggccagagcaagtcatgaggcccaatccatcagtagagtggggaaatagagtagaaatagatcagcctctagtgagaggaaccttagagtcaatgacaaagggtaggagtaccaggtggtgggtagggggcagctgataagtaatgcagtctagcctgtaatcccagcactttgggaggccaaggcaggtggatcatgaggtcaagagattgagaccatcctggccaacgcgatgaaaccccatctctactaaaaatacaaaatttatctgggcatggtggcatgtatctgtagtcccagctactcgggaggctgagtcaggagaattgcttgaactcgggagacggaggttgcagtgagccaagactgcgccactgcactccagcctgggcaacagagtgagactccatctcaaataataataatattattattaataataatacagtcgatcacaggcagtgtaattatttgaagaccataaggttgggcatacagcatagagtatctagcccttagtggctatgttggctattctctacttcccctctccagatccattctccaccattatccctcctgctttgtgcccttgggaggctgaccttcccctctgccttttagttgggttcagtcagaggggagcactggaaaaagagggtggaagagtggccagccatagtgaccatggctctctacggaaggccatagcttctgccaggtggttagttctaataacttaggggttccagtgaccactccccaccttgctccttccgacctagggcattaatggctccctgctttgccacaggggtctcttttaaactgaccccccttactgttgtaaatagtcccttcagtgaattctttttgtctccctggttgaaggaaacatctgcttctggccaggaccatcatggatacagtaggtgctcaataagtgcatggttgattagcaggcctccttgtttttcctctcctctggcctctacatcactaaatggtcacttctcttctagcctgaagagcccatggaatgtcagcttgggaatccctccctctttccccataacttgtccaaccaccatccctctcccaagaacctggcacagtaaattcattagagcgaattcaaataaataaggttttacttttcttctttgggatttcttagcatgcccgttgggacaattagggagggattctttcaagtacaacattttctctagcaattatgggggttttatctcccagatgtgatttatgccatattacattccaagaagggaacatgaagaatgtttgtggctaaagaagtctcaacacaaggaaactacaggtgaaacgtaacaatagtaattgccttactttatttgcgaaggggtggtgaacactaatatgcctgactccatagagcagtgtatttggttttcttaagcaggaagaagggggcccccccaattttaatttactgaatgagtttaagaaccatggtgtatttcccaagcttcgctagtgaagatggtattttgttaaaaattgagattcccattgatccagatccagttgggcctgggaatctgttttcaacgtgtatcctgagtcatatttgggaagcactgggctctgcttatgattctcacgttctggtctgtgactgaggagacgtgccatgatgagagtgatgatggtgatggtggcagacaagagcatgtcacatttagaaatactgtaactggttgctgaggttttacatatattctttctgagcttgttttgtctaatattgcctgtgccaacagtattttaccagaattgaatgaaaagaaaggtaccagcagatttttttagatgttctaattgataccagaagcaaagacgtagaaaccgtcatgttataaacatgaaagccccaagcaaacagcctttagcccaccctttgagaaccactacatgacttcttgataagattctttcaactttaccctatgcctggatcatgaaagaggtgtttctagaaagctctgcaaaggactttctctgacagacggctctaggcagggggaagctctgactaactgatctctggagaggaacacagatgttccctcctaaaaaaggacatgctggccttgctttcttacaggtcacgaagtctcttttaggaatgccatttggcatttcaagtttctgcagcagttctgcagaaagccatgcctagaaaatttataattactctgataccagatggctttgcggccttcagtatcaaatgcattgtgattgtgctatgagaattttggggggaaaattccaaactttattaattattgtattggggaaaacatcatgttattgaattttaattagagttgctgggcagcctgggctgccttttaacttacgggtcacctggttattgcctgtgaggctcactgaggaaatgtcttgctggcaaagctgagttcgctcagaatgtggactgttccatttttctgttgtccaacacttgctttgtttgtgacatttagctccttttcttcctttccatcccaaatccacaccctttcttctgtcttttgcaaaatctatgacactgttgaatgaataatataagcccaaggacttggagggatgagagctgtgatgcccacatgttttagtgttggcatgtttccctcatttttggggatgccttgggttgaagctgatttttcagcatccctggtttagcatatgttgcattatgtatctgggaaagtagcatatctattttctcattttgcattacaatagcatctagtaacattcaagcctcaattaattgaaccaataattattatattaaaaatggtatgtatgccccaggacagagattaggctatggtgggcatttgagaccttagggccatagaccccgaaacatgcattctccagaactgagtatgcaactgtttgctttcgaccttacagcacaggctttgggagaaaacagttaagttcaggtcctaactccagtaatgaatttcaagcttcttgttattgtttttcttcctgaaagacaaagggagttttatgccatggtattttgacgacaatgttgaatcaattgttatcagatgggaagatttctgaatgctgaatagtttgtaatatccttcaaaaaaccaaaccaagaacccacccacccattcaccatttatctctccatttgtccacccacccattacccacccatccatccattcacccatccatttcaacattcaccagttcctacaaggtactgagtactgcatttatttgctaggggtgcaaaaataaagtctaataataataataaccatcatttattgagaacctactatgtgttgagcagtttccaatcttcaaagcagttttgtgatgtaggaattatgttctccgttttatgagagaacagaagctaatttacttgcctgggtcaccaggcagtcaaggcggagcaggcctgaggcatccttgcaacattagaaccagaacaacatttcattattttatgttaaacggactctcctgcccggacccaggcccacgttagcatccagagtggcatgcagtggcagaattggagctggaacagccctcatttgttgtcttctctccttgggaaatcttcctgctatcagtgaaaaagggagagggatcagctcttgtttcttggctttgctctttacagcctcttagaaacttgagttctatctggattcatcctgtcatttgatggtacaggagtacaaatggaggtccacttagcgaatatctaaatatttaaagattacaaatcaaggtaactgttcagtaaactgtgttccatcctaccttgacaaatatacctttataacaacttggaagccctaggttgaattttgatttctcaggcctctcagagtttagtgtagaaatggatggcttggggagagccagcccccagcccacccccccacttccctttccatctgactccatcccgcatggcaatgggccttctgtgcatgcgtgtgtggacacccatccaagcttcgtccaccccctccccacagaggctgcccttggacctcaggtagggtacactcactcatggtgcactttacagtgcaggggacaaaccctggagtagagcccaacatggaccctgaaggaggacttagggctgttggggcagggatttctgttgtcctgggcacacagagcatatctgcaagagggagatgtggagactgaccttggtctcacaaactcattgccccttgcaaagaaataaccaggagggtctcctgagaatggggttcagagtaagggcccctcttgcctgggtcttacccagggtgataccatttctgccaagtcagaggatgaaagggacttcggcggaagccatatgacccacctctgtcattttagggagactgagcatggctggtaaatctcagtgatggctggagccctgggggtccttagtttcctagcaagtgccctgtcctgctcttgcctttctgagcatcatcctcgtggcattctggagcatgaggacccaaggctgggtctgagtggatgactgtagttacgtacacaggctctgctgcagggacaggattacagaagatgtttacacaaagctgtagctttggaaacaggctgtggtgcatatcttagcagccccactgaccagcttggtgatttttgttcaactggagccttggcttcctcgtctagaaattggagataaaatggtatctgtaggtagagttgtgtaggtggaagatgagatgtttgtagaaatcttcatacagcacttggctttcccaaagggaacatcagcgaattgtagccactgtgactggagctgctactattgttcaccaggtgtcctggaccccactgagaagacgctgccattcgttcattcactgattcacccactcaaatattcatagagcacctatcatgtgcaagtactattctggtagcatgggacttaccagtgaacaagagaagcaaaattccatgccatagtggagctaacatcctagcaggtagaggcagagataaaccataaacataattaacatggagatatagaacatatggaatatagagtatggaaacacgaaagctgataagtgctatggaaaaaggtggataagggaaaggggtttggttgacccaaggtgggctgtaattttaaatagggtggttagggtaggcctcatgaaagaggtttttaatcaagaacttgaaggaggtaaggggagagaaccatgtggagggatctgggagaagagcattccaggcagcggaaacagccggtgcaaaggccctgaggcaggagtgcctgttgttccagggacagtcaggaggccagtgtgtctagagcagaatgagggtgtaggtattaagagacgaggtcagagacatgacagaggcctgaccgtgtagggcctagtagaccattgaaaggacttggcttttactcattgcaaagtacggaggggacaaatgacatgaccttctgcatctcctcccacgccttgggcccgcaggctgcctctgcactgttagtcctccctgacttcctgccccaggctcactgcccccatccatgttgcacacccctctctacctgcagccgccatcccctaacaggtagaggtgtgccctgggtccactccctcaagtcccagctgcattaccagccaaggatgtgatgcatagtattctggagctcctttttaaaaaggagttacattgctttgggagttcaggacacaggcagcctgggggtgcttgcttcatttctgaaaaagcaggttgtggccaccctttcatgagccttgactctactgggctctccctgctccccatggagcctcatgctgtcctcaggccaccctagccccctgttctcctggctggctttatcccgctgagcagtgggacagaggacaggaagatgagaggaagatattccagagctgggtggagagtcagggtggagtagagctgtgtgagggtgtgcatgagggagccaacaggaaggagggctgggttcttgttctctgaccaattcccagtcatggctctcccatggggtttcacagctcagtccgaagacacattgttcctgtgcatggtgtagccaagcccaaatatttagctacggccacaccagcccttgttctgcttataactgtggtgtagacctcagtccagacaccctccaagagatacccaccctgccccttggcactggcttgggcggccttgtctggtgctggaaggctctcttgggttctttgccaaagttcagatgtccccctttcccactctgtgggtgggccctagtgggggatggatgagggctaaggcatgctttacccctggctcccaggcacagagatgagggtggcctctgggtcagagggcttcctgttgagtcagagcctccagccgatatgcctactgtcccacccctactccacatagatgcagggcaccctgcagctttgtttcaggaggaactctgccagtggaaaccccatgtccttagcgcagccctgggggttatcagggtggctcagatgcaggaagtcctcgcctctgctgtcctgctctgccccaccctgtcctgcagaggggaggccctgcccatgggagagtctgcctccactgggcagtgctggcctggaggaaacttccatgccacccctcctgcccctgggctccagggctctcgatttttggggtaaacagaggtgctgggctctgctgaggataagctttgtgatctgggaaggatccctttctcctcattttttccccacctccttttcatcatgtctgtgtgaaaacgaaagctattgtttatgtaaaaggaccatttgcctaatgtccctggaatttatttgctggagcattttccattttcatattcagtttagaccttggctgaagtagggaggttatgtaactgggatggaacaaatcccattggcatctggggaccctagtgtaccccacccttagccattcctgcagtggactgagtgcccccctggctgtatattcaagtcgcctctgtggctgccagagttggggagctggggagctggagtgatagagaaggagttggcagcatttagaatggagtcaggaggaagatttctctggggggttggattcatagatctgctttggggctgtctcctcctcctcagctgtagacctcgggggtccagactttccttgcacacaaagcctaggcctttcctatcagcctgtctgtggaccttagccaacagcctgagcctcactgcttgagccttggctggattagggaaatgtctctggcactttccttcttggctgtctgtggaacctgtctctacattctaacccatccccagcagcactggccttgagggccatgtttctacccctgattcccagcctgagcgccttgggtttctcctcagaagccttgtctgggtctgcatggaattactttgacaaaggatgggatgtttttctaggttatgagggcctggacatttgcctgcctggggttttaaaagaaggcaaatatatagagtgggttttggagccctgaacttagtcatgggtggataggggtgggctgaggagggggtgcaacctctgccttccctccccacgcccccatattctgagatggtagagaaccctttcattcctccagcctgtctctttcatccctctatggactgagacatctccctttacaccagttttttacttaaacatgcttattagcctccattaagaaaaaggtaaccctgtgtatacctgtattaacacaatgctaactgctgcaacaaaccctcagttttcaattacttgacctactagatgtttgttcattgctcatgtgtcagtcaaataaggctattcctcgttgaaggtagcttcctccacgtggtgattctgggactgcagttgctttccattgctgctgctgcaattccttaggacctccaggatttctgcctcctgggggcaggaggagaaagaagcagtggagaaggcacacccaccccttaaacactccagcctagaaatgacccacatcccttctaccgactttccattggtgggaactagtcacatggccacagccggcctcagaggaggctgggaaatgtgggtccaggctgggcaccaccttgggaatgactccacatatcagtggtaggagatggagaggagggggtgtacttgggaaacggcgaggtcaagtcagcagggtggattgagaatatgtagggggacgaagccaggagtccaaggaccccttgggtttctggtttggagaacagggtggatggtgcctctgaaggcaatggagttaacaggaagatggacgatgctgagagggaaggctcatctgtcaagtgcccagcaggggtgggtgctgtaagaatgttttgtgaatgcaggaatgaggagaaacagtagtgaatgaacttgagtcccttctgccaaccccttgcagctatagtggagaaaaactgtttggtagctgtactccatagcctgaaaccatagcacctgatgaaattggaccaatctgttttcaaatacaaagctagtagttagaataaccagggggaaaaaagcataatcagtagccccatgtctttgcacaggctgccataaaaaaaggtacagttgtttctcagtatgcatgggagattggttccaggattcccaatggataccaaaattcatagatgctcaagtccctgatataaggtggcatcgtatttgtatataacctacatatatcctcctgtatactttaaattatctctagattacttgtaatacctacaacaatgtcaatgctatgtaaatagttgttatactgtattttgggttttttgttgtattgttatttttattgtttttttcctgaatatttttgatctgtggttggttgaatccatggatgtggaacccatagatacagagggctgactatcccataaattgggtgggttacacaacagaaattaatttgctcacagttttggaggctgaaagcccacaatcaaggtgccagcatagttggtgtgtggtgtgggctctcttcctggcttagagacggccaccttcgtgctatgtcctcacatggcagggagagagagggagaaagctctctagtgtctcttcttatataccatcatgaaggctatgacctcctctaaaccgaattatatcctgaaaggcccatcacagtgggagttagggcttaaaaatgtgaatgtggtgttggaggacacaattcagtccacggcatccagtggcgatgtctccccaggcatagagtcctcttctgtgttgggtattgtctctctaagctgcggggaaagggaaggcagcagattggtgtcctggcccatccacttcaggtgagaaggatgcctgctgtcctcgtgtggacacaacttcctctgctctccttggccttggcctctttgctttaggatatgatgcccagaagggctcgaaactggcatgactcaggagtctgaccaggggcaagcaggctgcctcttgctcctccccagaaagggagagccagctgagggtgacaccttgggctgcagccacaggccactttgccactgggctcacccacgctgctgctgccacacgtggggccaagggtgacaaggttgccagggagcctgggatcggagttccagggccatctgagctctgggtcagcagcagtcattggagcagggatctggggaggcttttcacgtgggggttgttgagataggggtctggccccattcctgcctgactggcagtcttcattaatgtacgtttataccaggagcaagtggagctggggaggggactcacatctctgtctgtgggaagcagggcagagtgagggagagtatggcctgctttctagctgatatctccccttgctctcagcaagctcctctgcctcttcctttccttctggtaaagcataaggagaggactcaacagtaaggactaatatttgacagtgaggagcagatagagttttttaggcaggggtcactgttaaggaagtttgtatttttttttttaacttccaaataaagcttgaagtgtctgagaggctgcataacagaggtgaagggcacagacttgggagccccatggccaggatttgaatctgaactcttaggcaggtccctgaactgctcagccctcagtttcccgtctgtaaatggtgataacagtaccttcctaaggtcattatgaggactaaatgagtaaacattgatacagtgctaacaacgcttaatagagtacttacaacacttcacttaataagtgccatatggtgggtgttaaatatatattttggggaacggggtctcgctatgttgcccaggctagagcgcagtaactattcacaggcacagtcagagcccactacagcctccaactcctgggctcaagcagtcctccttcctcagcttcccaagtagctgggactacaggcatgtaccattgcacccagctaaatttttaaaaattaagtcttgttgaagagtgagtagaaaccagagtggtgataatttctggttctccctagtcatctccctcaagaatttcccagttacttctcctggaagatccgcttccttgttttgttgtttttgtttttgtttttgtttttttttgactttgagacaggatctcactctgacacccaggcgggagtgcagtggtacagtctccgctcactgcagcctcagcagcccaggcccaagtgatcctcccacctcagctttccaggtagctgggcagtgtcagcagctctcctatggccagctccaccaccaggtcagacagtacccttggcaacctgtggaccaggctggggaagaagaaaatctaggaagaaaaggccacacaaggaagaagtgcagatggcaggggattccggtggccagggaccagatgggagtccgaaagctacacagagcaaacaaccaaaattgaaagcaaacagactctgagttgagaaacctgttctccctatccagagcatacaattcagaaaatgccggaacagcataaacactgcaaaacaaatccagctatgtaatccctttattttagtaattagaggtggcactgggaatgctggtaacagtggagtttgactcagatccccttgacctcacttggcttttcctccatgttccaacaacttgttaagtctgcttctccattccattcctttcccggcgtggtgtttgggtttgtaggcaggatggccatgtatgcacaaagaaagctttggggcagtttcctgccacccagtttttatgaacattctctttgccccatgtgtggcagcagaaggcaatccagccctcagcctggaccgccgaccttgtgtgtttgtctccctctgtgcctaggcccgagaggccattagaagccccatttgtgtgtctcagcatggcaggaaggtcaaaccgctgcttcctggttggaaatggtttcttcattgattcatcaggtcagtcaagcatttactgagcacccactggagccagcattgtgcaaggtgctaggaatacagtgatgaggaaaagcagacatagaccttacccttctgaaagttccactaaaaatcaaataactgtgaacaaatgtccccttcctgctgtgatacctgccataaagaaacatgttactattaaagtataaccagatactcacatgtgacattctcttgttggttttccctgagtgcaaaagaggtggtgagtctttctaaatcctgagtcaagatgcttgaccacttattaggacttgaaaagagaaaggctacaactcagttttggacccttagtcccttatcaacatcgaaggtacagaaggattgacatcagagaggcccaggaagtttgacattggagagaggcgtttttggagaaggctgatgggctggggggtgttttccgacctgagccccttggaggagagaaaagggtgttcttcctccagcccagagaaaggaggagaccagacaggtctagctcctgagagctagcctgactttcttccagagtcttggagagcacaaagatgtgtgttgatgtacagcttaaaggggagttaatggagccctgagaatgtcctgctcccccggaggaggacatatgagtgcatctcagggtgaaagctggctaggagctatttaaaaggggttgtaccttaggtgaccctagggagaggtgatgggaccatacccaaaacacaaggggtctggggccagcggaggagaccttgttccctcttgggagttgcaggggagtgtcccaatgctcaggaagctccagggaaccttcagtgtgcctgaaaaaaagtcaacctggaatacccaccaagctaagggaggtcagcgtgcaatgccacaaagccacagaagtctctagagcgactcagctttaaacagctgccatggccagagaaaagccaacacccaaagacaccagttccaactaggtgtggcttctcctcccctcctctcctcccctcaaaaggtgttctaagcagctgctgggaaagggggtgagaggaagtgactgcagcttttttatctcccacttcccaccctctagcaaccttcaaagcctgaagtagggccaagttggaagaggcgaggaagtttaactttaaatgaaatttggagtttttcactaatacgcaggactggtcattttgatactgaatgggattattctggagattaaagcaatggaaagacttttcatgatctaagagtgatccaagagatagtgggacctgctcaaggtttcatccaggaggccagggagaaagggccaacctcagtatctaagggttaagggtgtgcaagagagtgcaatcagtattgcatttcagcagatcagccaagctgcaggataggtgacagatatgaaacgataaatgtggaggcagggagaccaggtaagaagtctgcggtggtctaatggtggaggtgaagagaagagggcaggctgcagaaaaggcaggatacgaggtagaactcccacagtttcctcatctctattgtacatagtaatcagggtctaacatagcttccctttcccacctacgacctatgaggtgcacctgtccgtagtaagtactcagtaaatgactggtgaatgaatgtgttttaaataaggtatatagtgagaaaagtgagcattggagtctatttcagttatgtgttacaataataatgctgcagaacaaactcaaaacttcagtggcatacaatacaaagcatatagtttgtgcagctgggattagcagtggcttggctagctggctctgctgatttgggcagggcttgttcatatagctaggggtcagctagctgttggttatctagactggcattggctggggtgactggggcaactcagcaccgctccatgcatatctcactgtccaacaggccagcctgggcatattcacgtggagactgagaagcacgagaaggcagaattgggcccttgataagatcatcctaacacagaggcagatgtagatttgaaccctatttgcaacagtcactaatcatgtgatcttcggtgatttattttacactttgtggcttaatgtctttatctgtaaaatggggctaggaaaatttatctcactgggtagtcaggattacataagagtaataacatctcattcccactataccatcctgagagggtaaataattctgcctatgacgcaggtatagaaataaaaaagactatgaaaagattaaaaagagctcaaatgaagggaagataattctaggcagaagaaagagcatgttcaaaggctgtgtgagtgaagaggtgggagagtgtgctgaaaggtgggcagaagcctctctgccctgggggaggggatggtgccagggagctctaattgtattttgctggcactggggagccatggaaatttctgtaggaagggagagatttattttattccacaaacatttatttggcacctatgatgtgcaaggtattctttaagatgcttgggagacagtagtgattaatcaatgtccagtgggagagtcaggggggtcaggaagatcttggcacagaatgaggtcagagtgagagaggtcaagattggctggccaggggtattagccctgagatacactgctgctctatgggattttgcccctcattcacaagcagagggcctacccttaggccccaagtgtgtcaagccccctctgcttacaaaactttatttttcacaaccaaaggtggttcataatggtgggctgaggaggaagcaactgaagtaggggaagctcagaagtctctgagggtccttcccaccaggaatctccccacttgaacctaaggctgggacactttggcatgtgtgttttaaaggatccgtgggtttgtggggagggctgcaccagtgaccagttaagcccagtgggtgatgcctttcctttgttacttttcatgcagacatctggaaagaatttgtcaagaattataataaagaataccacggaatgaaagcaaatgtggtgagaagcagagttgccttaagactgagaagccagcaggaatggctgctgctaagaacctcattcttataggaaggattcagttctttccctgagcaacagaagtgcataggtgcacggcatagtgtgtcagttagcatttgctgagtaacaaaccttcctcaaatttaatggcttaacacaacagccatttattattgtgtataagtctctgggttagctggatagttctgctgatctgggtggggcgtggctgattttggctgggctcactcatgtgttagggttcagcttgcaggctggctggaggctggctcagtcagatgttttagagttggctgaggtgacagtgtggctgggccaatgcctatcatcatccagcaggctggcctgggcttgtttacatggttaggaggttctacaagtgagagtggaagtaggcaaggccttttgaggcatgggcttcagaagtggcatgatgtcatttcttacacattctcttggccaaagtaagttcaagggatgggaaaatagcctcttcctgatgatgggaggagctactgtatcatcttttcatgacacatatgtagggacaggtagaacattgtggtcatatgcagtggactgagcccatgggctttggagtcccatggggctctcaagccatgattctttacttaaccttcgtctataaaatgaaaacactgatagaatctatctcacaagatcattttgaggtaaatgcacatgtacctaatgcatagtaaattctcagtagaaaataacattttatgtattttgcatgtttctcataaactgattgtgcattctaattatttagtttggaaaatgtagtctctgtaggtttacccttccctgaggcagtaggggagatcatcacctctgtaatggtataatatgaactcaggagttgagattcgtaaagcagtaaggaatgcatagtcagctatactggaaatttgggaaagggaaatggactatgtgggaaagcgggactcttatccttgcagaagtcactatgaaatgaggctttcagtaaacagaagatgggcatttcatcctttctcattactgagccttcctcaagacctccttaacatcctaacattataaatacaataattttagaaattacttagtcaataaaaaataagcacttattgtatacgagactctgttctaggagccagagatacagaggaataaggaattaaggtatttctcccatattcaaggacttcagtttcattacctgtccagaaaactatgagaaccacccatcacctctggttatagattcttaagtgggatgtcaagccccttccctaatgatctcagtttaacctgctgtcctattcctctgtggcctattcctgtgctacactcgagccaaggtggcctcttccctagccccacacatactctttgtttttccattcttccaagcaggcccggagaaggaatgggctccacgatgcagggcccgcggtagagaacagccaggcagagcagggggcctggctggatgtggccaccatctgcaggggttcagcattgagatatgacactgtcacctccatctcaagaagcccttacggatgcctcccttcccttcatgactcactgtgatctacaactcctcagagccagccttaaagtggtctgtggatcagtctcatctccccactggagctccatgggcagaaagcactctttctcttctgcctacaacatcctcctcccatcggtatgcaccccttcctaggagccccacaggcaatgacaggaacccccaaccccatgtgtgcacatatacacattcccacatgtgtggggaatgagaggctacatagcctgctccatcctcttcttttaacctgcaattactgggtgaaaagagtaggatatagtaaaatgcaaatgctagtttagtaaatggcataaagacattgaagtgtccctggacatcagtcacgtggctgtggaagggagacttagggtgtggctttccccatggaccatggtgggtctttgggatccctctcttccccaccccagtcctttaaagacccaccagcgactttgtgagattctagactcctttccctcgtacctcctagccttattggatggaaaagagggaacagtggttcctttctttctgccacgcctccaccttccattggagactcctatttctccctccgtgacatctttgctgaacagaacagctcttaaaccagaccttatctgttccatgggtgcagaagggtgcaatgtgaacagaaacagcaagtctctggaaaagagctccttcagctgcaaagaacacagaggtcaggaggaataaagctaatgagagagcagagagtcctttgtctccccaggtgttattcccagagggcaactagggaaaatggagatggggtataaacatctgaattcactgttaaacactccatgaactgttgataattccctagaagcagcatattcctgaggtagcttcatatgatctccagaagcaacttacatgtagacatttttctgagaattccagaaagaatattgataattttcagacaccatggcttccacgcctcatcaacatgagcagtattagtctttatctctgacatcaatcaaacttgaacaccatcagcatgggctttaatgaaattctcacatatgtatcagaacttgtattttttcctttagtcagtgtcttgatccatttgtgttgctgtaaaggagtacctgaggctgggtaatttataaagaaaagatgtgtattcggctcatggttctgcagggtgtacaagaagcatgatgccaggcatccgctttgggtgagggcgtcaggctgattctactcatggtggaaggagaaggggagccatcgtgtggagatcacatggtgagagaggaagcaagcggggagtggaggtgccaggctctttttaacaaccagctgttgtaggagcacagtgagaactgactcactacctagagaatggcaccaagccattcacaatggatccgtccccatgacccaagcacctcccatcagacccacctccaacactggagatcagatttcagagtgagacttggtggggccaaacaaatcatattcaaaccatagcaattagaatcttaaaatcaaaattgatggctttatttttctaaaaatgggaaaatatctccaaaacattgttcaaaaacaaaacaaaacaaaaaaaaaatgtttgttcttatatcccatcagtttattcaactaacattcactgtggactttttataaggcagtaactgttttatgaataggagatataaaactgggtgaaacagtgaggttcctggccactgtattgtaataatagaggcacatataccaaagagctaaaatacaggcagcaaactctagggactgaagtaaatttccttaatttaatgaaatgtatcaagcagaaacccacaataagcatcatacttaaaggattcatttgaatttttttatttatttttattaaatcagatatacttttctagtttttttaatttttattttttgcatttcttgatcatttcaaagtgaggtcagttacagagtgaatgggttcatcctgtcattgtaaataacagttttttgtttaataatggcattttgtattaccaagaccttgcttcacattaggtgtttcgtatacattatctcatttaatcaaaaccagcactctatatcatgggtgccaccattcctctgatttttgctaaggaggaaactgaggttcaaaaagggtaaataagttgtccaagaccacacagccattgtttggcagagctggggcaaaggtctatactgctgcaaagcttgtgatttttggctgctaccctctaatgttctgtgagggtggaacacctaacctagaatttccctgtggatcactcacccccaatgatggcatgtcttgctctggacccatgatataatgatctggatacagccaaagtcactaagcacgctacaccctagcctttcaattcctttattacttcatggagaatcatgtatttcagccactcaagtatctttaaggtctaggccttatcgaatggggtttagtcactcagtacagtctgccctttgtactcatgagttcagcattcatggatttgaagaactgtggggtgaaaatattccaaaaaaatggatggttgcatctgtactgaacatatacagacttttttcaatatttcctaaacaataaagtatagcaatgatttacatattatttacattgtattgggtattataagtaatctagagattaaagtatataggaggatgtgtgtatgttatatgcaaattctacaccattttacatcaaggacttgtgtgttcttggggtttggtgtcagggtggtcctggaaccagttccccatggacattgaggaatgactgtgcttcccctacccaacagaagtggttctcccgtcaggttataatagggaagggatgtgtgatctttcctgagaactgaggcatgctattaagctttaaatggagcatctctaagtttccttaccaaaaagtaatcagacaaagggccatgtggcaagagctcttgcttcaccaaacacgtagtgatggacccccctatacccagtgtgccagacatcatcatgagatgtaactcctttcacatatctcttcccttgccagaggaaggaactgaggctcagaaaggttcaattcctcacccaaaggtttccaacccaaggtttctgacctggagccctgctctttcctccacaccctgctgccattattttgtcttgttgggctggggaagggcaaagagggtgcccactgctggatgaaagaagcagctacattcccattcaaggtgtgctgagcccagtcctaactgctcaagtctttcttaggtcttatgatggaactgaaaagcaggctacctattttatccaggaagcagacagaggatacggatgggcaagcacttctatcagatgctggttctgttgtaagacatcatcaaggttcctccaacccctgctcctcatcacactgcacagccctttggcagagacagggagaagcttgttgtttgagacatctggagttagaaagtatctgagctttaaatggagaaggagtggggagaaactgacagtgaagtgtagacatgaggcttagagagatgctaactaagtagtcatgagtcgaatctcccatttagtcagacacatttttctagtttttctagttttctacccttcaaaatactttgtgttaaactcaattacagagatagatccttccattcatcaagtgaattttagaagccacacctttgggtgggtcttaaaagcagttcatgggaatctataggctattgtgtataactggagggtagcagaaaacaagttccttgtgagatcagacacatgagctaaacatttaggaaaaccttacagaagcaaatctttaacggaagggtttccacactgagggccttgtgttgcttttgggaatggtgtagaaatcacgtgcttagtcttgaattatgattcacctttactgaatgtcccttctcttttctttactcactgtcgaacaggaacccaaaggatgtagtttttggcagatgtcctttgtagggttcagtatttctcactcacccctttaagaccctaaagggagagttattaatagtttcagaaagttgagggaaatcatgcagaggttctcagatgttcagagaggcttcctctccccttccatgaaagttctaaggctcatgggtgaggcctaagaaaggcatgtcagttgtctatcaagttcattagtttattcagcttatttctgaagcttttgatgggccggctattcagaggtcaatgaaatagacatgagtactcttcacagaccttaccgtctaataggaatgatagcaagtgaatgtataataaataaataattaggggttgattgttacgagtgctatgaggggaatagccagggtgacatgtttgagaaggggtcagtactgctaagtgttggtcagggaagcattgcaggcagagggaacagcaaatgcccatggtttggaggcaggaatggtgttccaagagtagtagggagcctcgggactagagtttggaggatgagcggggagagtgggaggagatagtgggaaagtctgtggagccagttccctgaggggcctggtgggccatgctcagtgggggtttcatttgacgagccatgggaaggcttccagcaatgggggatgtggttttacttgtaccttaagaagatcacactgggtcttgtttggagaatggacaggaaaggagcaggagagcaagcagagagtctgaggtgcaagaaatgccctgtcctcccagcagactggagcgaattctaattctgcctctgctacttcattcctatgcaactttgggcaggtttcctaatctctctgcctctcaactgttcacccctcataaaatgaggacaagtattttctcatgtggtttctaggacaaataagtattcgtaaagtcctctataaacttgggccatatgcttatctgagctataatatgattcatattgaaaggagggggactcctgcaatgttgggaaaacgactcagctgcccctatataaggaatatgttattacagtccgagactaaaaagatgcttttgtttctttactgccatcagtgtctctctaagggagggcggctggttaaaaatcacatggtgtgggcatttataggggtaataacttgaaatgattaaaccctttttttttaaagcttcatgtctctgttctccatctgtaggtggtgcatgagtatgatatagtgtgcatgtgtgacatgctgcgagtgtgaggaatgccagagggagacccacgaaactgccctgcaggcagaaggccacatgctctcagcaccagtcagtggtgctcgctagtccggcagattgctgtattcttgcaccctgtaccacaacattgttaggataaagtttcataagtcttatatggctttgaacaaagcaagtctatttttcatcatagtatgggttatttagaattcatatgttatgaggaaatacactgtttcaaatgcagttttctttgtggtgtctcagcagatactgagttttgctgccctgtcatccaagagggcctcaaggtgcccagagagaccaactgaaaaatgttcactggaacggagctgcaatggtggaaacgttctgtgtgtgccctgttcagtacagcagccactgcgcggctgctgagcccttgaaatgtggctatcagggtagaagaactgatttttaatatattgaattatgagtcatttaaatttaaagagcacagctgtattggacagcacagctgtagaaggatgttttctctcatggaaaaccccaactctgagccccaggggtcctatggatccatgagctcacagactcccctaacgtccatgaagatcatcaccaggatttgagggaatgctgtggtgcatactttgtgttggacagttatgggggattgcttttgccatctcagcatttcaccgctgtcctcggtatgagattatggtgatgttgaatgggggtcattagaaggctgtccacagaggggatcagcccccctcaatgaccactactccgagcatgggctttcttctgtttgatctcgttgggccctcagctgtgactgtggagaacagcaagtcctcagtgagagtatttgtcacttcctactcttggtgtttaatatcatccctctggcacagatgcttgaaaatcaatggtttcttgacacatcttggcttgtgtgaggggccataacaatagcagggctcatggctcctttttttttttttttttttttttaaagagatagggttttactctgtcacccaggcaggcaggggtgcaatagagtgatcatagttcactgtaacctcgaactccaggtctcaagggatcctcctgcctcagtctcctgagtaactggatctatacacatgtgcccccgtacctggctaatgtggcttcctttatgttcagcaaggaactctcagtgtttgtccatttccttaggaacatgagtgtttttggaaggcctttgatgagtggcagttgggtggatggatgagctaatacatccatcatcctatctcaggaggatgcttggatttgtgtttagaaattgggtaactcagttgttcatggaggaaaaagttgaacattactcaagtgcagatagggaaacagtgtaagaacaaaaaactttttttctatctacaagtgaggaaaaaaatattgacagtgtgcccaagcttcatggtaggatgggtgttaattgggaatggcatgtaattctcttctggaatccagtgtctgggcaagtcctgcctctcagattaaggcaccagcattcagcataagagggtcctgcctctcagattaaggcaccagcattcagcataagagggagtaattgacattctacatggcaaaagacccttgaaagataacagatgaatgtctcatggccagtagcttggtttttttgcatggtgtagatttagaatataacttttacagggaagaaaggggttaaaatgtctggtgccatctgtcacagtaatgagttgtgcaaagcccaatgaaccttgtagaaacaacatcgtgcccagaaatagcctagacctcagagtgacatcagggggcggggacctgatagatgtggtcctgcaaaaggaccgaaggttcttctttaacaattcaaattgaataggaaccatttttaatttgggggtaactccgtcttcaccattaatggccattcttcaaagctactttcattcctgtgagggatggccagacacgagaaagccaagcagggattttcagttacaggtgagcatccgatctgcagccagggctttttctaccgggcacatctttgtgcgcagcctggtttgagctgatctgcacataaacaggcactctgggtgtggatgggggcatctgtgtactctttatggctatatttccagaatatgcttttaaagactgtggtcacatttaccttggttagggaagatagtgacttataaaaacctcaaacatttatgtttccctttccaatataaaaagtgttaataatttacccacttaaaaggttaagatcaaagagatcataaacacacatgaatactatttcaggaacataaaattcagctatttctactaacagaaagtgagtttatgggataccaatgcaaacaaacatagatttagtggaaaatgactcaaccaagtaagatttacaaaacaaacaaacaaaactgttttcatcatctttggttgtagttttataaagaatgctggttcatggactccagacacttcactgaaactgtgtgaatcattttaaacaggtttgtccttgggccccagatagtacattggcatttgtgaatcattttagatgagtttgtcctcagtacaaatcgtgctgtgtttaaagttcttggagacacttctctcttccaataaaaggcttttactagatgtttcagtgacataaagttgaagacataaatactgttttatattgtaagcaggaccaactcttttatggtgtgttttatacgtctagaggatttttgttgttgttgtttctttgaggttttctctgaaacttcagattaaggtagtccttgaagtggaggctattaagacctagtgttatctgtctcagggaggtgggggactaggtggactgatggaccccagaactccagattccttgcactggaagctggtgttttgtgtttggaagagcctctgccctctgtgtcatgctgcagtaaagtatgggtcaacatccccaaaatgtgtgactcgcccaaattaagtggtgtcatactctgatccttcttccactgaacatcacattcttcatgagaatcacaccattgtcctctgtctgccctgcctgtgagacgggccatgctctatgcttgcccgcctcttccatcaggaacactcacacagtcattctcctcacataccccactctcatctgctgcccctcacacctgcccttctatagaatgttctaccctttaatagggaagggtttcttcttcctatgaatttttacctcactttgtgtctttttaggtttgtattggaactatttgcaaacaggtcttggcttatctaaagaaaaattgtaagctccccatgacgcaagacagtatcttatttacctttgaaaacctcatcacactctgccctgctcagagtacaatctaaataaaagtctattgaatgactgaagtagagtttcttttttaacacttatatgcacattcttgtgacaggcacagtgaaagatttatcaaggaatgacatggtccccacccatgacactgttaaatccataatttgtgatgcattgtttttagttatctagtgctgctgaacaaaccactccaaacttaatgatgtaaaacaacagcaattttatcatgctcacagacattgtgggcaaggaattcgggacagggcacattggggatggctggtctctgctccatgatgcctaggacctcagctgggagagacttgaacagttgggggctggtgaatccatgtctaagcttcttcattcacatgcctgtcaccttggcagcatggcctagaagcctgggcttagctgggcctgagacccccagcattctcttcaaggttggggaattggaccctacatttgatgggagaattagccagttcatgttgcagaagagcatgtggagtcggagatactttacaagcatctatggaaaatacagtctgaagtgaatgcccaaatgagtggcaccaacactgattattactgggtgacagaggcacatggagaaaatgtcatgagggaggaaatgctgggatttgccttgacctctggctgggggacggggagggatgagaggtccaaggcaagatggataagtaggaataagcagccttgttttggggaaaaagagggacagacctagaatggctggctgggtgaaatggcttgttgtgtctcctaaattagattttacatttttgagggcagagctacttaatattgtatttaccccagaggaagattatttttttcattctctaaattgtttaattaaaactcatagttcatgttaaatttgttcaaagtttccatctaatggtgaggtggtaaaggaaataaaacttaccaaaatagaagagggagaaatgaaaaggaaatatgatcaatgatttctgttctttttacttcctacttgcaaagactctggaaatgtaatgatggttcagagtgttctgctataaatcctaacagcttaaacaatctcctgggatcatattggcaaactctaagatgatacaagtatagacttagtttgtctgagcccgaggttcagtgtttggagaaaaataatacctatgtcgagataatatcagataacctataaaagcaggtagcccagtcatgcacattggtgatcaatcaatgttagctgaatccaaatattacgagtgcagatgctgaaaggaacaaaaggaaatctcactcagtcatccatctgccagtatttccaccctttcccgcaaagaggagctcagtgtctgtctctgttattgcatcaggatctcacattatccagtaaacccaaatgctgtaggtaagagatgtaataggtggtatttattaagtggttttaataaagttttgtggataggtatgacaccatttcttttgagcttaaagatgcttaaaatagctaaggttaaaaatgagggaagatctgaaaagaaaaacagtaaagagatgtgagatgtaaacactgaaaggaagtaagggtagagcaaaaaaaaagtaaagcatcaggtaaatatttaataaaatgtttatacatgtatattgactgtaggtgtagggttagtctattgaataaagctgcctttcttaggaatggtggtctcaaaatgcaccagtgccttcctattggctgaatgtccacttctgttctatgcactgtgctaaagggtggacatgctgagatgagtgtgagtggcctctgcaccaaagagttcagtctaattctgggggttggggataaatatgttagccagtaaatgccatttattgctttagatgtcatctcagaaggataaggagcagtggggacaggaggagcaagccatctcctgggggagtcaagaaagatgaggacagagagagaatgtcccttggatccaatatggtggccattagtgaccttgttaaaaccagtaggaatggggtggcaagaaggagagtagaacagattataagaaagaatgagttttgatgaaagtattggaattttgatgaccttttttattacaggtttgggagcaactactttcttcactctctaaactgcaaatcattcagggtaattgtgctggttcagttagcccccaagctgagaagacaggcccactgtggtttgagtaacttggaaatcttgtggggtcagtgttttgactctcttcattttggtcatggttcaggattttcacacaccactaaggtctaggggaagcttctcagctttctggataccctctcagggctcatgaagtggcaggcctgccctgggaaggtcaggattcttctgtaaaagcagagaacactgcatggagcccagagagcccactctctgcgctcttcccttcctatgggctcacacggggaaacagatgctttcctataactctgagcactgaagcagctttgctctgccttggccgaaacatctatccaggaccaaattcttaaaaccccaggggccctggggtgattttcagcccaggccctgaacctgtcataaaatgtaatggatgatatatttttaactgctgagaccagagagttcacataacctatgaagactgaaacaacataatgtttctgcagttttgaagcatttcaaaaaccagaggatggtctctctcattaggcattactagtaagacaaaagttcttaaccatttctgtgcgtggacgcctttggccgttgggaagcgcacgtggatcctttctcagaatatgcttttacatacatagaataaaatacatagaattacaaagaaattcagttatactgaaatggagttatcaaaatttttaaagaccactttatgatataataatataccagctttttcttgatgcatgaaataagaagatctacagacattttgagtactgttaagcataaacaatatttcaaggtgtctacaactataatatagtgtgtaatatctcagatttctatcgacggtagagtcacaggtctttctaatacttttgtggtttgatgcctacattttataatggaaggaaatgctaaatttcagttagaggttaataaaaataaagaaggaaaattcttttcctctatctaaatccacagatgccctgaattctcttcgaggttaagaacttctggtttaagatatgcttttggttgacagtagtaaaacaagccaaaagaagttgaccatttatgtgatgtgcagtaataaattagcaattcagagttgaggagctcattactaatctgtggatagtcctaatcccagcccttttctttctgagctttgccttttgtaaatctcagtgcttcacacacatcagacaaagatattttgtgagtggctctaaaaatgggggcaaaacatgaccctgaggaggcctggggctgatctgagccttaagacttatttgtggagaccttgtgctgttctttttttttttttttaattatactttaagttttagggtacatgtgcacaacgtgcaggtttgttacatatgtattcatgtgccatgttggtgtgctgcacccattaactcgtcatttatcattaagtatatctcctaatgctatccctcccccagccccccaccccacaacagtccccagtatgtgatgttccccttcctgtgtccatgtgttctcattgttcaattcccacatatgagtgagaacatgcggtgtttggttttttgtccttgcgatagtttgctgagaatgatggttttcagcttcatccatgtccctacaaaggacatgaagtcatcattttttatggctgcatagtattccatggtgtatatgtgtcacattttcttaatccagtctatcattgttggacatttgggttggttccaagtctttgctattgtgaatagtgccacaataaacatacgtgtgcatgtgtctttatagcaacatgatttataatcctttgggtatatacccagtaatgggatggctgggtcaaatggtatttctagttctagatctgtgaggaatcaccacactgacttccacaatggttgaactagtttacaatcccaccaacagtgtaaaagtgttcttatctctccacatcctctccagcacctgttgtttcctgactttttaatgatcaccattctaactggtgtgagatggtatctcattgtggttttgatttgcatttctctgatggccactgatgatgagcattgtttcatgtgtcttttggctgcataaatgtcttcttttgagaagtgtctgttgatatcctttgcccacttgttgatggggttgtttgttttcttcttgtaaatttgtttgagttcattgtagattctggatattagccctttgtcagatgagtagattgcaaaaattttctcccattctgtaggttgcctgttcactctgatggtagtttcttttgctgtgcagaagctctttagttcaattagatcccatttgtcaattttggctgttgttgccattgcttttggtgttttagacatgaagtccttgcccatgcctatgtcctgaatggtgttgcctaggttttcttctagggtttttatggttttaggtctaacatttaagtctttaatccatcttgaattaatttttgtataaggtgtaaggaagggatccagtttcagctttctacatatggctagccagttttcccagcaccatttattaaatagggaatcctttccccattgcttgttttcgtcaggtttgtcaaagatcagatagttgtagatatgcggcattatttctgagggctctgttctgttccattgatctatatctctgttttggtaccagtaccatgctgttttggttactgtagccttgtagtatagtttgaagtcaggtagcgtgatgcctccggttttgttcttttggcttaggattgacttggcgatgcgggctcttttttggttccatatgaacttgaaagtagttttttccaattctgtgaagaaagtcattggtagcttgatggggatggcattgaatctataaattaccttgggcagtatggccattttcacgatattgattcttcctacccatgagcatggaatgttcttccatttgtttgtatcctcttttatttcattgagcagtggtttgtagttctccttgaggaggtccttcacatcccttgtaagttggattcctaggtattttattctctttgaagcaattgtgaatgggagttcactcatgatttggctctctgtttgtctgttattggtgtataagaatgcttgtgatttttgcacattgattttgcatcctgagactttgctgaagttgcttatcagcttaaggagattttgggctgagatgatggagttttctagatatacaatcatgtcatctgcaaacagggacaatttgacttcctcttttcctaattgaataccctttatttccttctcctgcctgattgccctggccagaacttccaacactatgttgaataggagtggtgggagagggcatccctgtgttgtgccagttttcaaagggaatgcttccagtttttgcccattcagtatgatattggctgtgcgtttgtcatagatagctcttgttattttgagataggtcccatcaatacctaatccattgagagtttttagcatgaagcattgttgaattttgtcaaaggccttttctgcatctattgagataatcatgtggtttttgtcgctggttctgtttatatgctggattatgtttattgatttgcgtatgttgaaccagccttgcatcccagggatgaagcccacttgatcgtggtggataaggcttttgatgtgctgctggattcggtttgccagtattttattgaggatttttacatcgatgttcatcagggatactggtctaaaattctcttttttggttgtgtctctgccaggctttggtatcaggatgatgctggcctcataaaatgaattggggaggattccctctttttctgttgattggaatagtttcagaaggaatagtcccagctcctccttgtacctctggtagaattcggctgtgaatccatctggtcctggatgttgtttggttggtaagctattaattgttgcctcaatttcagagcctgttattggtctattcagagattcaacttcttcctggtttagtcttgggagggtgtatgtgtcgaggaatgtatccatttcttctagattttctagtttatttgcgtagaggtgtttatagtattctctgatggtagtttgtatttctgtgggatcggtggtgatatcccctttatcattttttattgtgtctatttgattcttctctcttttcttcattagtcttgctagcggtctatcaattttgttgatcttttcaaaaaaacagctcctggattcattgatttttttgaagggttttttgtgtctctgtttccttcagttctgctctgatcttggttatttcttgccttctgctagcttttgaatgtgtttgctcttgcttctctagttcttttaattgtgatgttaggttgtcaattttagatctttcctgctttctcttgtgggcatttagtgctgtaaatttccctctacacactgctttgaatgtgtcccagagattctggtatgttgtgtctttgttctcattggtttcaaagaacatctttatttctgccttcattttgttatgtacccagtagtcattcaggagcaggttgttcagtttccatgtagttgagcggttttgagtgaatttcttaatcctgagttctagtttgattgcactgtggtctgagagacagcttgttataatttctgttcttttacatttgctgaggagagctttacttccaactatgtggtcagttttggaacaggtgtggtgtggtgctgaaaagaatgtatattctgttgatttggggtggagagttctgtagatgtctattaggtccacttggtgcagagctgagttcaattcctggatatctttgttaactttctgtctcgttgatctgtctaatgttgacagtggggtgttaaagtctcccattatattgtgtgggagtctgagtctctttgtaggtcactaagggcttgctttatgaatctgggtgctcctgtattgggtgcatatatatttaggatagttagctcttcttgttgaattgatccctttaccattatgtaatggccttctttgtctcttctgatctttgttggtttaaagtctgttttatcagagactaggattgcaacccctgccattttttgttttccgtttgcttggtagatcttcctccatccctttattttgagcctatgtgtgtctctgcacgtgagatgggtctgctgaatacagcacactgatgggtcttgactctttatccaatttgccagtctgtcttttaattggagcatttagcccatttacatttaaggttaatattgttatgtgtgaatttgatcctgtcattatgatgttagctggttattttgctcattagttgatgcagtttcttcctagccttgatggtctttacaatttggcatgtttttgcagtggctggtaatggttgttcctttccatgtttagtgcttccttcaggagctcttttagggcaggcctggtggtgacaaaatctctcagcatttgcttgtctgtaaaggattttatttctccttcacttatgaagcttagtttggctggatatgaaattctgggttgcaaattcttttctttaagaatgttgaatattggcccccactcccatctggcttgtagggtttctgctgagagatccactgttagtctgatgggcttccctttgtgggtaacccgacctttctctctggctgcccttaacattttttccttcatttcagctttggtgaatctgacaattatgtgtcttagagttgctcttctcgaggagtatctttgtggcattctctgtatttcctgaatttgaatgttggcctgccttgctagactggggaagttctcctggataatatcctgcagagtgttttccaacttggttccattttccccgtcactttcaggtacaccaatcagacgtagatttggtcttttcacatagtcccatatttcttggaggctttgttcgtttctttttattcttttttctctaaacttctcttcttgcttcatttcattcatttgatcttccttcactgatatcctttcttctagttgatcgaattggctactgaggcttgggcattcgtcacgtagttctcgtgccatggttttcagctccatcaggtcttttaaggacttctctgcattggttattctagttagccattcatctaatttttttcaaggtttttaacttctttgccatgggttcaaacttcctcctttagctcagagtagtttgatcgtctgaagccttcttctctgaactcatcaaagtcattctccatccagctttgttccgttgctggtgaggagctgcgttcctttggaggaggagaggcactctcatttttagagtttccagtttttctgctctgttttttccccatctttgtggttttatgtacctttggtctttgatgatggtgatgtacagatggggttttggtgtggatgtgctttctgtttgttaggtttccttctaacagtcaggaccctcagctgcaggtctgttggagtttgccagaggtccactccagaccctgtttgcctgggtatcagcagcggaggctgcagaacagtggatattggtgaacagcaaatgtagctgcctgatcattcctctggaagttttgtctcagaggagtacctggccgtgtgaggtgtcagtctgcccctactcggggatgcctcccagttaggctactcgggggccagggacccacttgaggaggcagtctgtccattctcagatctcaagctgcctgctgggagaaccactactctcttcaaagctgtcagacagggacatttaagtctgcagaggtttctgctgccttttgtttggctatcccctacccccagaggtggagtctacagaggcaggcagacctccttgagctccggtaggctccactcagttcgagcttctcagccactttgttaacctagtcaagccttggcgatggtgggcgcccctcccccagccttgctgctgccttgcagtttgatctcagactgctgtgctagcaatgagcaaggctccgtgggcgtaggactctccgagctaggcacgggatataatctcctcgtgtgctgtttgctaagactgttggaaaagcgcagtattagggtaggagtgacccgattttccaggtgccatctgtcacccctttctttgactaggaaagggaatgccctgaccccttgtgcttcccaggtgaggtgatgcctcgccctgcttcggctcacgcttggtgtgctgcacccactgtcctgcacccactgtctgacactccccagtgaggtgaacccagtacctcagttggaaatgcagaaatcgcccgtcttctgtgtcactcatgctgggagcagtagactggagctgttcctatttggccgtcttcgctgttatttttaagaataaattttaaaaggacaaagtaaaactccaagttgaacttaatggcaaggaagtgtcaaaatgagactctgcatgtaactccccatgcctctccactactgatatggatctgcctggtccacatcatcctggagtgctagggtgaccctagcactgtatccagctcttctcacctctttaggaattttaagcccacaaattaagtatggaatttattacatggtatcttggatttcagaagcagaatctgagatggggatttttgccagagatttattgggggagtgctctcagaagtgaggaaaacagaaagggacagagaaaaaaatgttgagtaaggatgtggtctcaggaaaagtctagcctcagcctgatcccgtgcagaagctctggagcagagcttatcccacccagcagcaagggggatggggtgttatcctgctgcatctgccagctagggaatggggcaggtattagttttctaggccacttcaaaaattacaaatttagcagcttaaaacagcataaagttactatctcacagtttttgtcagttaggagtctgagcatggcctgcttagcgtttcacaaggccgtactcaaggtgccagccagatcttttatgcggcttggggtcttgctccaggctctcatggccgttgctggaattcactcctgcagctgtggagcccagggtgacttgcttcttcaagactagcagaagactctttttgctgcttctagtctcttagctcagccttccagtctcttagctcagccttccagtctcttagctcactgctctccaaggattcttgacacttgcactccaacccactctgggtcagaagctattcctccctgtgaaaggggtcacttgagtaggccaattcacgccatcctttctgattcactcaattgagctgattcagaactttaattacatctgcaaactcccctcacctttgccatttaatgtaacatcacaggagtgagaaccatcatatgtccagtccttcctaccctcaaagggagaagattatacaggggcatgggtcactggcatcattttaggattctgcctgtcacagggcgtcacttgcaggcttcgctggaggagatggctcctgtcacccaagggcagttctcctgagaaagttgtgggcataagcaatgcatgtagcggctagggcactgaggtcccgtgacctggttccagcctgctctccttccctgtccatagtccctccctgcccctcccccgtgatcttgccccacagacctttctcaggtggcggtggtgatggtgttgtaggggcaactggcttttttagagtgtcaggagctctccaaggtgcttgacatccatttctctaatcttcacaacaagcatgcaaggttgattctgtcatcccattttacatctgagaaaacaagctcagagagagtaagtaaagtggccaaggttgcagtttgcaagaaatggagcttggaccccctctgaccttgaactggctgacatcaaagttgtcgctttgcctggtcctgtcacctctcttcctcagatgtctagtgtttattagacctccatagtatcttcaccaactgagaaggtgccccatcagcctgaggaactcccagggtcacccctctacaaggattcttgacacttgcacttctacccactctgggtcagaagctattcttccctcattggattgccaccattcttgtaagggcaccttctctgcaccacagttttttgctcacactcctcctatttttctcttctcagcttccctatgcctcatgatgccaggcataaggcacacagcaaccaagtgttggcagaaggcaaattatatggtttggctgtgtccccacccaaatctcatcttgaattttagctcttataattcccacatgctgtgggagggacctggtgggagataattgaatcatgggggtgattttccccatactgttcttatggtagtgaataagtctcatgaggtctgatgcttttataaggggaaactcctttcacttggctctcattctctcttgtctgctgccatgtaagatgtgccttttgccttccaccatggttgtgaggcctccccagccatatggaactgtgagtccattaaacctcttttactttataaattacccagttttgggtatgtctttatcagcagcatgagaacagactaatacaccaattgaggttcctccagagaattaacaaaatgtccatgcactctttcgttgttcccccatacccacagacctgccatccctggccctgcctggatgccggtacctggccactgctgctatattccatgcttttggacaagagcatgttcagtattgtccaggagacccagggagctcaagacagagctgagatccagttcctacagccacagttaacaccccagcccccgacacacacacagacttttcaatgcaaaatcaaaccattcccaaatatccagctacatattgttttacctttgaagagaaaaaagcatcagtggggttatgtgattttcatagatgaacaatttttgcaaatatgttaattgaagagtaattggtgcttttttgaccctcctgagcactgatgcttgccaaagggttatacatttcagactaatgatgatatccattactatatgtgcaattgcttataaactaatatatagtcatattaaaatctctaatctgattgagaaattttcagaaacaaggtacactgattttcttaccacttatttcctgctctcatgacagaatttctggagttctttgaattcacctggtttttggagctctgtcaagtcaatatttataactgaactagttcaaacagttcaagcattgtctcttcctttctggttgaagttctgtcttagaagactgttgtagtcagctgtgcttgtcataaagttttgtttaaaattattttagaattttcttctttggctttaatttaaatttttgtttgtttactttttttttttttttccccggctcactgcaagctccacctcccaggttcacaccattctcctgcctcagcctcccaagcagctgggactacaggcgcccgccaccaggcctggctaatttttttgtattttttagtagagacagggtttcaccgtgttagccaggatggtctcgatcttctgacctcatgatccacctgcctcggcctcccaaagtgctgggattagaggtgtgagccaccgtgcccagccttgtttactttttaatttataggattgtaaatgaaactatacttggcctcagtttattctctgggaaataggttcttgctacaggtacagtttataataaggatttatttcataatagggagctttttatagattttaatatcatagttgccatttaaaaaattgtattaaaggccgggcgcagtggcttatatctgcaatcccagcattttgggaggccaaggcgggtagatcacctgagattaggagtttgagatcagcctggccaacatggtgaaaaccccgtctctactaaaaatacaaaaaattagctgggcgtggtggtgtgtgcctgaattcccagctactctggaggctggggcaggagaatcacttgaacctgggaggcagagattgcaatgagctgagattgcgccactgcactgcacagagtgaaactctgtcaaaaaaaaaatgcattaaaaatggtaatgatcaccatttattgcttgcctacagtatgtcagtcattatacaaggtatattttataattataaatattatttattatctgattacaaatatgttataccttgcactgtgtcctgtatgtctgttatgtttatttctgaattttccttcctttttcctctccatgctttgatctggatatttcctattgagagaatacactgaggcccagtgtgatttcattcacaatcctataaattaaaaagcaaacaacttctgggtcactggtcgtcttttctgctgtgttcaatctccagtaaaatatgtcagcaccttaaccactgtcctctgcctggtttcttagtctcacagccccgtgctgctgtagaattggcagatgccttgaggacaattgtggcgtacagtaaacatacctcaatatacttatttctgtttgggattttcgcccctcaagtcctcattgcgttattagccctgagctcttaagttttgtcttcacagagtcataagacttccagaaattcagcttagaaactcaagaacttagctttttagccactgcttcactttcagtttcatagcctctcatcccacactgcttacaaatctggaaacacctcaagggaaaagtgcccataaatgttggggttacctccacattctttccttctctttgggaccctatactctgaagtcctggctgtcttgatagttagttccctgataactttatatatttttaatttttttaaatgaacctggcatttcaaacataagttccatgataattttaaacaggggtgtgtgtgtgtatgtgtgtgtgtgtgtgtctgtgtgtgtgtgtgtgtgtgtgtgtccagcttttcgagttgtccgtgggaggacggtttcagtaagttactctatcattactggaaatgcaaaatcctgttttcttttaaaagagtcttcaagctgatgaaaattttaaagtagcttataacattttaactgtgatcttatttattatgagtatagagataaaggaaaaggcatcccacttctgaagatttctcgtttctaggagtgtctacaagattatcataggtgaaagtagggttggatgcagagaaatagtaagaaaggatggaggatggaggggataaaaagatcacatgtttggtgaatcctcttttaaaaacacttagaagattttccctaaactaattatctggcttaatgctaactgcttatttgctgaccttctgctttatttacaaatttaaagtggggccaacccttcctgttttcctttaatttaccccggcagctgctggttagctaaggaagaaaaaaaaccctttttttttttttttttttttttaatggagacaagcagcaattaggtaggcttctaggtcaggtggccagttaggggtgccagggttcccaggtccagctttcttcgggtcatagagtgagggtgggaatcaagtcactcagatatttctcccgaattgaaatgcgtgtcttcctttggctgggcagatgaggtcccctcttctccatctctgctgctgggtcctggtgcaagcccttactctctttccactaaacccatgtggcagcctcctccttagcctgtttctccccagtcctgcacccatcagtccactgccacacggcagctacagggacctttctagaacacagcctcctgctgcctccatgttggcctccctgcccctgtcagagggatttttatttattttatttatttatttttgagacagagtcttgctctgtcacccaggctggagtgcagtagtgtgattgcagctcactgcacctccgcctcctgggttcaagcaattctcctgcctcagcctcctgagtagctgggattataggcgtgctccaccacgcccggctaatttttgtatttttagtagagatggggtttcaccacgttggccaggctggtctcaaacttctgacctcaggtcatccgccttcctcagcctcttaaggtgctgggattacagacgtgagccaccatgcccagccaagagggacttttctataacagcctctaggatcatgctacccccttcccagctctccctagcttttaagatcacataacctgcaaagtgccctgagatctggttctgcatgaatcttctctaccctattgctgcctatcaacttgacttcccacctttgggagtcagatgcagtccgctggacagcccatgccctctccatgtggctataccacccctgccttgcccctgctctctgcctgatgtcctactgtcttttgactgtgcccaggggcatttcctctgggaagcctgccagccctcagtctgaacctttgggtccccaaagcctcccctgtcctggtatgtgttgcactgcgttgtcatctcttgtctgtttcccctgagactcattattccctgaaggtctttcatctctgtttccctgtggcccagcacattgcctggcataaagtaagcacccaataaatttcagatggagcatatgttaagttccctataaaacctcagctgctgcaaattctgccaccagcctgggtgttctcctctgtggggactccttcagttttcagagacaggagactcccatagatttttagcaggaaaaggtagattcttgccttttagtctgtcagaatgacactttattagatgctttagaactgcagaagcttcaattttagaattttcagtttgtagcgttattttttttaagcagtaaaatttcagcgactatggtctgtgccagagccctaagcctctttctccatcctaaggagtttctctgcttaattgcagtgctgagctcagggaagctgcatatccaaaaatgaaaaggaaaccgctaaattgtgctgctacttttcctttgcagctcagataaaacaggcccagtgtgggaagaaggggctgtccttttgggggtgttggcctgtttctaattgctgcaccctcctctgcctccacccatgcctcagtgtggtttgggtcccttctgcccagagctactgggacatgtaataagaagctgcttttcagacttcttaattaaaataggttccggcagccattgccaggaagcagcattcgcacccctacatgtccaaatgcattactcatccaaaataagatatgccacgactcaggtttccctcctcagccaccatggcttgaatggctgcatttagaaacagcccttacttcaagcccctatttcttaattatttgtcacttattcccattcatccttgtgtgtgaaacatttttcccctcaccctatatgctgttatgtaaacaagtaattttttaggatgatgtcagaacctgatgtagttggggtggttttaaaatagtattttatggacagcaagaaaagtagttttgcttctggtttcacttgctagctttgggatggagggacatttatttgagcttctgcacctctgtgatcttgtctataaaacggggggcaatggctggtgctgtggctcacacttttaatcccagcactttgggaagatgaggcagaagaatcacttgaggccaggagttcaagaccaccttgggcaacatagtgagaccccatctctacaaaataaaaaataaataaaagaaataaaagaatgaaagttagctaggcatggtagtatccaactgtagtcccagctactcaggaggctgaggcaggaagattgcttgagcttaagagttcaaggctgcagtgagctatgattgtcccacttctgggaaacagagcaagactctgtctcaaaaaaaaagtggaaggtgggggtcaataatctgccagctcaggtattgtaaggattaagaaagacagtgtctgtgaagagcttggcccagtctctggaacacatttggtagccaggaaatagtaaatgacttctgtttccctacccccatcttcacctcctcccctagaataacaacatcataactgacttatttcatcattaaggatttaaatgcaaaaccttaagatagtcagccttagggaaacactgaagaatttatttttaaacacataaagattgcattcattcatccttctccacaccgcgggcagtcttcaaattctggttagcagagtcagcgggcagggaggatctggatcctggggttgtgtgctttgctcccagagggacatgagtatcaaaggtctgccccgatatctggagttcaagaggcgttttctggaaacaatttgtccaaaggctcccctatcactctcttggagaagtcctgtgttttatttatgctgaatgattgaatctattcccagccgaatgttttcctgaacaccagtaaaaatcatctgccagtcactcgggctcccaccccgggagtcatctgtcccctttgcctggtctcccatgcctcacagctcagcagccacaggcatggccatatctgcctctcttgcccttgccactccacttcatcatggccgtctcctctctggggctgctgcgggagatttccagtctgccctccagtgtctctgcatgcattctactcacctcctctccccccgcagccccgaggaactctgaagaaacacaagcttctgtggccccgtacacgtaggactaccaccgcttacttggaggcagtggcagtaaaaacggaaacaacaaacaaaacagaataaaatcctctttaactttgtttaacttggtgtcccatgcagtctatttaatttcagactcttatttaccccagtcctagggaactgaggttcataggaccaatctgggtgaatgctgctacagtttgtggatgggctgctccccatttgcttgttcaggtagctttgagcccaaacattggtcagcaagggcatccatatagtgacatgctgtatgtcatcaaaaagaaggtgttcctgacatagacaatttccagaatatatgctaagtgactaaagcaaagtgcagcatgagatgccaccatgtgctgcagatgcttggactggatggatacctaagtacccccaaactggcaggcacatctgcctctggggaagggggctgggtgtcggggaggggtgggagcaaattcctccccgtgtgcctcctggggcctttagaacctctacttctttgaacacagtgctactctgctccaaacgcccccaaacttcacacagagagtagtatgaagtcctcatctctgcacttgtggccctgaggttggcctcagcctgcccgcccagcttctcttctcattcttccctgctgccactctcctgtctccccagggactcggctgtttgagccactttcctttgacacgtctcagacttgccctgctccacttggaagtccttggagcagcccacacgcacccccgccgagctcactgtctcagaatgtgggaccacctaccagctttactcctgcgtctaactctaacttgtgagattgtgggggccagagtccccaggaggcagtgacgctgtgtgcagaaaagccaagagctccagggctgaacagatgtgactgaaaatctttaccagccatgtgccctggggaactgagcctttcatttcccctttccttttctgtataatggaggataacaagccttcactcacagggcgtgggtgtgtttctcatctccttgcagcacctagcacagtacctggcatctcatatgttcagggcatgtttgctctcctcccttcctttcccatcgtgactgtcaatcgactgttcccttggggcttgagattcttggattccaaaggaaagaacacagggccaggagtcagaatttcatccttgcctccgctgatgtctaattctgggataacgctgggccactcagtctttggattccctgccctaacacaaaatccatatttatctcaatgcaaaagagatgtggtcatcgaaacactgaatgcaaagggttagcagagtgagcacagatgttctcccatttgccaactggtttctaagaatatttggaggatgagtaaagtaatgtcttccatatgctcaagagaagatgatttagcaccatgcaaggtagagaaggagagcccccacccatcaacagaatgaccttggacaagacactagctgccctaggcctcaattacctcatttaaaatatgaaagtcataaaaccctacctcacgagggtgattgtgaggattatatgaggcaattcatgtagaaggtctttgtaaactgtgaaatgctctacgactgtcagccaggattagtagttaatgcacgtatttgtttattgtttcagcggagggtgcaggacgtcatcagcccgatcgtgtttgaagcagcctacagcctcagtgagcatgtgactggagaggaggagagggaactgccgcctctgacaccagttctccgctggaaaaagggacaaaagattgcccaaaagaatcaggtcagaaccttaaagctcatactcagcacccaaggtggcagctgcacagagcagaaataatggcccaaaagttgagagagccgtgggcctggctgctcaggagaccgcagccaggacacacctcctctctgggtctcccttttctgatctgcaaaatgataaaataaacagtcttaggggttacttgtgactactgtgggacttaaacactttcagacaattctcaggctgttagaagttacaatcccctcgagttcgtgaactggctggccacttggtccctgaacttgcctctgttcctagactgttttcagagcttagattggtggatagtaggtgcttaatgaatgttttattggtgggagaatgagtgaggtgaagaagcaagaatggtagcttgctgaattggcagttgagttacagaatgctcaacccaagagtccctggaaaccagagcactggggcaagtacaggtggtccacactcatcagattctgggatgtgcggctgtgtagagaagctttagtgcgatgggtgtatcactcgtatgaagtaggagtgagcctgtgcctgattttgtgcagcagcgctggccagctctgaggcgtgcagcactgagtgcggtgcaggaatatgcaaggaatctgcaatcccaagtctgtttcaaatcttttcttgaaacccaagatcaccacagattcagaaccctgtggaagatcaggaaaaactgtgggctaacccagcctcctaggcagggttggggcaaagctgtggaaccacctttcacagtgcttcagaccactgtaagtgtaggggaaaactagcagattgtgacccatgccttgtagattagagttgtagactgaaccacagagaagggtttgggatttgagatatccatccaggtgttcacgtaagtgctgagatttttaccaaggcatcgcattatctcccaaagcctctttcccatcatcctaagtggggttccctagaagcagagcctgagaaagggaattgggaacacatggtctaatgatgctgtgctcttagggaaaacctgtaaaggaaaggcatgggggctcaaaatggttgtggtctcagataaagtctggctgagggactctggaacaaaaattacaccaaagagttgtcctcaccttgaggcaagaggggcttcccttttgtgccccatatcattcagccattgactggctgtgggggggaagggaagtgtaaccctccttgaaaggagatcccctcagctgaggatggttctctagagaagaatgcagatgtgagccataagcagcctacacacacatcagccaggagatgggccacagttcacagtgcccactacacatcaaaacacaccctctggggaatgctgccaagaggttttgatttaaaacacgaaccttctttcacaacacaagtgccccaggagagtggcctgtaagtcccactggccattgatacttggaacaggccctgggggagtgagggaggacacgtggtgtctaagcaggtgggcagagtagatgggctggccttactctgaggtgtggagaaggctagagaagagtagaagataaggtgaagaggcagggcaggaagctgatggcttctgccttgactgggaagtacagacctaggtcccctcctgacagggaagtggggagaagaggttggcctggggacacagtaaagcatggtattatggtaacttctacataattggtctctagttctagaattattctgctttctaaggtcaaatcttactggactgataaacttacccatacttgggttacggaagttacccagactcggggtcctgggaagaatttcagggtcctctgtgcttatttgtttctgaattgacccagtgaggtagtcatctaccctgtccagcatcttgctagcctggacatactttccacagtgaacctatctctcattcctgcaagtctgtcagtggcacagatgtggactttctttagtgaaaagcatcttggaacctttactgacatttttagatttaagcagcccaatcaaagccagagatggagggacagattagtattgaaatgatgttcttggtcacttctggttccagatggccaaccaagcacaaatgttgatgtctgtgccttctggtaccccattgcaatgattataaatgagtagatcggaacagggaggacaacactgtgaaagaaagggcatcagctaataataagagtccagtaattttctggtatgagtgaagtaaatggaagagtgttagtgggtgaacttgaactgtacatggaagagctggcttcctgcctacccagggaacagagaagctgcagccacagccaggccaacagttacagagggggccagagtaagaagtgggactgcaagtggtggtggtattgagggaggtcagtgaaatgtgaaggttggtatgaagaagggttagagttgacttttcaccattgtccccacccctacaggcttcaggcatgcagaatagcaagcagccaggcatcgccttctctaaagtgttaaataaactgtttaagatagtgtgggcggcctcgttctcagagaaaagaaagccttacttctggcatttgaagtcaccaacgtaagagctagctttctctcccacaatccacccaaacactttcacagattttctactcagtccttttaccttagtttgaaatatgaatggacaaccaaggaaacccaagattgaggaatatttggtgcatgaaaggaaaggctaaaataaaccaggagaataactaacttaaaaggaaacaaatgatttagggaatataagagattattttaaaaaattttaaaaatgcaacaccttaatgtctatgcagtagacccaaggagatttaggaatatattccattcttttcattttctaatggatgggattctgttcctttttaaagggaggaatgaaaggcaagggaagtgttcttaaaaattaaaaatatatttgcagcaccaaaaactcagtggaagtattagaagacaatggtaaataatttcccaatggaagtgctaaaagacaagtagaaaagaaagctaaagaataaatttacggggtcctatatctccaagtaataagaatactagaaagtaagaataccagtaataagaaaagagaaagaagggggagaaaattatgtaataatagaatagcatgtttcagagttaaagagggagactattttttaaaattggtgtaaacaacaatttacaatcacaataaaccaaaattatcatagacacatcattttgaaatgtcagtgcttcaaagacaaagggaaaattctaaatgtttcgagggcaaagaatgcaggaatgttgatcatggaggataagtcagcttacaacagaatgagagtcagactgagtagtccattagactttttataagcaagattagaaactaaactatgatgaaataaaggcttcaatgttctgagggaaaatgattttgaaattagaattttgttttcagccacacaatcaaagtatgtggtaaaaataaagtcacttttcagataagcaagaacccagaaagtttacctccctagtaactcttccaaggaaattatcttgtacttcaacaaaacaaaaatgacaaccagaaggagcaagatgtgggatacaagaaactctggaactaactctcaaaagtctaatgacaagaaatcccaggatgataactgcagcaagtctaaaaagcagccaagtctattgagaagaggagatcaattaacttccagaagaatgaagctaagcaatagaatgatgagcaagtggcaaatattcagtatatagtgcagattgaatatgtttcttttatgggtaagaaaaaaataaaagcattcaagacctctcagaaaaatagaaataagataattacctgtacagattctccttgactcacgatggggttatgtcccaataaacccatcatgaattaaaaatattgtcagttgaaaatgtatttaatacacctaacctgctgaatatcattgcctagcctaccttaaatgtgttcagaacacttacattagcctacagttgggcaaaagtcatctaacacaaagcttattttacaataaagtgttgaatatctcatgtaatgtattgaacactatactgaaaatgaaaaacaaaatggttgtatgggtactcaccattaacacacacagctgaaagcacactggacctaaagaatatttgaactaaaattaactgctggattatggggctactagtgtaacagggtcatccatttctctctcttctgatgagtctcaagaatagctggtagaagccactgcggtattaacactcgttgatggcttagcaggcatggtgttctgtagaaagctatcagttgtttaccctcctaatcctataactgactgggacctgcagctcactcccactgcccagcatcacaggaagtattgtaccacatattgctaccctgggaaaagcttttgaaataaaaaatttgaaatatggtttctactgaatgcatactaccttcacaccattgtgaagtcaaaaaatcgtaggttgaaccattataagttggagaccgtctctatgtcatggttaaaatataaaacaaattaaaatgtgataaaataaccagttataactatcagatgttttttgtaagcctcatggtaaccacaaggcaaaaacctatagtaatacaaaaataaaaataaaaaagcaaagaaccaaaccataccactagagaaaatcacttgaccacaaaggaagatagcaagaaaggaagaaaggaacaaaggatctacaaaacaactagaaaacaacaaaattgcagtagtaagtccttacttatcaataattatcttaaatgtaaatggattaaactctccaatcaaaagacatggagtggttaaatggatttaaaaaaaaaaaaacaaaaaacaagacctaactatatgctgcttataagagactcacttcacctgtaaggacacacataaaatgaaagcaaagggatgaaaaaaattctatgcaaatggaaaccaacacagagcaggagtagactttaagtcaaaaatagactttaagtcaaaaactgtaaaaacagacgaagatcattatacaatgataaagggatcagttcagcaagaggacataacaattgtaaatatatatgcacccaacaccagagaaactaaatatataaagcaaatattaatagatcttatgagagagatagattgcagtacattaatattagggaatttcagtaccccactttctgcaatggacagatcatccagacagaaaatcaataaggaaacatcagacttaaactacactctagaataaatacgtctaacagacatatacacaacagtccatccaacagcgacagaatacacattcttctcaactgcacatggaacactctccaggatggatcacatagtaggccacaaaataaatcttaataaatttagccttgaaatatcaagtatcttttctgaccacaatggtataaaacttgaaataattaacaggaggaacttcagaaaattcacaaatacgtggaaattaaataacatggtcctgaatgaccattgggttaatgaaataattcaaagggaaatttaagaatttcttaagacaaatgaaaatggaaacacagcatacaaaaacttaaaatgtggtaggattttgagtaagtagaagagtataaagaagaatgttgatcctagaaatattctatctgaagtagaagttgaatattcctggactttaactttgcaactgtagaggaggatgtataatcatgacacttgtcttggctcaactgtgagcaataatcatgaaccataataaaattagcactatttattggttttcaatatttataattaagccaaaatcagagctatggtgatagcataaaatgcaaatgtcattaaacttgattatataaaggtaaaagtagaataagataagttttcttaatatcttaatcttttaaattgatgagtcaagagattgcaaaacttgatgaaacaggaaatcactgttggcttaaaattgcagaggtcatcagtagagcaacacttcctaaagtgtgattcctgaaccagcagcatcaacctctcttgggattttgtgagaaatgaaaattgtttttattttattttattttattttattttatttttttcctaaatttcttatttccttctctttttttaaagttttattattattatactttaagttttagggtacatgtgcacaacgtgcaggtttgttacatatgtatacatgtgccatgttggtgtgctgcacccattaactagtcatttagcattaggtatatctcctaatgctatcccacccccctcccccaaccccacaaccgtccccggtgtgtgatgttccccttcctgtgtccatgtgttctcattgttcaattcccacctatgagtgagaacatgcggtgtttggtttttttgtccttgcgatagtttgctgagaatgatggtttccagtttcatccatgtccctacaaaggacacgaagtcatcattttttatggctgcatagtattccatggtgtatatgtgccacattttcttaatccagtctatcgttgttggacatttaggttggttccaagtctttgctattgtgaatagtgctgctataaacatacatgtgcgtgtgtctttatagcagcatgatttataatcctttgggtatatacccagtaatgggatggctgggtcaaatggcatttctggttctagatccctgaggaatcgccatattgacttccacaatggttgaactagttgacagtcccaccaacagtgtaaaagtcttcctatttctccacatcctctccagcacctgttgtttcctgactttttaatgatcaccattctaactggtgtgagatggtatctcattgtggttttgatttgcatttctctgatggccactgatgatgagcatttcttcatgtgttttttggctgcataaatgtcttcttttgagaaatgtctgttcatatccctcacccactttttgatggggttgtttgtttttttcttgtaaatttgtttgagttcattgtagattctggatattagccctttgtcagatgagtaggttgcagaaattttctcccattctgtaggttgcctgttcactctgatggtagtttcttttgctgtgcataagctctttagtttaattagatcccatttatcaattttggcttatgttgccattgcttttggtgatttagacatgaagtccttgcccatgcctatgtcctgaatggtattgcctaggttttcttctagggtttttatggttttaggtctaacatttaagtctttaatccatcttgaattaatttttgtataaggtgtaaggaagggatccagtttcagctttctacatatggctagccagttttcccagcaccatttattaaatagggaatcctttccccattgcttgtttttgtcaggtttgtcaaagatcagatagttgtagatatgcggcgttatttctgagggctctgttctgttccattggtctatatctctgttttggtaccagtaccatgctgttttggttactgtagccttgtagtataatttaaagtcaggtagcgtgacgcctccagctttgttcttttggcttaggattgacttggcgatgcgggctcttttttggttccatatgaacttgaaagtagttttttccaattctgtgaagaaagtcattggtagcttgatggggatggcattgaatctataaattaccttgggcagtatggccattttcacgatattgattcttcctacctacgagcatggaatgttcttccgtttgtttgtatcctcttttatttcattgagcagtggtttgtagttctccttgaggaggtccttcacatcccttgtaagttggattcctaggtattttattctctttgaagcaattgtgaatgggagttcactcatgatttggctctctgtttgtctgttattggtgtataagaatgcttgtgatttttgtacattgattttgtatcctgagagtttgctgaagttgcttatcagcttgaggagatatggggctgagacgaaggggttttctacatatacaatcatgtcatctgcaaagagggacaatttgagaaaattcttgggcccaccccagacccactgaatcagaagctgatggggtgggccccagcaaactatgtttttgtttttgtttttgtttttgtgttttgagacaaagaatcctctgtcacacaggctggagtgcagtgacaggaactcggcccactgtaacctccacctcccaggttcaagtgattctcctgcctcagcctcctgagtagctaggattacaggtgcacgccactatgcctggccaatttttgtatgtttagtagagacaagttttcactatgttggccaggctggtcttgaactcctgacctcaggtgatctgtccgccttgacctcccaaagtgttgggattacaggtgtgagccaccgtgcccggccagcaatccgtgttttaacaagatggctgggtgattctcatgcagctaaagtatgagaactgatacagtagaggagttaaactaataatttgcccatcaaaattatggaggtgaaggagtggggatcgttatgtgagataaattcctgtctatcatggaaggaatttagtaaaataatgtctagatctgataaatcaacgagtagtagtatcagcatgttttctagagatatggaaataatcatcaaaagaaacataaacggacgtgggtaataatgagtaataatggttgcccctggagaggaggactcagtatggcgaggtatgtggcagggggttattatttttctaaccatgtgattctttggttgaaattaaaataaaagaaaaaattgttcttagattgggaagattgtccaggagcctgagagaagttctgggagagcagttctttcttattgtccttttcctgattatggggaaaaaaaaaaaaaaaaaaagataatcttccagatgttggctcagtttgaggaggaggaaagattctgagagtgaggcccactgcaggaagcagagctgatctttaacctgtgtatatatacacaacagtttgacacagagcatctcacctctttcataggaaggaataaattcatcagaactctctaggtcatgttgccagataacattagggttccactactttaaatgccttgatctcttcactgagcccatgttggtacccaggactatacagaagggtggatcaaatcatgatgaccttttagagttggggtctgcccccactgatggcctaattaaagtggaatcgctgcacagactgtgtgtgtaacatggagatagtgaccagtacatgttaagtacaggcttactgattaatctgaggctttttgctatgagttaggaatgtgcaggacaggcaggagaccaagccttccctctatagggtacatagtcctgggagaagacgggttccaggatagggctttggcactaggctctggtgagtgaatagtgggattgctgctaatgctgagattggattgggattctgggcgctctggggacggtggagcttgaatgctacaagcctccgtacatacagcctgatgggcacacattgcaccttcaaaatttaaggaaagcaaagacctgcatctgtctcatcagaaagggaggcatatttgatagcaggaaaaagacaacctttttttcattaaccagaggagtattttaaaagactataaagctggaagcaattcaattgtgtgtctactttatgtaagacctcgatgaaaaaataaatcattgctgccttcattggagtcacagacagtccaggaataatttacaaagtgagatttagattagtgtgtaagaatttcactgcagaggccacttctggctgaggagaagatgttctatggagaaaaggagaattggccagagccttaaaggtggagtaggatttgggtcctcagggaatggaggggctgatggatgctaaaggtctctcacgtggctgaatatctagtgagggaaaggggagaggccatctggactggagattcagtcatgcagtctgaagccacttgttcactggctgaggagttggatgtgattctacggtggacagaccatggcatattttgcagtttggggagatcgtagatgtgcctcagggagattggtgtgcctgggtatggggaggccagttaagaaagagcttgttgcaggggcctttgcaggtgagtccctggggagtctgtgtgataccccccagagagttgactcctaattaattgctagttggtctcagctgctgaaacagagggtatggaactaaatgaaacaatcatgggaagtcctggctggtccgtgtgctgggaagggagcaatgctgtccttggactggtcacctgaaggtcctttatccctcctcctcagctgagcataccaatggtgatgacagaggccctgtcttcaatccctgtacacagaatagcgctctgaaaattataactcttctcaggcttcatcagcaggcccccaaagagacctggctacagcagggcttccaggtctttcactgcggtaggcagaatggccccccaaagatgtccatgccctaatttctggagcctgtgatttggatacgttacatggcaaaagggactttgcagttgtaattaaggtgatggacttccaaatggggagaggagcctggattttccaggtgggtccaatctagtcacacgagcccttaatagcagcaaacttcctccagctggaggtgggaggaatgaggcggaataggaggtcagagagacttgaagcatgcctttgctgatgttgaagatggagtatgtgatgtgacgagaatgtggacaaccttaaggggctgggagaggcttccaggtgactgtctgcaaggaaacggggcctcagtcctacaaccacacagaaccaggtgcttccaaaaacccgaacaaagctggaagtggattctcccccagggcctctagataatcgtccagaccagctgacaccttgatttcggcctgtagaacctggagcagacccagacaacccaccgacctctgacttacagaactgtgagataatagatttgtgttattttgagcagctgaactccggtaacttattactgcagcaatagaaaataatagacacacaatacagcccacacctccagaaccccggggcttctttcctccctgggctctctggggaaggagcacaggctgtgcagtgagatcagggccctggcccagagcactcaccctttagagcctgtttcctcacctgtcactgggggtgccatcggctgctctgcctgcctctgggtggtggtgggattacatgagggaaatgtgagaagcccggaaatgatgaggcagcactggatcctgctgttcccttcctgggaagccggcttcctggtgttgtgaggagaggatgaggccgtcatgggagcaggtctgacctgggctctgaggaagcaggtgctctgctgcctttccacatcctttcctctgaggggggtcccgtctctgcaggcccgtgggtgggctccccggtgggacgcaatggcaccatcttaggcaggagtccccaactcctggatcagtaccagtccggccacacagcatgaggtgggcagcgggccagcgagtgttaccgcctgagcgcccctcctgtcagatgagcagaggcattagattctcacaggaacatgaaccctacacatgtgagggatctagattgtgccgaaaccatcccgccccctccaccgcccgttcatggaaaaattatctttcacaaaactggtccctggtgccataaaggttggagaacactggtctaagggttctggcaggctctcagatgaacctctctggatctttagggtgtctggccctcacgtgtcaggcccaaagatgcctgttagtctgtcgcagagggagaagatctggggaggacccatataaccagaactcgggagccagccgcaccaccatgagcccagatagcatgagtcccttctcttttctccatctctgctgccattccctaggccaggccaccatcatttgtcacctagaccaggtcacatccctgcataacctcctcccgctgaggagctcccttccccctcagaagaaaatccggacacatgctaaggcccacgagagcctgtacagtggggctcctgcctcgccagcgccacccgcatactgcattcccaccaccctcaaacttaccaggcctctgcctgcctcaggccctttgcatatgctgatacctcatctagaaagcactttgccatgcttttcccgtggccagctcttcattttttaggtctcagcctaaatgttgcctcctcaaagaaccattctcccactaccctgtatttcctgactcagctgcctttctttgttttgacacagggtctcattctgtcacttaggctggagtgcagtggtgtgatcatggctcactgcagcctcgactttccaggctcaagtgatcctcccacctcagcctcccaagtagctgggaccactggtgtgtgccaccacgcctggctatttaaaaaaaaaaatttttttttctggacacagggtttccccatgttgcccaggctggtcttgaactcctaggctcaaggaatcctcctgcctcagcctccctaagtgctgggattacaggcatgagccaccgtgcatggccttagctgcctatttgattccttcgtgacatctaacagaacgtgttatttcgtctacttgttattgtatttacctctctagaatggaagcccagtgagggaagggatctattttatcttatttgctattgatccgcaacacctggcagagaacctggcctatagtggatgcttagtaaatagtaaatagttgaaagagcccttctggaagaacacaaggctagttcctttggcaaaaattgggcatcatatcagagcttcttcactagcagattcagcagagctataaaattaaaagaaatgtgttctgtaatccctctgggaattccccacgggcaagagagcatgatgtgtgatttgcagtgacatatctataccacggtatgtttgtagtgactacttttcaaaagacaagatggaggatatacagctggtgaaagaaaaggtgtcggctttgttgagaagtcttactttgttgtctttcaagtgaaaagtgagctattttagtctaatggtaatttttaactatgttgaagccatacactttgggtctccattgtgctggaaatcgtcactacagctcctcccaccccacacccctcaatgcatgcatataggaatatagctcatgctatggaaatccactgtttgcacagcctggacattaggtaatagtttcccggctgaggtgcccagctggcttaacatgccattatttacagctctaaggtttattttcattattatatttaaacgtctctgcagaaggaatggaaggctaagagggtgggagagtagaagaggagagggagaagagtcactccagacgtcagaaccagacaggctcctgagaccgtgcaaactgggggatttcagattgcacacttggagtcagggcagcagtttggctcagcaggaggggaaaggggtgttagaggaaaaggctcctgccctccaatgttgtttgacccagatcaaccctactcttatgggtatcagcttctgggtaaatactcttttcaaagagggcaccatggcagaacacatgtgaaaaccatctagtttgaagtatgtgtgagaaaaacaactaattcacccttctcactgaccagtggagaagtctggccttatctgtctgtctcaggcttcttctccaaggttaaccccaacgggaaaggagaggggactcatcaaaggttagaccatgtcctgaagtgacctgttgaatttgcaaaacttctttttcagtgttatgttttatttttgcaatttgtggggggaaaatgcattctaggcttctgaaaccctttttagaagaaaatcatggtttcctcaaactcttcaagcttattgagttttcttctgtattatcctgtcctattgaaaaccttgtgcaaaagtatgtgtggggtgagaggtgtttaaacacacccggtggacagtgtctggctggggaggaaacgttagcctctcttttcttatcttatgagataatttaggaaatcaagtacaaggcccttgctgtgtgcacttatacctggagccttatttaggggatgttcttgcagatagatggggagaagtcttgctgggatcctctctggttttaaggcattttttttctcactcccagttgcctgcccatgtctggtttagcagcttttagaaacgtggctggcatccttttttcttttctctgacagcaccagcccctttatttgaacttcctagctgttttctgcctcttctgactaattaacagcaactaaaaaagaaaaatgaaacatagaacacaaaaaattccagggtgaaaaaggagaatttctagtcctggggtgcaaaagtccctagaagagagttttgagctgaaatgaaaagttgtgattatagagagacatgaaatgtgtcccataaaaggccacctagtcccaggcagatccaggaagagcactgggctgggagtcccatggggccagggcctcaccaagcagtcagccctgctcagttatcacaggggttgaactggattgcctaaatgatgcctttagatggatggaactggagtccattatcttaagtgaaacaactcagacacagaaagacaaataccacatgttctcgtttataagtgggagctaaataatgtgtccacatagaagcagattgtgggatgatggacaatggaggggtggggaagttggagctgggtggatgatgggaggttgcttgttgggtgcaatgtgcattggcccagtgatggatgcaccaaaggccctgactttgccatgacagaatatatcaatgtggcaaaactgcacttgtatcccatgaatatataccatgtttttaaaaatgttgcctttgggcagaggggataattctgcaaactgcagagccatggagtaaaaaaaacacccaagatagcagaacttgtcatttctagtttttccacaggaccataaagcaaaattggtgccgggtttgtatttaaagggaaaccaagagggtttttttatccttccatggtttcaaaatctggaaggacaatttgtacagaccctgagatagaaggattcctcagctttaatttcatgaacgatttgcctttcattgattcttgaggatatgaatgttttagaaagcaacagtgtatgccttgattttaagaggcaatgagccttttccttccttcgtttaggcatggggctgaatggagctgaaattcctgcactcttataacgtgccacatgaagggcagttttggattctgggaaaacagcccattgaaacagaattgggagggagaaacctcttacactcaggtcatggtatttatatgaatacaaaaaaaaatttaaatactgtgctaggtgctgggggttataaacatgaattacatgattagggcctctggaaacttgtgtggggctatagaaggaacaccagttcagaaatgtcactcctgtcatccagacaggatgcttcaccataggggcagagaccttctgctaagtcataccgcatatcaagaaatatattgctaggccaggcacggtggctcacgcgtgtaatcccagcagtttgggaggctgagacgggcagatcacttgagatcaggaattagagaccagcctggcaacacggggaaaccccatctctactaaaaacacaaaaattagcggggcatggtggtacgtgcctgtaatcctagctactcaggaggctgaggcacgagacttgaacccaggaggtagaggttgcagttagccaagatcgtgccactgcactccagcttgggcgacagaacaagactcatctcaaaaaaaaaatgcattgatcaaatcagcttaaaaatagccttcttgtttgctcttcttggtgtgggattattcagtccaattcttctactttttttaggcctcagcatgggatttggttgtcatatcaaccctataaacagtgttgaatccatgtcaataattgtattttttaaaagcaaatatcaccaagtccaagaaactgatcctcctctgaacatgatagctggactaggctaagaatcctatttcctgttagatcagaagtgaagattttctggtacagatttgggtgggagaaatgagctacccttcccaaggccttagcacctagatgacatcctctctgaagtcaccctcagccaggagcggacactgagctgctatttctgaatcacatgtccccaaagctgccctggccttggtgaccatggcactgtaagagaagcacagccagccccagcgtccttactctgactcagaggaaaatgcaacttgagctggattcattgaaatcttttttttcctggcctgaaggaaatgaagaaacatagccaaatattctaaaacaggattcaacaaacagcccataggccaaatccaccactgcctgtttttgtaaataaagttttattggaacacatctatgcccattcccttatgtattatctatggctgcttttgctctacaacagcagagttgagtagtgtgactgagaccatatagcctacaagcccaaaacatatactgtctcacccttttcagaaaaagttgccagccttgttctaaaagaagtagagtaaggatttagtgagaagctggagaaaatattttcaaagacaactgtattctccagggaaacctgagatgaagaccaaggtgaggaaggagccagcagagaaatcgagtccatgaggctgaggaggccactggatgtccagtcttcagctctctgaagcctgagacaggaaacagttgtctcccgagagaaaggtttgaacctcctttaactagggaggaataagagatgatggcttcttagatctgtttacatttgctggaaaaacttcttccagggaaataactagacagggctttggccaactagcaggtgaagtctggagggaggtggaagagactgcttccaagctgggttccgatttgtctgattgaagcagccaagcttgtgtttgccagaggacttaggaggatgtggataaaatcaggctgaggcctttttttaaaggcccaagctggagctattgggattgttccctcagaggaaaatcaggagtttgggccattggcttcatggagaacctgtactttgtaccaaggagaagtcatttctacttggtttttgaaactgcattgtcatctagtattccaaggctttagtctgtccaccctcctgctccagagagatgcctttcagttccttaggaaacaaattggccatttgcccaaagagactaatccaggactagaacacaggcactgagtttcaacctcaggctccccagtgcgtgactcaggtctcttgattccatggtgtattgtttttttacctattaaacaattgcattcctagcctatggaaggtcttacctaagccaagactttggcagggattggattgtgcagcccatttttgttaatagcattgcccaagttagggaaggccattaggttggctgagtattctggtattctattgctgcataacaaactctgaaatttagtagcttaaaataacatttattttgttcatgaatttgatttcattgttttttaatgtatgtaaggtatataaaatgatgttttgatgtacatttacatagtgaaatggctactatggtcaagcaaatgaacatatccattgcctaacatagtttttttttttttttgatagtaagagcacttggaatctactttattgtcaaatttccagtatataatacaatattgtcaacatagtcatcacgctatacattcaatctctaaattttttcatgctacctaaccaaaactttgtacctttgaccaacatctccccattccctactccctaccccctccccgacccctggtaactatcagagtttcactttctggttctgtgtatttaacttgtttagattccgcaataagtgagatcatacaatatttttctttctttttgtgacttgtttcacttagcataatgtcctccagtttcatccatgttatcaaaaatggcaggatctcctttttaaaggctgaataatattccattgtatgtttatatatgtgtatatatatatgtgtgtgtgtgtagtatatatacatatatacacaccacaatttctttatccattcacctgttgacaaacacttaggttgattccatgtcttagctgttgtgaataatgctgcaatgaacatggaaatgcaaatatttctatgaggtactgatttcattctctttgagtatatacccagaagaggaattgcagggtcatatagtagttctatttttattttttttgaggaacctccatacttttttcataatggctgtaccaatttacattcctaccaacaatgtataagggttcccttttctccatgccctcactaacactttttatctcttgtcgtttttatagtagccatcctaactgttgtgaggtgatatttcattgtgacttcgatttgaatttccctgatgattagtgatgtggatatttcagcagaaaccttgcaggtcagaagagagtggggtgatatattcaaagtattgatggaaacagtgcctcatacctgtaatcacaacactttgggaggctgaagcaggaagatcacttgagcctaggagtttgagactagcctgggcaacataatgagaccttgtctttacaaaaaataaacagaaaattatccaggcatggtggcatgtggctgtagttccagctacttgggaggctgaggtaggaggatcgcttgagcccaggaggtagaggctgcagtgagccaagatgatgccactgcactgcagcctgggtgacagagtgagaccctgtctctaataaattaataaaataaaatttaaaaaccctactagccaacaatactatacccagtaaacctgtgcttctcaagttgaaatgaaaggacactaaatagcacaagagagcataataaagaaggaaactcgttggtaaaggtaagtatatggacaaaatcagaacactatattactataaaggtgatgagtaaatagcttttatgtctatgaagaaagttaaaagacaaaagtattttaaaaaccattataagtattaactaaattatgttaatgggtacataatataaatagatataaactgaggcatcaatagcatgtaacttggggggagcagagggaaaatcagagtttttatgcaagtaaagttacattgtgaacttataacagactgttacaaattatttcgtgtaagctcctggtaaccaccaagaaaatacctatggaagttatatatataaaaaaagaaaggaatcaaaacctatcgatacaaaaaaaaaaaagaaacaaaacaaaagaaaaccgcaagggagaaaaagagggacaaaagaacaagacacatagaaaatagtcaccaaaatggcaatagtaaatctgtctctatatttactttaaatgtaaaaagactaaccttcccaataaaaagatacagcatgactgaatagattattaaaaaaaacaacaacaaccaggatcaaactgtatgctgtctacaagaagctcacttttagattcaaggacacacagagagatggaaaaaggtagtccatgcaaataccaaccaaaagagagcaggagtggttaatacttatatcaacaaaatagactttaattcaaaaactgtctctagagacaaaggtcatttcttaatgacaaagggtcaattcaacaggaagacataacaattataaatgcacccagcatcagagcacctaagtatatacaacactgacagatctgcaaggagaaattgatagcactataataataggagatttcagtaccccactctcaataatggataggacatctagacagaaaatcagtaaagaagcagtagacttgaacaactggacctgtgtaacaaatggacctagctggcatatacagaactgttcagccaacagtggaagaacattcatttttctcaagtagccatggaacattctccaggatagatcacatattaggtcacaaaacaaatcttagcaaatttcagatcgaaatcataccaagtatcttttccaaccacaatggaatgaaactagaaatcagtaacagcaagaaaatgggaaaattgtttgtgaattcatttgtgaatttgcaatttggcagagcttgatcaacacagctctctgttccatataatgtctatcagctggggcaactcaatgggattggaggacatctctgaggttttcactgtcatggtgactcacgtagcctgcaagttgatgtggcagtcagtgtctcctgtgagcctctgcatggacagcttgtgtttcttgcagagtggctaaattctaagaacaaatgccccaagaaaattaggaggaagctctattgctttttatgacctagtctcagaagtcacatagtgtcacttccactgtagccaaaagtccacccagattccaggtaagggagcattagaccccacctctctatgggagtagtttcaaagtcacattgtaaggagtgccatcatcgagatattgttgcattgatttttggaaaataatttacctgcacagaggtaaattcacatcaattctttgtctccttatttcaccatccattaatgtttgtttgtttgtttgttttgagatggagttttgttcttattgcccaggctggagtgcaatggttggtctcggctcactgcaccctctctctcctgggttcaagcaattctcctgcctcagcctcccaagtagctgggattacaggcacccaccaccacacccggctaatttttgcatttttagtagagacagggtttcaccaagttggccaggctggtctcaaactcctgacttcaggtgatcacccgcctcagcctcccaaagtgctgggattacaggtgtgagccaccatgcctggccccaccatccacacccagccccaccatccattaattaagcttcatggtgttcactcagtcacactgttgtcgctctcatttgccaatgttaaatagtgatgcacagtgcctaagacaaaattgctatcactgcaagctcctacccctggctaaatgctaatctggatttatgggacagtgacgagtgctattattttcattttataaatgaggaaactgagtcctggagggaagaaaagtcaattttcttaatgtaatacaattaaaataggattacactttgaatttccttatttcttaactagtattttatctttccatgattgtgcttaattttatcttatcagtacaagcactcatataacctgtagggatatttgtgtacatgtgcatgtgtgcatatacacacacgcactgtgtgtgtgtatatgtcaaactcagtgcttgcctttgttggatggaaattcagcagcactggaggactagacagctagaaaagccagtttcagggacaggaaatagtagagttcaaggaaaagttaggacaaggaaaatgagtctttacaaagcaaccaattcctcgtgagaagtctttgcatctcacatggctaagagacagtactttggttaggggcctggagctttggttttgatgaacagtgtgctggtattggctctaagctggggcatccaccatttggctccccatttgagtggtcactctgtctctcagagcaatgtgtggtctttcggtgttgataaagcagcaactacatgccaggccctaagggcaggcacagaggcaagcaagaccagtacagtgccccctgcaatcctcttgggacatcattttagcaggggagactaccattgaacatgtaatgataaaattgattagttatgattgagatgagcagtaggagggaaaagtgtgtggaactgtgagagctcacgatgggcctgaacttgcccagggactcagagaagtggtctggatttgcttgttgaagggtgagaggacatgtactaggtgaaccagctggaggaatctggggatccacttgtggggaggccctgggtgggaagttgtaaggacaaccagagtgatagctggcatgagaaagccagggtgacagaggtgaggagggcacatgccagatctggcagcctgcatgtcaccagatggatttaggtcacatcctgttcttccgttctcacctctttcacctccatctccacctccacctctaccccttcacctctccatgcctcacaaagttggactgtcttgcctgtgagacaggaaaggcatgtgtgatgaggggactgtacactaggggccagtccaggttttgtgagacctgaggcttatatagtagagggtggggtcttgaaggaaaaaaaaaaaaggtgaaattatgaagacaaagtttgtgcaaggcttccctaggggccatgtcagctggggacctctaagctgaagtttcactagtgtggtggggaagctccctttggcaccttccctctgtcctcaaagctcataaagcccacctttcatcttgcctgagacgttcatgccatccttacacccacttcctcctgttttcttcttagttaagatggcaaagaaagagcaaatatattgaaatctcctggaaatttggctctctccttgaccccagtagtgtccaaaagaacacaggaatttcctcttttttcccaagacttccatgatattttccctgataatcaaggaagggagtgttggctgggacacttttttcttttggaaatgtggcaggggaatatgaattttcataggcgaaattactctgtctggtcgagtctagactgttcgttggccagcacgtttgctggcgcccacactgacactctgaggtgctgcctggacttattctctgggcagggaagaaataacctggaactacattttggggaaaaaactcacgaacatgagcagtgacaaggaagaagtttaataatgagtaaattacaactaaaagttgtcaacaggctcttctctccaaattccactgaaatgagcaaagccatctaacagtagtgaagagtctctgtcatctggaacttggggaagctactgtccatagatctgaaatgtcagagaggttgagacagattgaggggaagactaacaagccctccatggaccgtagaagaaagccctaacccctctccaaatgctgctgctgatctcctggcaagcctccacagataggcccaggcccaggcacagccagcaagctctctggaaatatttgggttttgacatgccaagacttggccccagtaagggctgggtggggctttggctgttgaggcccagtcttggttagagaaaaggcactgtgtccctgttaactgctggctgccccaccaacaaactggaaagaatctcccccagtctgttgtgattccctcagcctgatggcctaattgcctttgccttttcctgttaatactgacaattcaatacagtcccattgctcaggcagaacctatttcatatataaatttcctgcatccccaaggcagagcaaatagggggaaatgaccaaactataatctgagagttctttactcaactggattatcattcatctaagagcatctgaaagacagtctcacacaagcaaagactgaaaggacatccaccaccacgtacctctcttgaaaaaactgcttggagaagcacttcagtagactagggaatgaatcaaataagtaatgcactgacaaaatcaaaaccacagttgacttaggcttccttggagcttggaagaaccccttcccacgctggagagctggctttttggaggtgggagtagaagccctgaggggctcaggggaggaattcccactgatttgcaagaaaggaattggccactgtgtactcgtttgccactcaatcctgccctaaccttcctctcctgtctttctcacagactgtttttgaaaggaattgccgttcagaggactgtgccgcagacctgcagcttcagggtaaactgctgctctccaggtatgtcggtgtttccttcagagcattgttctcaggctcctttttcttgaccccaggtcccaaacctgaatgtgcagatttccccactgaagaggataaacagagttgatgggttacagtaatattctgtggttttaaaaaaatgtatgttacaaaataattataacaaaagctttgttgggaagattgtttaggtttttttgtgtgttgattgcaattccacatatctcacaatgtagcttgtatttctaatttctatgagtatttgaggggtggctattttatgcttgctgattgtattaagttgaatcatatgaaattgccaatatttgaacttttggacaatttcatatgtatgattcatcctattattaaataaaggtttatgccctcctgcctccacacacacacacacacacacacacacacacacacacacactagtgtatgttttaacaagtaacatttctgtggcaggagagggctgaaggagaggggcaggctgccctgatccaagtgagcagatagtctccttattgtttcagggtttcctcccgcactgcatgaatcccccaaggctaaaggtgaaccgtacagcggccttctgtttcctctttgccaaccttttattttagacttcatttaggatgaaggtgctggtcctgatcatttagcctcatttcacagaatggcttccttttgaaacagttccttctgaaagactgttttagccttggggccagaaacccctctattagttttattaccatttctgaaaaacagtcactagttttggtagttatttttcaaaatgcatagtgtatcccttacttaaaactatgagagttaagtttggatgaaatgacatgaatatactattatgaaccagtgcctacactaggacattttttttattgttatactttaagttccaggatacatgtgctgaacgtgcaggtttgttacataggtatacacatgccatggtggtttgctgcacccatcaacctgtcatctacattaggtatttctcctaatgctatccctcccctaaccccccacccctgacaggccccggtgtgtgatattcccctccctgtgtccctgtgttgtcattgttcaactcccacttatgactaagaacatgcagcatttggttttctgttcttgtgttaatttgctgagaataatggtttacaccttcatccatgtccctgcaaaggacatgaactcatccttttttatggctgcatagtgttctatggtgtatctgtgccacattttctttatccagtctatcattgatgggcatttgggttggttctaagtctttgctattgtaaagagtgctgcaataaacatatgtgtgcatgtgtctttatagtagaatgattcataatcctttgggtatgtatacccagtaatgggatggctgggtcaaatggtatttctggttctaaatccttgaggaattgccacactgttttccacaatagttgaactaatttacactcccaccaacagtgtaaaagcattcttatttctccacatcctctccagcacctgttgttttcttgactttttaatgattgccattctaactggcgtgacatggtatctcattgtggttttgatttgcatttctgtaatgaccaatgatgatgagcattttttcttatatttgttggccgcataaatgtcttcttttgagaagtgtctgttcatatctttcgcctactttttgatggggttgttttttttcttgtaaatttgttttagttctttgtagattctggatattagccctttgtcagatggatagattgcaaaaattttctcccattctgtaggttgcctgttcactctgatgatagtttcttttgctgtgcagaagctctttagtttagttagatcccatttatcaattctggcttttgttgccattgcttttggtgttttagtcatgaagtctttgcccatgcctatgtcctgaatggtattgcctaggttttcttctagagtttttatggttttaggtcttacgtttaactctttaatccatcttgagttaatttttgtataaagtgtaaggaaagggtccagtttcagttttctgcatatggctaaccagttttcccaacaccatttattaagtagggaatcctttccccattgcttgtttttgtcaggtttgtcaaagatcagatggttgtagatgtgtggtgttatttctaggcctctgttctgttccattggtctatatctctgttttggtaccagtaccatgctgttttggttactgtggccttgtagtatagtttgaagtcaggtagcatgatgcctccagctttgttcttttggcttaggattgccttggctatagggattcttttttggttccatatgaaatttaaagtagttttttctaattccatgaagaaagtcagttatagcttgatggggattgcattgactctataaattactttgagcagtatggccattttcacgatattgattctttgtttccatgagcacagactgttttttcatttgtttgtgtcctcccttatttccttgagcagtggtttgtagttctcttgaagaggtccttcacatctcttgtaagttggattcctaggtattttattctgtttgtagcaattgtgaatgggagttcactcatgatttggctctctgtttgtctgtttttggtgtacaggaatgcttgtgatttttgcacattgattttgtatcctgagactgctgaagttgcttatcagcttaaggagattttgggctgagactatggggttttctaaatatacaatcatgttgtctgcaaacagagacaatttgacttcctcttttcctatttgaataccctttttttccttctcttgcctgattgccctggccagaacttccaatactatgttgaataggagtgatgagcgagggcatccttgtcttgtgccagttttcagagggaatgcttccagcttttgcccattcagtatgatattggctgtgggtttgtcataaacagctctttttttttgagatatgttccatcaatacctggtttattgagagtttttagcatgaaggggtgttgaattttgttgaagcccttttctgcatctattgagataatcatgtgtttttttttcattggttctgtttatgtgatggattatgtttattgatttgcatatgttgaaccagccttgcatcccagggatgaagccgacttgattgtggtggataaactttttgatgtgcggctggattcagtttgccagtattttattgaggattttagcattgatgttcatcagggatattgacatgaaattttcctttttcgttgtgtctctgccaggttttggtatcagatgatgctggcctcataaaatgagttagggaggagtccctcttgttctattgaatggaatagtttcagaaggaatgataccagatcctctttgtacctctggtagaattcagttgtgaatccgcctggtcctgggctttttttggttggtaggctattaattactacctcaattttagaactcgtttttggtctactcagggattcgacttcttcctggtttagttttgggagggtgtatgtgtccaggaatttatccatttcttctagattttctagtttatttgcatagaagtgtttatagtattctctgatggtagtttgtatttctgtaggattggtggtaatatcccctttatcattttttgttgtttctgtttgattctctgttttcttctttattagtgtggctagtggtctcttttgttgatcttttcaaaaaaaaaaaccagctcctggatttgtttattttttttttgaagggtttttcatgtctctatctccttcagttctgttctgatcttaattatttcttgtcttctgctagcttttgaatttgtttgctcttacttctctagttcttttaattatgaagttagggtgtcaattttagatctttcctgctttctcctgtgggcatttagtgctataaattttcctctaaacactgctttaggtgtgtcccagcaattctggtatgttgtgtctttgttctcattggtttcaaagaacttatttatttctgccttaatttcattatttacccagtagtcattcaggaggccattgttcagtttccatgtagttgtgcagttttgagtgagtttcttaatcttgagttctaatttgatttcactgtggtctgagagactgttatgatttctgttcttttgcatttgctgaggagtgttttacttccaattacatggtcaattttagaataagtgtgatgaggtactgagaagaatgtatattctgctgatttggggtggaaagttctgtagatgtctattaggtctgcttggtccagaactgagttcaagttctgaatatccttgttagttttctgtctcatgatctaatatttgacagtggagtgttaaagtctcccactattattgtgtgggagtctaagtctctttgtaggtctctaagaacttgctttatgaatctgtgtgctcctgtattgggtgcatatatattgatgatagttagctcttcttgttgcatgatcccttcaccattatgtaatgccattctttatgtttttttgatctttgttgatttaaagtctgttttatcagagactaggattgcaacccctactctcttttgctttccatttgcttggtaaatattctaccatccctttattttgagcctatacgtgtctttgcacatgaaatgggtctcctgaatacagcacactgatgggtcttgactcttcatccaatttgccagtctgtgtcttttaattgggtcatttagcccatttacatttaaggttaatattgttatgtgtgaatttgaccctttcattatgatgctagccaattattttgcccattaattgatgcagcttcttcatagtgttgatggtctttacaatttggcgtgtttttgcagtggctggtactggtttttcctttccatgtttagtgcttccttcgggagctcttgtaaggcaggcctggtggtgacaaaatctcagagcatttgcttctctgtaaaaaagtttcttcttcgcttatgaagcttagtttggctggatatgaaattctggtttgaaaattcttaaagaatgttgaatattggcccccactctctgctggcttgtagggtttctgcggaaagattcactgttagtctgatgggcttccctttgtgggtaacccaacctttctctctggctgcccttaacattttttccttcatttcaaccttggtgaatctgatgattatgtgtcttgaggttggtcttcctgaggagtatctctgtagtgttctctgtatttcctgaatttgaatgttagcctgtctttctaggttggggaagttctcctggataatatcctgaagagtgttttccaacttggttccattctcctcatcactttcagatacaccaatcaaatgtaggtttggtcttttcacttagtcccattatttcttggaggctttgttcatttcttttcattcttttttctctaatcttgtcctcatgctttatttcattaagttgattttcagtctctgatatcctttcttctgcttgatcgatttggctgttgatacttgtgtatgcttcatgaagttctcgtgctgtgtttgtcagctccattgggtcatttatgttcttctctaaactggttattttagtttgcaatttctgtagcctgttttcaaggttcttagcatccttgaattgggttagaacatgctcctttagctcagaggagtttgttattacccaccttctgaagcttacttctgtcaattcatcagactcattctccatccagttttgttcccttgctggtgaggagttgtgatcctttggaggagaagaggcattctgatttttggaattttcaacctttttgtgctagtttttcctcatcttcatggatttatctacctttggtctttatgttggtgactttcagatggggtttctgtatggacgtacactagtacattttaacttatgatggcacatgatctttcattcatcaaaggaaagtaatactaagattccttttcttcagtttgagtttactggaggaagatgatgtaacacacacacacacacacacgcacacacacacacacaaatagtcctccaaaccacttaaatattaattagcattacttttacttagggcaatagtggtagattaaaatagcacacgttttgccaagcttacaaaattacttaaaactcatggcatggatattagaattgtttcacattagtacgaaggacctcctgggattattagaggaactgactttaaagaagtttcataaatttgcagctcattaattttaattttaaataggccttccacaaagtgttttagggaaaaaataacaagaaacaaaaatatatggatttgttttgtcttgaggcagactggaaatgctggaaatttattttggatcgtagaaaaacttcatgtggtgggaaaatgttcacttgctccaaggtcaggtattaagttagcaaagtcctaatgcttttgctacccattagtggatgatcaaatccatctctattgaattgtgcttttcttatattaagatgtaaaattcaaggctcagtatagcacctggtggctaaagctgcctccactgccccagtctggcctttcaagtgtggtcagagctagttatcctctgtgggcccagtaatcaataatgcttgaacaactagtgtggtggccaggacccagtccccccatatgtatcagctaccaattgccacaaaaaaggctgaataaaaaagtcaccccaaaactcgatgatatgaacagcaatcactgattcccatggattttcaggtcagctggcccaggctggactcagctggaccttggctgatttgtccatgcatctgggttcagcagagggtaggttctaggcttgggtgacaccattcagctctactccctgtgtctttcattttttctttggaaccagtggacaagcctgggcatattctcacagcataacagaggtacaagaaggcatgcagaaatgtgcaatgactcttaaggcctgggctcagaactggtgcacttttcctccagccttattctattggccacagcaagtcacatggccaaacccaaagtcaagggacaggaagttagtgagaggaattacaaagccacacagcaaagggcctgagtataaggaggaggtgaagacttgggacccataatgcaattgactatactatataaacagcaaggtagccctgtctcttatcctgatgccttgttgttatcagggctatttcagtctttattgcaatgccgtctctctggaattcagacatgagatctggagactgggtgagaagattttctgaacctcagaaacaatgcctttggaccgaagctctcagcctcttaggttgggttatttctcagaggacccctggcctctcaaaatagccttttggccgaatcctccattaaagaaaccttcgttgtacttttgggcccatagctgttctcacaggaaccatcagagaaatgttcattgatacttagataacaaacctgtggttcagttatatgggatttatccagacctttggatgttcactcttcagagccagggacaatgtgagggaagatacaatcagttaagtgctagtggaaaccagggtctgaatttggttggcaaaggcatagtggctccaagcagaggtaaactgctttggttatcattgagctctcttgattcattcttgtctgggatggaatgtgccctcctttcttgttcaagccaggcaagtgctaggcactgggctgcagaagtgagcagtatgtgagccctgctctcctgctgtgagcagagcaagaggctgggagatagtggtaccacacagtgagtgctaggtgggttactccagggctctggagcagcttccaagaggtggtgttgagaggaatgaggactcacgcattccaagcagagggaaaatgtgagcagaagtatggagaacaggactcccatgaagatctgcaggtgtctggaatgaaggaggcagtcaggagaacacagtgagagacagggaaggagaaagggagagaaaccagattgtggaacacttatgagtctggacttcatcttgaagccagtgggagtacagccaagttgtagtgtaagtgcttttaacctaacaagaatacagccagggggccaggcgcagtggctgtgcctgtaatcccagcactttgggcggctgaggcagatggattgcttgagctcaggagtttgagactagcctgggcaacatgtcaaaactccgtctctaaaaaaacatacaaaaattagccaggcgtggcagcaagcgcctctagtcccagctactcgggaggctgaggtgggaggatcacttgagcctgggaagcagaggttgcaatgagctgagatggcaccactgcactccagcctgggtgaccgggggcaaaaaaataataataataatgcagctgggcacactccaggagccagggtggggaagggagaggagaacattgagatggtataggtcattttaccctctattcctctcagtgaaagtacgttccagcttgagttttgagtttgctcctctctccaaccataacagttcctgcttccctgccttgggtaggtctgtggggcagctgcccttcatctcagtgcaggagcagccttttcagggttggacttatgagagatgttgtgctgatttccaccatggtgcccccctcccagggcttcacaagggcaacttggacacaatttttgctttccgtgatgtctttagaacttagctctcctgttagccgtgaccttactcactgtacgaaaagtcgaagcaaaggggtcacagagaaagatttctctgatgactgtgtagacagttggtccatggtgttgtggctggaggcctctgaatacccaccagactgaggagcctttgtcttaagacagagggaaggacatctgggagtgattgtgtcacccagagtggccagagatcaagccataggaaatgctgtctgtgaccaggattcatggatgtttttattttcctctctggagagcatgaattctggcaggcctgtgatctcttaaaacaatcaactcttcaattagaagttcatgatctttaatgggcttgagtccagttccaaaacaggccattgtcaaaacgtccaggaacagggatgaaacttgtttaaaagtttctattaagcaggactgaaaattccatttgtaaaaggatgcaactatgttttgtctttttgaatactcacagtacctaagaaagcatcacatatgataaagaaaaagactatggcaagtgagctttaaaaaaattctttttttgatgcattccatcagaaatcagtggaacatttcattgctgtctggctagccaactccgataaaataaggacttttaagggagatggaaagacacagcaggatatctgtaaagccagaatcatctggtggcaacatataattgtcctatggttgtaaccttgatagtgctgttaccatgggggttgggtggtggggcgaagtgcatttcccaaaactgttggctagctgagggatgagagctccatccatgaaaaccagtcttccagaggaggatccccaaacccagagagctatttagagtttgaaacaaattgttctccttctcaaaagtggcagaatggttagaatcatcaactgcacagcctaggtcagaagtgaagtttgtcctgttttatgaagggaaagacacccttgtttagtgagcactgaccaagcactagataccccactgaatactccatatacataaaagcactgaagtatcttaccagctgcataaccttgagcaagttgcttaacatctctgcctgttttctcctctgtgaaatggggaaaataacagcagcaccttataaggttattttgcatattaattaattaatacatatccaagtgcttctaaaagtgcttagcatataaggaaacactcagtagtgaaaactagcattattatttcatttaatcctcaacaacactgagaataaatattcttatactctttttactgaggcggtgcagaggctcaggaaggccaggttacttgctcaaggctcatgttgtatgggaaagttaaagcttggaatgtctgattctacatcgcgctctcctcctgtacattggcttctgttgtctctgggttcagctatcagctggctctagaccagaggtactaaggctagagaccttgggtaaaaagtcttcctctctttgaaagccccaatccagagaggaggtagatgggcaaaaaatccaccagcaaagatagctgccatccctcccctccattctccccatgtgctgtctgacctggaggccttgttcaatagcttttcctcctggagacacaagcaatctgtcctgctgggtcagtggcagtccttgcattgagtcagcacattcttttttttttttttttttttttagacggagtttcgctcttgttgcccaggctggcaatggcacaatctcagctcaccataacctccacctcccgggctcaagcgattctcctgcctcagcctcccgagtagctggtgttacaggcatgcaccaccatgcctggctaattttctatttttagtaaagacagggtttctccatgttggtcaggctggtctcgagcttcccatcttggcctcccaaaatgttgggattacaggcatgaaccaccgcgcctggccgagtcagcacattctttatctatgtaggttgcattttctctccttggagagcctcagattcaatggtgagcttacggctggcatgccagcagtttcctaaaatgtaatatcatcactattattgttattatatgagggaaggtgaataggaactcatcagaaacctggaaaatgttgtcagaacattagccgtgtaatttttttccccttcattgtctgcaccagctctgaagaaaaaatgcagaagtttgttgatttggagtagctggctttttttttttttttttttagatggagttttgctcttgtcacccaggctggagtagagtggtgtgatctcagctcgctgcaaccttctccgcctgggttcaagcgattctcctgcctcagcctcccgagtagctgggattacaggtacccaccatcatgcccagctaatttttgtatttttttagtagagatggggtttcaccatgttgtccaggctagtctcgaactcctgacctcaggtgatccacccaccttggcctcccaaagtgctgggattacaggtgtgagccactgtgcctggcctagctggctttaatggttgctgtttctggaatctctggctataggaatggatttctcaatggtatattcttgaaagaaaggcaaaatgctcaaccaaatggaactttttgaataagagttgacagattgctcatccttgccctcctcagaacaagtgtttgccgtttctctgatgtgggccttctttttttttccgaaaaagtctcactttgttgcccaggctggagtacagtggcgctatcttggctcactacaatttccacctcccaggttccagtgattctcctgcctcactcagcctcctgagtagctgggattataggcgcccaccaccatgcccagctaatttttatattttttagtagagatggggtttcaccatattggccaggcgggtctcgaaatcctgatctcaagcaatccacctgccttggcctcccaaagtgctgggattacaggcgtgagccaccgtgcccagcctgatgtgggctttctaggagggggcagcagatgcctctcctcacatcccagccacgcatcaaggatgaatggacatgtgggtgtcttccgtgggagttacctggcggagggtgggatttaggccccagggaaggtgaggagcagtgtaagggacagtcacactctgggaaagacatcgaagggtgacatgcccttccagagagcccagcttctgttcacctgatgagaggtgacacaatgctacggtgttcattcgtttgacaaatgtggatggagcacttgctatgggtatgccagacctggtggaaatagacacataatgctgcatcacaatgctcccagtctagaaggggagacacacatgaaaacaggtatcactaactatagtcatgatcacgatgggaatatgagggagttccccggaagcacaagggaggcagcactctacatggtctgaggttgagttctcctagaagcagaccatgagacaaggatttgagtgcaaataattgagtgagcagtgcaggaaatgaagaagtaaggaagtacacagggaagcctgcggtgaggatgtgccatagcacttgtatatcagttacttactgctgtaacaaatcaccccagaactccatgacttaaaccagccaccatttgtttagctcctgattctgtggccagctgttgaggctaggctcagctgtttgggtcttctggtctcatttgggccccctcttgcatctgcaggcaacctcgggttggttgggtgcctggctgttggtttgtggttcgctggcgttcctccgcatggtctctcctcctccagcaggctagcccaggattactcttacagtgtggccagggcccaaaatggagagcagcagtgcactagacctcatgaggcctagttccagagcaaatatattctcacttttgctacattctgttgatcaaagcaaatgtcacagggtcgcatggaaataaactctgcttcctgatgggaggagctgcaaagtcacatggcaaagggtgtgatccagagaggctgtcaatcagtgcatcatcccctgctcccacagtggatgattggcactttgtcctgcagggaaacgtacctcttggaatgactatatctgagaagtgaaggagctggagtgtttgtaccccaattcctgagattcactggttgagggctactctgggttaggtgggtggggacagttagctccctggcacttgcatccttgtctagctatgggaaaaggcccttagatacaaaaatgcagacactggcagctgaaagtcagcaaaagcattggggtcagggtggggagtgtgggaggggatggcagggacatggatgatatctcctgtacccgctttcttaaagactctcagttgatgaatttattctgaaattccaacaggagtatcatatcaccttttgacatggaggcttcttcccattagcttcctaggaatactttcatttcatgttttgccaaacacccaacattctccagtactatgataactattctctattgcattcgtctggacccttttttccccttcactagcaagcataacaatatattattgcacacatgcagaagggcatttggctttacagcaaacctatgaaccatgtatagggctccaagttttgttcccattcgctgaggacagcagcaaaggcagataagggatgtgtccacagcacgtccacaggcagagaggataagatccctgagccctgcatcatcctgggagtgacgtgggccaagcctagccatgcagcagaactctgtgtttcttaggagccctggctccagcgcagctcaggcgtaagcacaacccatgactctgggatgcccctcaattgtcttacaaagtaactcaggcattgatgtggggtagagacaagcccagcacacaagttcttccaggttgggggattttatgtgtgtacttggagccagagcatttctggtgcagaataggaagctgacagacagggattagagtcacttatctgaggtcaaaaaaattaaatagcagaggcaggagaaacacctggtgggaggctccaaagcctgatattctagcaatttgacccatgggccctcactttaaataaccattgcagcttggggaacctggcctgtctttaggtggaaacaagttttggaaattcctcctattgcagaaagcatttgatttgcagtttcctgaatgcgaggctccaagtgtagggaccgccacccaaggacgtttttctctgttgggcagactcaaagcactgaggggagcttttcagggcccaccatacatgagcaacagatagctctccctacagataccatatttcagggacagccccttccctcctgagcagacactggctgagattttccagcttcgactttctagatggtgagaggatggggatgctcagagggacagtgaaggcactgaggcagtaactgtggcaaccatagaagaggctggccacgtgctcatagcggccttcctcctgagacacccgggaaggctgagtctacctcacaggtgtgcctgataaaatttttttgggcagtgttttccttggcttccaaacatagccatccattggaggttttatgtggaagcatctttccagcaggcacaatgacatggctatttcccttgtgactggacgcaaggaaaggatctatgaagagaatgtagccccgaatccctcccttctctcaacttggagcagacagggagccatgtgtggtttccttgctaagatttttgcagtttattctgtgtggctgtgtgtgttggtcccttgccaataatcctagactcacccatcccggcacaggcttgttactgtgggccaagccaaattctgaagcagcgcagttgtttgttgtctgaactcagtcttccccaacacatacttttcttgttgtcctgcacacaccctctcatcagcacccctcccaagtttgttctgagccacctgatataacctcaggtgaacaagaaggctgccctgtggctcttcacggatgaaaagccaaaggcagctgtggcttcgctttgtccccagtagtcactggccacggtgagacctgggtttaacatgacctgcccataaatcagtttgctgcaattgcagtgagagggaaggtaccttgtagaaaacctctagattttatgagcttgtttccctgactgcattccagagccacgtgtgagacttgggtttaacgtgacctgtccgtaaatcattttgctgaaattgcagtgagagggaaggtaccaggtagagaacctctagattttatgagcttgcttccctgactccattccaggtgatcttgatccaaaaatgacgaggctgggtggttgccattggtgtcacacccacatcccttgctgtgcaggtgcactgctcccagctgctgtgctggctgcaagctgctcacagtggcccgtcctttggtctggaaagtcacccttgccctgcctgggagggtgacttgttagccaatggctggctgatttggggtgtggattaactccctggtgcagtttatgctgcacagctccccttggtgtctggttgaggctagattccccctgtgcccacagccttggtccactcctgccctgtccctgccccagcctggttccctggctcgccaacagatccctggatctctgccacaagctctggcttccagggaagggagcctatcctgagatgcggtagaacctcatgttttatttatctgctcttagatctcctgtccgggcaggctgattgctttttaggattccaagtttcaaaaggaaatcaaatccaatgtatttatcagacattagtgggagagaaaaaaaaacagttgctcattggctttttatttgccctcttggaattgcagaggattttgttatttttatatttaaaaaccagacttgtggagtaatgtgtgggagaccccttcaggctggtccaggggactttgtgtctttagagattgctctggacacctcttccactgaggctttgtttttaaagaggactttccagacccaagggaatggaagggggctcccttgagagaaatggctttcatacaaaatgtccttactggtggggaactgaagacaggtacagtccttactgcataaggggacagatgatgttcagttacagtcataagcctttctcaccaggagcactggactctcctttaagaaagttttctgtgataatgagatttgaactggaagaaatgctgttctttcagttaacagttgtgttttttccaagaaaaaaaagaaatacaaatgttaaaacttttttttttttttctggtgctaaagaacaatttcacctcctaagccaagaaggaaaaaattctcatctaaaccgccaggcttaaaggtggctccttgtcagtcctgaggtggtagaattgaggtgaatgaagtcaaccacagtttctaatgtcttcttatatgccttcagaaacaccatgctcacctttcctcctgctgtcctaggctgagcctgccatccctccttccctctgtccatcacagcctccccttagggtcattaactcagtccctaccactcaccttcccataggacaggtgttcttaacctggagtctatgtcctcttgctgatctgtgaacccggataaggaaatgattgcattttgttttcactaacttcacactgaaatttaacatcatattcaattatgaatgtaggaaacagactacagtaatattaccaggacctgtgactctgtcccaaatagaaatcacaggtattgtcaaatcaagttagagttattgcagatatttcaaactaccatttacattcatccctccttcagagttatagcattagatttacctccagatctttttatttaatatgttttttttaaagcatattgctaaactacacatttgtgctctcccctttcccatagggctacctcacctcccaggagaaaagattcaaaatctaggagattcataatttcaatatattccattgcttgtgactatttatggccgtatttggttcctgagctagaaacagaaaagttatggccatgacagaattacttgtcaagggactatgatggccctgctaacctgggctttcttgagctgtctgccccgctagctttgatgaaatgcacatacactgcttgcattttctgtgcaatggccaagtgtaacaggcagcacacatgtggcagatcgtagcagcgggcccttgccgggtcaagtcatacatcgctgcacaccggggctgtcttaggacattggacctccgagcagcctgcagatcttgggaattcctctgccccctaaagtattctttgtctttaatccagttgttacagtgagtgaacctgatttgttccagatgtcctaagatttagtgattccggaaactactcctaaagtcaaggctgatgaggatttgaattcctctgttagctgggaaccagcagttcttttcacagttaaacagatgaggcaggaggagggagactgagctgccttgagggacagggaggggcccactgactggcttatttgccttgttagaaagaggatggcctttgaagcaaatatcgattctaccactacatggctggggccaaagtcagctgggcagggacatggacgtgctattttttttaaagtaatacatatttaccttaattatctgaatgttgttgctagggaaaccactattttggctcagatcatcttagtaaatgcttttttctctcactttttgagcataaaactggcccaggtgggtacctatgagggaggtggaggtatttctggcttcctataagtgagtttttcaaaccagaaattcagtcccaggaatgatttccctgacccactgtaaattttaattgaggtgcgttacaggggtgcactatgatctctctctggagttaataaccatatggatctgttttgcctgattagaagggatttctaaagcatgatgagatggggaagcacaattcaaactacatggcatagtaactcactcccagaggaagttaaaacatgtatacatacatatagaatgttctgtttaatattattggtttatgcagtatttgaatatataaatatgaacataaagccacgtacagttatggatttaaaacaaaagcagaacttaattaatgttgctgtttggatttttttcaagtgtatttgaatgcagacaagtatccagatagatgctagtggaagtctgggacaagctgtataagggtatcaacccagggttcagctggagctgggccagactactaggttgtgtatttagagaaactagggcaggactgctggagaagaagctgagtggtgccaaggtagggcagtgatatggtttggctgtgtccccacctaaatctcgtcttgaattgtagctcccgtaattcccacatgttgtggcaggaacccggtgggaggtaaataaatcatgggggcgggtctttcctgtgttgttcttgtaatagtgaataagtctcacgagatctgatggttttataaaggggagttcccctgcacacactctcttgcctgccaccatgtaagacgtgactttgcttctcattcaccttccgccatggttgtgaggcctccccagccatgtggaactgtgagtcaattaaacctctttcctttataaattacccagtctcaagtatatctttattagcagtatgagaacaggctaatacaggcgggataggcacacctgagaaggaggacagggtcagataaggtggtaagctttgaacagaagaaagcgtatcataggggatgttgagcttgttgggatgaggagcatccaatgggctagagcaggtggtttagggctgaggctgtaaaccacaggggattacctatgtttatctggggcaagttgcaggataaccacaggacaagactagtagttggacagaaataccaatttttattattctagaatagattaaaatataaaataaaattagattttctctaatatatttagaattgaacctttttgggtacaatattcttttttagtatttcttggtgatttttttttttacaacaaaaaatagagcaatacctttcttggttagtaaaataaatccctaaatatttgccacaatctctagaatcttctaaatcaggaaattttaatgattttcacagcagtgaaaattgatattcatattctaaataattccatgtttcactgaaatctgcaggaatcgaaaacaataggcagtcactaactaaaatgggacagcaagacagaaacagtttcctatccctgtaggaaagagaaatctcggagctttcattgcatgaaaaccgactccattttagtacctcgttgcactttaggctttccttgtccagagttctcacacatgacagtgagctccaactacaacctattccaagctgagagtaatggactgagaatctgaaaacatgacacatcaatccattccccacctttcccctgtgagactcaaaaaaacatttcccaggctcccttgcagataagcttcttgggaagttcagccagtggcatcactggtgtgagattggagaaagggaggaggagaaaagtcagggtgtttctccttaactccactcactttaagcagcatctctggcagtagctacttctcctccaccgtcttagctccctcttggcagtcccagtcccagtcacaatcacaacacctcctccctcagtccctccaactctaagggtgtcagcagttgcttctgatctcagcttttccttatcttaccttgtttgctcttctggttcttttcacacctttgtacctggttccccattttaatcccttctatgaactacctggcatgggttctgctttcctctctggactctgactaatacatagtgggtttgaatcctggtactgccactagttactaaataagttattaagttgtctaccttatttagtcctcaatgtctttgcaaaatggggaggaggttggtctgtaatgaattctgagatcccttgaagctttgaaaatccgtgagtctctaaattttgatctcataatacatattcatgaaatgagtgtatttttctagctccattacagagatagtttttattatttgctttctaggacatggccttagccttcataatactgtttgtttacagatttcatgaaggcatttaccctggcattgtaccactaaaggctgatgttggcggcattattcttaggagacatagaaatgttgtggttttgagaatgggcttttatattatttggcgtagattattaaagaacagttacctgtgtcatgaaggagaggcccccagactggcactttgaatgcaaattcttctgtgacaaatccaggggactttggaataactctcagatatggcagtagacttaactgtaaaagctcccagcccacagaggtgagcagaggctgaggagtaaacaccataccaacattctgggacaaaatagcctgaatgctgttgtaccttggaaatgcaatagcagctgccttcctaggtggggaagctgagagcagcctcttacaggagtgcatgccctatagacagaggctcatgaacttgtgcttgctgacatgtatatcttcttcagttggtccctagtgagtctacccaaagtgaattgcactggggaaattcagaaatatacacccctcagattcaacaagggtggtatcttgtgtgtttcctttaagttataccagtttatggcaggggcaatgttcaaaatagttaagaacctgcacagcatgagcacacctacctttaagaacagttgccagtcatagagaactggtacagctcccctggtgcaacccactgatggtcagtctggggccaggggtgtctttggtcacccacacccacatttggctggactgtgaggcctgggacttgaaccacatcagtagaaattgaggctatggcacctgggatgtctccttgtgacagttacgcaagaaggaaagtgaacagaatgtggatcccaagggttgggtagggtttgtccagagccttgggtcctttccagaaggagcttgggcccctgtaattcagagatattcagattaactgatctggtctcctgccagtgacaggcctcactcactggaccattctcctattcagaaagctgacataggatcctgtagcaggaatgatcagtgctggctgcatcccttttatatttatgtgctatgctggtatgcagctactagtaactatatctctttgccttttctgcctaccaagtatcttgccagaggtactgggagtagatgtgcagccccccgcctttgcagtagccctcaaccaatgactgactagagtggacacgtaaatattccctcatcccacaaatgggataactctgttctgctcatgtgttgcacagtttcccagagctccccagcaagattaagttccaggtgctcagggagctgactggcttgatgttgctgcctttgctggttgcctgtccttctgtgtttcactctaccccttccctactggtgttttatggaaccacctctggaataaacaacttgctttcaaacctgtctccagctctgcatctgggggcgcctgcactgacattctttattccctagatctgtgtggcttgctacttttttctcccaccacatcacaggtaatgaatgaggctcatttgcacaacatacaactttggacatcagattttggtgaaactcaaaattacttggtgagaaagaaaagcacacatatgttacgctttttttttcagcatttcacaatattcactaaagcattttataagcaagtgagttgtaggagctaaatatgatcaatttttaaaaactactttttttttttttttttttgagatggaatcttgctcttttgccagactggagtgcagtggtgtgatctcggctcactgcaatttctgcctcccgggttccagccattctcctgcctcagcctcctaagtagctgggactacaggtgtgcaccaccacacccagctgatttttgtatttttagtagagacagggtttcaccatgttggccaggatggtctcaatctcttgatctcatgatccacccgccttggcctcccaaagtgctgggattacaggcatgagtcatcacgcccggcccaaaactatttactttcatttttacccaaatttatttcccctggacgtctacttcacaagcagtaacataagcaagtatgtatcattaaagatttatcacaaatcaaccatattatatcgtaagtaaagtaaaactggtgaaacaaatttaatgcagtatatcccaaaagtaattatttgagcatgtaatcaatattaaaacaactgtggagatttttacatctttgagtatctgctgtctttgaaaactcatgtgtatgttaaacttaattcagaccagccacattttaagcgctcaaatgccacatgttatctgtagcaaccatatggggcagctctggtctagcacatgaacttcagagttgtcccactcaataggcaagggagctggggtaattatacagcagttcccatcagtcattgagggttgctgcagagcatgtcagaggcttaattcttaggcactttcctggcctgcagaaaaaagccctctgacaaagagatggggatactgactagatagaactgcagtctgtgcaggttacacagtgataagaccccaggtggaaccacttatagctgactacattttttaatatcttcactttggtgttttattattgtcaaattacttgcaataatgtatcttaagttggtcactcaagaaaacttggttaaattcatgggcctagaagatcaacatcaaatctttgtcttcaagacctaagggaatctggatgtgccctacacatatctacttgcctctcgctaatctttctgctaagagtgtccttctcctgcccctttccatgttatttctgcccaccttcatcctctgatcatgtttatttttctctctggctggaatgtactccctgtttttctgcccatcaataggcagagcattttacaagcaagtgagttttaggatcattctttcagatgtggctcaattgctacctgtctctggaagcttcatgtaataacttcagtcaacagtgatatcttttccctgagtttctcttgccccttgatcttcacctgttcctttggcaggtcttatcaacttcatggtttatttcctgggtaattcatttaccagcatgcattcaggaggtgcctgacagtcctcacttattccctgtagcttaattaacaccgtctcttaattcttcatgttataatcaatttatttggtattttttgctcatatctctcatagaaagacaacagatgagcaattttggttttatggtttactcatgtttgtaattttaaactctgaaaattgaaaagctttgatagttgtcaacaaagtacccagaaagaaggttgcccatgagagtggctaaagacatctagagtcatctcaaatgcctccacaaatttcaaagaaaattgtcaagagaaaagttaagcacctcagtagcatttgtaaagagatgacaccttatgttctaaatattctcccagtattctaaaatattctaaatgctaaggaaataaacacaattttatttataatcttatagccaagtatgtttcatatacattgatactatttagttgcatttttatatgctttaggagcaatgggaaaggcaaaggagcactgactggaccaggggttagagctctgcccttgtctgctgagtggccttggggaagtcatttaactgtctgcctttatctgcaaaatggtgacccaaatgggcccccttccagctgtcaaattccatgtctgattttatgatgtctgccctttttaagaatgggaagcattgtttgtgatttcacattgcaggggctatttacatgtatgatttgcatcattgattttatgatacattgttgagagtatctgtgatttttttggaagctgaatccttactgagggcatgctgcccctagttatgatattgctcctaggaagaataaaatctgcttcacaatgtcctttttggtatgatttccatgattgagaaaactggggattgtatgtgtagtacatctggtttatccacttgtctgtccatggacactttgggttgtgtctacccttggctactgtgaatagtgctgctatgaacatgggggaacaaatgtctctttgagttcctgctttcagttcattgggtaataaacccaaaagtataatttttgggttatatgacaattctatgtttaattattttgagaaatgttcatattgttttccaagcagccactcgattttacgttcctaccaacagtgcacaagggtttcaatttctccacattcttgacaattcttgtcttctgtttttttgatagttgccatcctaatagtcatgaagtgggaaaaaatagtttttaaaaagtaacagatggataaacaactaagagaaagaaggaaggagtgaaggatggacggatggacagacttggctgccctatactattatcctagtcatcattgttaaatatagttgtggttggtagatacaataccgataataataatgatggtgtaatgagaatttttttaatgcaaatatagttggatgcatttgattaacacttgtgctagcctttactcaggctagatttatgatggcagcaaaagaaaaggtcatggtttttatgtctaagacttaaggaaaatctaagtgatccaacagaatattattaagcaccatccaaaaaattatctggatagaagaggaaatttttgctttagttgccttagtgattcagcatatgtggttgatatggaaatgtattgcatttacccaacaaggaactttgaatggtaatcctaatgtacagtgatgaatgaggacagaaaacaagttctacagagattttctggcttgacacagctgccaagatgtcatcagtaacatcttccattgagtatagtgaatgaattggtgctaaacttaagtacaaacccaataacgcagtcaaaaaaaagccagctgctataagatatacttgggtaggatttttaataacaaatgagcaatatattttcagcaggctatatatatgctgtaagataagctttatagaagcagtacactttgtatcttatgttgactactaataatgattttcatataaaagcacagcaaagagatccatgtacaaagtaatataacccacttaaaagactgcacaagcaaattaaaataaaaagggaaatttctcagggaataaaatttcttgaagattagaaacactgttcctcaataaataagcacccctggaatgtttagcacaaaaactctatgcttgatcgttttactatttcagcaggactgtcagagaggttggtctttgtggagtcctgttcctttcaggtgtttgtaaactttcttgccaaagcccttcccgactgagatggagttgatattagagccatggctgggacaaccttcatgccaaaggaggtgtgctgctagttgcaactcagaccctgcatggccgggtgacctcagttgggtgggttcccctttctggggctcaacttcttcatctgtaaaatgtgaagggggagctgatgatctgttgtggggatgtcatggatgttcattcattcaagtgttcactgaacacctgctaggagagaccaacctctctgacagtcctgctgaaagatgaaaacaatcaggcacggggtttttatgctgaacattccacggtgcttagttatttattgaagaagaatctttctgatattcaaggaattttattccctgagaaattatgtgccaggcactactctgtcactaggagttcaacgataagcaaagccagagaagggtcctacccctgatgtttagattctagtaggggatagacagtcctcaaccaaaaagccccacaaacaaatgcataaccacaacttcgataagtgccatgaagggttgatggggcacatggggggtggggggctcataatgggaggatttatttcacctaggcagggagatcaggaaggatcccctggggacatgatagtcagggggctggagaatgtgggttatgttggagaggaatgagttttgaagggataggagttgctgggttctcataccagcacagcgtcttctctctcttcatctcaatttcctcatctctctaatatgggcctaatatcaagaccctttctcagtgttgtgaggtttcagaaggatgacatatttgacaacacccaatatcatgctggcacatcacattttcatttcatttctaaaaataactttggaagcagagatgtgctgttttagtcaaagacttttttagctttggagaaagaatgaaaccccagctttgagactcctctaaaaaaaatctgagttcacattctgccctggaagttgcctggctgcttcccttaatcacagagccttgtttgaatcacttgactttgaaatcccaggaatgactttgctgtgtgattaagtgacagaggcccaaggtttggggattggcagaagtttagatgtccctggcctgatcccttaccctttacatataaggaaaggaagctgatcacatgaacaactaaactggaatgaggaggcagcccctcctccatggtcctgggctcatctatactgtctccctgccaaatattccatggaaaccttggacactgtctgatgtcaggactacttatgaatgcctgtccacttccttctcaagataaagctaggttagcactctctcataactcaagcctgaggtttattcttttaatcttccaaaagcaaacagaagaacagaaataacctatccactgtttaagattaaaatggccaacaataataaataattgccacaatagcttgagatcagggtcttaatttattggaggccgttcaagaatttgcagctcttaagttaatttttcacatcttgtttggatcctcagagcccgtgcttccaaagcaaggccatcatatttctcattgcacatgttattcttgttgatgtgccagacatgcaggagagtgaggtcctctcttcacggatgggtaatgaggattccacccccccagaaattagtatttcaaagtatttttgcctatggagattttgaagagttctcttcttttgcatggtgtattagctgtattaatggttgcaaacaagaaaaacgtatgctggttaatttaagcagaaaaggaatttattaaaaggatgtggggtggttcagagcatagacaagaaggctggggaaccaacacaggcaggaaacagaggaggcaagtcttagtccagggttccacctctgggccctttactcctctgtagctacttcagatgatccctggtgtctctgtgcaaccctcaaaatttgtagccctgggtgggagcatctgttctcacatcgctgccacttgatcacccttagatcacatgatttcacttaggcaagtgcccacaccctagtgatcaagaagaggggaaagagagggtctgccccctttctgctgatgtgccgccccacctatcttgagattcccccaaaacacgaggatgtcaggatgctgagtggccaaaaataacaactgttcattatacaaacccttatatccttaattacgtcttccattaactggttatccgattaaaactggccactcacatggatttattttgttcaaaggtcgcatcacacaataatcatcagtctctcatgcatcttcatccttgtcatcttcagcctcagccttatcaccgttctcatcctagccccgttcactcacccctgtcctgggcccccatttccctccatctcctcacctctcaaacgttcacctctttctcctccaactcccagtctttcaccctacttctatttcactacaaaatagaagcaatcacagaggaattcccgcatgttcctaccacccatctactaatgcatcttcagctcacctccagccaggcgagaacagtcattcatcagaccccagcaattgttgcctgtcgtgttttcattaattgttgcctctctaatggatcattcccattagcttgcaaatatgctatgataattcccatcttaataaaaaagagcaaaaaaactccctggagcccacttcccccaccagctaccatccaatttctctgttctcctttagagaaaaactcctccaaatagttgtctgtcctcattgcttccatttgttctcctcctacatctctgaaactctctccagttaggctttcctcccatcgtgccacttcagcagttcttatcaaggtcaccagtgacctccagaaggctgattccaatggccagttctaattattcccattgttctggcctgtctgccatattggacaaaattgatccttcctttcttgagactgtcctctgtgaccatgtggatgactcctctctcgattttcctcttccttctctagccatgcttttccagtcttgttggctgacacctcctcatcttcaactcctaaatgtgagtcctcatttctatctatactcatttcctagtgatcgtttctagtctgtcccaaatgtatcctagcccagacccctccttcaactccagactcatgcatccacctgcctcaaaatctcctttaaaacccaataggcatttggattttctctgctgaaccttctcaacccagtctttcccatctcaataaatgacaacttttctcttctagttattgaatccaaaatccttgaagcagtccttgactcctcttttcctaacacccttcatccagtccatgagaaaaatctgttggcatgacctttgaaatgtgtccagaatatgaccccttctcaccccctcagctgccatcaccctggccttcacgttcatcttctcacacctggattgtcacaagagcctcctactcaggccccctgttcctctcctggccactccacagaccgttcacatcatagccaatgcgagcctcctttaaacactaacgtcaagtcacgctgctcctctgctcagagccctgaaggggcttccgagggtcaaaccaaggtccctgtgctggccctcaaggccctgtgggatctgctgccccaactccctcagtccctctgagctcaatccttcctgctctctttatcactcctctccagctgcactgacctccttgctgttacctgcacatgccaggcacacgcccacctcaggacttctcctttgctagtccccacataccgtgtttcttgctccccttctttcttcgggtttgtactgagaagtcacctcatcagtgagacttccctgatcaccttattgtaaattgcaccccacctcccttgtaagtctggcatgttctatcttccttaccctttgtaagttttctccacagttcttaccacaatctgacagacatatttgcttctttctatgtgtgttttctctctccctgaagctaccaggactctgttttctttgctgctacttccctagcacggagtagtggctggcacatggtaggcactcagaaataaccgcatgaattcatgtacaaatgaatcccacgcttaggttgttaagtgccttatagtttttgaagtttgatgtacaagatttcatgtgagcctctaaacagtctagtgagttaggcaaggtagaaccctgtgctttacatgaggaagctgaggccctagagctaactgattgcccaaggacacatggctagttaatggggctcctggaacttgtagttctgatctcggtttctgccccccaccttcaactaccccctgtgcctcatgttatattagtgtaggcctcagggcattcattgctgtctatttttcgttacagtatggatgagaaaaccctgtatctagctttgggggctgtgaagaacatctccctaaacatctctatctccaacctcggagatgatgcctatgatgccaacgtgtccttcaatgtttcccgggagctcttcttcatcaacatgtggcagaaggtaaggagggcatccctgtaaaaagagcagttgttccatctggtgcgcttgctgactttcattattgcctggaataggcaatgattctacaagcactaatcctttctgtggactatcatttagaatgattagaacttttttcttcctgggcttagaaaacatgttggtatagccaaagaagcagccgtaaatgcccacagagtgccagagaagtgtctgtatttatgtagtctcccatcccttctctcttgtggaatcctctccctatggttttacatctggccccttcttggagatgatacagttgctgtctccagcacacacatgttctagagaattccagttttaggtcagtagttgtgaaagtaagggcagatcactgcttgtcgtgttagttattatgtatgatgtacttgatgtttctagtagagggtcactgctttggcctgtgctttggattatttatttatttattttttgagacaagtctcgctctgtcacccaggctggagtgcagtgccacaatcttggctcactgcaacctccacctcctgagttcaagtgatcctcccacctcatcctcccgagtagctgggactacaggtgtgcacctggctaatttttgtattttttggtagagacagggttttgccatgttggccaggctggtctggaaatcctgacctcaagtgatccgcctgcctcagcctcccaaagtgctgggattacaggtgtgacccaccgcccctggccttcctaacatatttgagtgaattgaggtagttaaattatttccacaaattgagtgagtttttttagagtaaattaatttgaatgaagtgaagtttatatagcatgactcaaaggtacagtgctggtattctcccctacccataatcatcccgagtgtaccacctctcagaggaagtgaacaggcttccctgcagacaacaagggggaacaagtggacaaaagtcgactctgctctacccagtgttgctctaactgctgatagctgttcagctgggactgcttgcagctttttaatatttacagcattgaacggggttgccttgttctttatgttaaaatggaaccaaaatcactttctgtggaaaaccttcactctgcccaccgatgagcactgggcatacattgagcaggtcaacggcgtttgttcaggcacatattctgtggcctcaatagtgttgacaggtttgtgccaagcctgcccagcttaggggacagctgaaatgctcagagccaccaacagtagaggcactccaaaactttccaagaagtcatctcagattccctgctgcttcatagcttttaggagctccagggttgagggaggccacaaaagcaatcaaggactgcaggaggggtgtgctttccatccactttctatattctaaaaattaccgctggattaagcccagtcaagagagaaccaagtatctgtatggttcaagtatcgctggccacacacacagtatcttttacagaatcgcatgtgctgtgatgccatctccctgtgcagggtgggttggtaggtgggggaaaggggcttccttggggatttgatctgtggaactcatctctgtggtaactgaaaagatgtaattggcaactggctcattacattacacagatttctctcactcaggacccatgcgagaaatttccttccagcctcatttaagctatttccagacttagaaatagctgtccctttgcctgagaattttggcttgtttttaccttgtgactgactaggcttcattctctttattggctgctagaaagctcagagctgaccccactctgtcagtatataggacttagtcttactattttataaactcactagcctcctgtatcttgctttgctccccctttaccatgcttttctttttagcttggagattgcataatattctaccatatggatatactgtggatttaccttaaaaattcctcttattctgtatttaggttattcccagtttctatattaagtaaaattgtgagaaatgtcttttatggagattagtaccagtaaatgatcatatccttagctctataacttttcagagggtgtgaagtcacatttttgaccacctactatacaccagggactttttgcatctcgtccgcatcccctcttcactgcatgaggcacaatgtgtgtgaattattggaggagcactctcaggagaagaggggcgagggagcagggaggggcaggggatgggctgggagggatgtgctgtcgggtcaaagctagccttggtctgatttatgggctgggaagaggtggggaagccctggagcataaatcactctgcagaattgtccccccttgaagctgctggggacagcatcattttctacccctgtatcgtcattggccactggagggacgcaggcgtggtgagtagcctcccaagcatgctggacaaggaggctctaggaagtcaaagacaatgtgcctgggaaggccacaggtacaagccattggccactgtagctggccatgggaaaaatgggagcacatcattttgatctctttgccattgaattccagcaacctttgaaacctttgtcacaaggaaccctaggtttcagttcgacagaaacttgacaaagcatcaggctcttcgggacgtggtgagtgttagctccagagtggtgatggagcagggaggtatcttgtagctgctgtggaggcagggccagccagaaacgcagatgggcaagacgaccctcagggtggcaggaaaaggaagggaaaagaaacagaaactacccttccaggactccagccacgctgcaaggttgataaacagcggatgtaaatggcatcacccagcaccgggtaggattctgacaggacccagtggctagtgaggggcaccaggagagcccccccaacctgcttaacaacccacaggcctaacaggaccaacatgggcctgtgaaatattctaatgggtaaactaagaaaagcatgactaagatacagagggaaagcataagttttaaaaagattattaatagaaaacaaaagtaaattttacagagcatctactttttgatgaaagtcaaaaaaaatgaacaaagtggaagatcagacagtagaacaatagactgtatgaaaatggaatggactgggaggcaagcaaaaataaatgttatggatgggataaagaaatgttacaatgaaaccaggaaatcagtggcagaattaaaatatgttatagtcaggaaagagcagaatcagcagaacagaaaattgatttaatgatgcggaggtgtttttgagaggctctgagaattcagagaaaaagaacaaagcaataaaaaaggatgacatgaggactatattgtggaaggtagaaactggaaaacagcaaagagaaaatggttccagaataattggaacagaagccattccttagacagcaaaggaggatctccatttcctgaaatgggtgcagcagacaccaggcaaaaatatttaaaacattttaatgtctacaaatagcttcatgaaatttttaattttaaggatatgaaaatgatactattaacacttagcagaaaacaaagaaaccagtttctacagacttttctgtaacattaatgtccaaaattagaacagtatattccattgtgaattttaaattcaacacacagccaacttgccctccattgtgacgtcaaaataaagatatactcagatatatgagaattcataggctattacctcttccagtttggatttccccaaaagcataccctgatacaatgatacaggtacaggtagtttatttgggggtgggcgatctcagtgttgagtttagacaggaaagagaggaaagacaggaaggcgtgcatttataagcaggttactgccgtaggcaccttgggcttgtcttcctcagaccctccaagagactgtgtgtaacaaacctcacatccacttcactccaggatgaggaagctgctggaggaccgatcccccagctcctgtcattcatcatggagaaccattccctgggcatgaactctctggcacttccagccttctctaagtaggtccacactgcctggggccaggaagcaactcaggcagaaagatgtgggaagcctttgacctggaggggcatggcttcaggtgaccagaactgtggctggttctggggaatgtgagcgaggtgctagccacatctgctatagtaaccatgagagcttcctgaaaagtagttatttactgataaactactcaagaatacaaaagtagttgaataaaaagtgtgccacagccaaataagcatagaatgaagcaaaacaatttttataaatatttacaatagtaagcaaatgtaaaaaaaagtattgccatggtaaatgcataatttaaaagattaataaaaataatcccataatctcagttataccaataacaatttgagaagaaagttgacattgtgactcctctgcttcactttcttcaggaaggagttcagactcctcagctcctcatgagaggccgtcctgagcctggtcctgcctgcctgcctttctccccagacccctggctcaccatgcccccacatactcacttgaatcagtcgccacttaataccaaagctgcctttacccaggaatcacccccaccccccatttttgtttaatgaactactatgtccttaaatctcagcttagggagcccgtgtgcaggctcctcacctggctgcacaggatctgtccacagaatagatggatggatggatggatgggtgggtgggtggctgaatggttagataggtaggtaggtagatgactggctgggtgactgggtggatgagtgggtggatagttatgtggataggtgagtggggatggctggctgggtggatgagtgggtatgtgggtggatgggcaggtgagtggatgactggctgggtggatgggtgtgtgagtggatggctggctgggtggatgagtggatgggtgagtggatggctggctgggtggatgggtgggcgggtaggtggatggatgattattcattttgtgcaaagttacagagactcaaggcccaggcctccaaggttacctatcttctctgtcatcacacagtccattagttatgtattagcttctaagactgaatacaaaatatcccctgcaatggatttttctgtcttctaatgcaaaactactttcatagatttattctggattattttttcctttgagggaaggctgcttataaaaacatggggtacacatggatgaccatctgctggcttttttctctcctaaataaagctaacttgaaaacacattataaaagagggcttaatttgttggtggctactctgctggctggcgtgtgctgtccagccagagcacagggtattatggccagcaactgggtttcctcaggggcaggcccagtgcaccgtgttgcctgccgggcaaggaaccagcaaagcctcactacagagtgacaattcctggggtgccctgtgggagcagtgagagggagctcctggggccggggggtgctgcatggttaaaaaggagcataaggaagaatagataaccactgcatcacaccagggtcaccattcacactgggttccatgtaaacgacacctccacagaatataatgtgagtggtgtccctggagatgtacagctctatggccctggagtcaaggtaaagcctcattttaattttttgccctggagccgtttggcacaaaggactttggctcttcttgcctttgtcaaacagccatgaatttgtttggacagcagttgttgaatgcctgctaaatgctagggactgttccagccacaaggagacacaaagatctagtccctgctcccagggagctcatggcctattggggccaaaggcatgtcagtaagcaattaaagcacaaggtgccagctgctctacagaggtgctgaaacgttgtttgaagcacagatatgacaaggtgaagcaagtcattaccacagtggctagtgccatgttggacagaatccttggataagtgcttaaggtacatggatgagcctccaaaggatctgatgtcagctgattcctacattgcagagctagggtgggtggaatgagtcagtttatttggctggtgaaggaggaacctaggttggagcagggatgagagggtagaagagagcaaaggaggaggggcaggagagaacccggtaggatggaaagaggctgcccatgttgaacaaagggccagtaacatttctggtggcagggagatgtcaggacattttagaaatctgatgcctgctgttacaggcctgtcaggactttaccactcataggttctaagaaatctcccctccccacctcattctgttttgtttttagcccattctggatttctgcactcatgcatgcctcatgtgaccagggataggcagggagaaaaactcaaggggctggggttatgtgtacatcttcatggtattgactgttatggcatgcatggaaacagacctggacatgaaaggataagcttcaagccaggtgcatgagggctcccagctgacttttgggtgcaaacaggatgcaacagcttgccacagagtgatagaggaggccatgctaggagagaagggagaacaagcagggcaggcaccctggcccgactcttacacacagtgtgagatgctctcttggtttgggtctcccagatggcgaggaattcagggaaatttctttatttgggagatgcaagaaataatggtagggggttgaagtgatatagtagggaggtgaaacaatggtagggaggtgaagttatataggcaggaggcagtgaatgaaaagtgagctgttaaaccaactactacagtgggcaatggggcttattcctgcagggcaacactaggaagagtaagggagctgggggttttatactcctttccccaagtgtcaagaattgaggtctcctggggctatttatattctccagtactcctgccctcccatatgcatggcaggagagacctacatggttttggaaaaatgctcttgggtgcagagatgccgtaatatagcccctggcagctggaagtgggctggagcaccctgagagtgcaagtaatgtggtcagggctcaccagcctctgccagagaggcccacaggattagaagtatctctaacctgagcacctcactttctagactcctagaagttgtgggttggtctgatagagcctcgctgaggttcttatacaagatctagtagcatacacctcacagtgtgcaggagttgggtgaggcaggtgtggtatgtgggtgaagaggaccagggtggggcaggaggaagcagtgaagacagtgggaagatggagggttccagcttcacccacagggcagcaggctcacagcagcattcagtggttgccaggtgggagtgaggcccagcacactctattttctaataaaaccgagagatcttatgactttggcagctaattaaaatgttttctgaacatcgtatgagccaaacaaaacatgtccagtgaccacctccagcctgcaggccaccagcctgtgacctccagcctggctgttttccgtatgttctagtccggatctgcatttctggtagaactagtctgtctgcagccttactgtgtttcatgttctccccttggcaacagataaattagtcaaagagatgagagtttggggcttcaagtgtccgagtgtctggggaaggagaggagtggagagggtcaaccggaatgtagtgtccatggaatttttagaactcatgatgttttgaaaactatttgctggctggaatatttgtacttcacagtgattgcaagaagcagctaaactggagtttgaattttagaagctgctagaagtaaaataacaggcaaccagtgtgaaatagagggaaagtgtagctttggtgaccagcagatgcagagttgagattccaactctgtttcttgtggccagtgtggccttggctcaagggtcttctctctgtgcctcagtttctttctctataaagtgggattgtgccaaggattaaatgagtcctacaccatcatgtacagtcccacttgtatatgatgggtactaccatggtagtcccgactctgccacacatgagcttatactttatagctcattcatttactcagaagagatatactgatcacctacttcagaccaagattaaatgctgagggggaagaggaaaataaggcaagaatataaaacatagaatgtatgtcagggggtgataactcttccttttaagccaaaaattatcagtcattgtcttaatgaaggattgagagagagagagagtgtgtgtgtgtgtgtgtgtgtgtgtgtgtgtctacatactgtaaaaaaaaatagagacagtgttaaactgaacattttttaatttaatgagttgcttgtacttaagaaaataaaattatatgaaaattaatgtgaagcagtaaatataggtcagttcaataaatgtctgtgttggcttttgtgactcctgatttttttaaaataatgcttgttgattttttttttccatttacttaccatttgcttaagtattggagtttttggtttagggatattgactttttaaaaccaagatatataattgttcaaatatgtgatgcacgtaatacataatagcgaagtttagataatgaggagaataatgccctccaaaaacaatggcagggggctaggtcctgactctttcagactgggcagggaggcatctggcccaaagggctggaggagtgcggtatgggattcagactttttatcaggtaggcagtaagtgaggtcttgactgagagaacagagaacgaagaacagaggctagagacatcttagaggaagaacaaagaaacagtgctgacaggccaggaaggtcagagactcagtgttgggactgctggaagaaagacaagtgaggaagaggggtgattgtgaactcagcagggagaacccagatcctctactcctgatcatgctctagcgcacagagcactgtaagctcgtgaggaatgtgcttcgtacctggcatcggttggccataagtcactgaatttggctaataagatgttgcattgtctctgatctccttgagagactgagatagatggataggccctaggtccttatttcctccatgggagggtattgtgggaggggtgatgatgttcgaagggaagctcatttttgctgtttctaaggagtataatttgagttccaaattaaactggtcttccaagttggggtttggaggcagtaaagcaccaggtcaactttcaaggctttcagtggctaattttttatgacagaaggcatcgagggcttgtaagtttgtttttcttatcaagtgattcttcagattatatctacctttaccacagaaagggtggtccctttctttcaggagtggttctctcttcactttcaaggcaaaccgctcaagatggcaccaggtgataaaacagatccacttgctaatctggatagagcaggaaggacttaaacatttatgtgtttgtatacctttatttgagggagtgctttggcctgtttttagacagaaggttccatacagaaactgcatctgggcaggagaacaaagcaaattgtgttacagccgggaaaccaagcattgagcaacagaatggttcttaggcagaagtgagcctcatccctcagtgctgggacagattacagccttccttcactgccgctttcattcagcgcagggactgattttcattgtgttctgctttctctggtgtctcttgtcaagttaatagtagcctcaagtaaaattcaacccttagatgtttatagtcatcttggcctggccattaagatgatgaatgaacttgctgcttgccctggtaagagagccctgagggtggatgccgatacttagaaaataataagtcttttccgcccccttcctgtctttaatccagtgccccaagccccctggtgactttaccttgaacttcctgtataacgccaggtagaaaagcctcacctggctggaagcccactcgaggctctaacacaacagcaagctctttatcttgctttgttggtcttccccatccgcttatcagatggaaactcggcattcctcagagacccttcagtgtttctcagttgcttctgcaggcccttcccttcctccttgagaggacaagagaaggtggcggggagcaggcacccccagcctgtgtttgtatttcctcacctggattacctgtggcccttgcatcagggagagcccagccttgagtgaaactgcctgggagacaggctgggcgcttcctgcggcagtcggcagtgaggaagtggtggagaaacgcagatgtccatttcaaatcacaaggcggcttcagtattccgccgcggggctcagctttcacgtatatgaaaagcttcatttgtgtattcactgcgtttggaaggaaggctatgttttgctttagaaatgtcaacagagctgtagttacgacaaggatcaattaagaaggacgtttcccagagccgcaagacttgagtgaatctgtggggggaatttagaaaacatgtgttaaacctctagatttctttttttctaactaactgcaaaacagcaatttaataatttcctcttttaaggggaaaggggggagtcttggattttaaatcttcctaaagcagcacagcatctcttgaaaagaaagccatgaaagactactaagctaaggcgaataaaataaaattttcaaaaatcgagaacttcagtgtcctagtctgggtttccctgagcagatcctgagatgagggctcacatgcaagtggttcataaaggatgtgtttccgggggaagacaggtagggagtggagagacgcaggacagggcaggactgaaactcaggcagggtccctcagagcgtggcctcagcctgatgctgcaagggggatcagaggtgtgagttacgccaaggtactgttccatctccagcttaggaagctgagttttgttctcccgtaaacaccagtcattggttaagggccacttagggaggaataagtggtagaaagtggtcctaggcactttccacccaggggtgaagtgtagacagtggggcttcaatagcttaagggcagaagaagacccacggttctggctcttggagccaaacgaagactgaagccacagtgtgcatgtaaagggagtccaaggagcattgggtggggcattgaaattgtttgctacagtcggtttaccttcaactggtttccttcttgttctgaaggatatattacaagcatattgacaaaagtctttgaactcttgaggtgtttgtatgatattctgtgtcagttgcacatgggatgtttctaccagcatctgaattggggaattgacatatacagatgcccgtggaatttaacagagaatgtgaatgtacggctacagtccgtcaccatccagcttgccagggctgtcatttcatccttttgaggccaggcttacagacagtctgggcttccactgcccccatgctctgcctgtgatgtgtggtggcctctggcattgttgtaactcaggcacctgagcataactagtgagcctgtcctgctctcccaagcaagtctgtgtttaaaatcagttaggaatatgttgggctgcatgtaacagaaaagccaccttttttagcagctgatccttgtgagacttttatttttctttggtaataataaaataagaaatgggcatttcagggctagtatgcacctgtgtggtacccacaggaaccccattccttctgtctttcctctcagcctgtcttcataggggttttcatctccatactccaaggctgggctttccctgatggtgctttttggtttccgcttccaacactacagctgcattccaagcaagaaggagaaggacaaagggcaaaaggtctgcctccttttaaagagctttcctaaagctccacttgacattttccacatatatctcattggccagcaccatgccacaaggtggggtggcaaatgaattttctcagctgggcacattgctactctagacagagtcagagttgtgtttattgggaggaagggaagagtggccattgggaagcaccagcagagtcagcagggcagagacctgagagaggtagtttgtgagtgtgtatccctgagatacgtagcagaactggggaaggactgcccagtgagtctactcccttcagtatttgtcagatcctgctcaattataagatgatctttatctgtccgccttatctatcttcactgacgtgtatttcttattttcacaaaatgaagccatttcaacgatgttgtcaatgtgtttggatttctgtccttcaacagaggtgccacagctccatactaggtcaatccatgcaataaagaccaagttccagaacccctgtccttcagaccatttggtatatataatttccaggcccttcttcactgttctgtttatcactccctgtgctgtctctagtttggcatcttcctttttaaaatagaacccaggcttgaactgcaattcaaccagcccagcatagttattattgtcccgagtctaaacatgatatttctgttaatgtggtagccacagcacaattctatttattcttgaggcattccctcttttattttcttggtctttttgtgttatttggaagtgtaatcatgtcatttatacccttgctactcgaatatggtccatgaaccagcatggtgacgtcacctgggagtgtgttagaaatgcagaatctcaggccgcagccctccggggtcaggatatgcattttaacaagatcgttgggtatctgtatgaaaatgaaaaattgaaaccagggcgagatatccagggcctcagaggaaaatctcaaaatggtcagggaggtcccttcttagagatgagaaagtcactcagaggctgccatggcctaagactgagacaaagagaatatgtctgtatacaactaaagaaaaagagaaaaggttcgctgggccagagagtggctagagactcgattgtactcagacttgctgtattaccaacaggtaatgtacaggacagtcatgacctacacctggctaaatccagtagtcatttttcagtcttctttctggacccgtcagcatctattagtacaaataacgactacttctgttattattattattattattattattattattattattattattatactttaagttctagggtacatgtgcacaacgtgcaggtttgttacataggtatacatgtgccatgttggtttgctgcacccattaactcatcatttacattagatatttctcctaatgctgtccctccccttgcccccaaccccacgacaggcccccatgtgtgatgttccccttcttgtgtccaagtgttctcattgttcaattcccacctatgagtgagaacatggggtgtttggttttctatccttgtgatagtttgctcagaatgatggtttccagcttcatccatgtccctgcaaaggacatgaactcatccctttttatggctacatagtattccatggtgtatatgtgccacattttcttaatctagtctattattgatggacatttgggttggttccaagtttttgctattggaaatagtgctgcaataaacatacgtgtgcatgttctttatagcagcatgatttataatcctttgggtatacacccaataatgggatggctgggtcaaatggtgtttctagttctagatccttgaggaatcaccacactgtcttccacaatggttgaactagttgacagtcccaccaacagtgtaaaagcattcctatttctccacatcctctccagcatctgtggtttcctgactttttaatgattgccattctaactggtgtgagatgatatcttattgtggttttgatttgcatttctctgatggccagtgatgatgagcattttttcatgtgtcttttggctgcataaatgtcttcttttgagaagtgtctgttcatatcctttgcccacttttggatggcattgtttgttttttttcttgtacatttgtttaagttctttgtagattctggatattagccctttgtcagatgggtagattgcaaaaattttctcccattttgtaggttgcctgttcactctgatggtagtttcctttgctgtgcagaagctctttagtttaattagatcccatttgtcaattttggcttttgttgccattgcttttggtgttttagacatgaagtccttgcctatgcctatgtcctgaatgatattgcctaggttttcttctagggtttttatggttttaggtctaacatctaagtttttaatctatcttgaattaatttttgtataaggtgtaaggaagagatcccgttttccatcatatgaatatgccacaatatgttttctccattatcctgatgatggacattgaagttgtttctggttttatcttttgtgaataaggatactaagaacatttttataccagttttcgtgtgcatgttttttttcatttattgagtaaatgctagtgagtgtaggtgctggctcaaagggtcactgtttagctttattagaaactgccaaatagcttttcaaagtggttctgccttttacaccctcaccagcaatgtataagagtttgagttggtccccatccttgtatattcagtattgtcagtcatttttattttagccattctggtgtgtaattgtgtttctttgtgatttagagctgcatctcccatatgactaataaacacgttttcacgtgcccctcagccattgggacacttattttagcctgttcaagtcttctgcactcccttcttctggggatacttttcttctcctgtgctgtggtacactcctcaccccaattcttctcactcgccactccttttctgcttcctttgttggggtctccttatcttgccaacctttcaacattggagagcctcagggtgcggtcctgagaatgcttttcttctgtgtatacgcattccctggatgaactggtcaagtctcataacttcatatcatggacatgctgacaactcccaaattttcccctccagcccagagctcactcctgaactccagcgttgggtaccaaattgcctgtttggcctctccacttgctgtctaacacatttctcacacttaagatgtccaaaatgagttcctgatcctcctgacacctgttccatttgtaggaaacagtaactccatccttcttggctctcccttttctctcatacaccacatctatttctcaaacaccctgttggctgatcctacagagtatctcataatccagccagttctcaccatcaccattggttccatcttggtccaagtcaccatcgtcttttgcctcattattgattggcaatagccttcttcataattggtttccgtgcttccacctttacctcttacactcctcctcttacactcctttgctcagaagtctccagtggcttctcatctcattgtaaagcttagttttttataatacctctaaggccctagaagatctgaccccgttgctgcctctctgaacatgtgtcctgtcactttcttccttgtagcctcagtggcctccttctgttccttgaaacacactaagcttatccctgcctcagggcgttgacactggctcttcccttaaataggcacatagcccactccccatttccttcttgtctgtgcttaaatgtcacctgattagaaatatcctactactccaaacaccctatctgtcctctttatcttgcttttctctatagaacctatgaccatctggcatactatttttttgttttgttttcttgaaacagagtctccctctgtcacccagactggagtgcagtggcatgatcttggctcactgcaacctccgcctccctggttcaagcaattctcctcctcaacctcccaagtagctgggattataggtgcatgctaccatgctcagctaattttttgtctttttagtagagatggggtttcaccatgttggctaggctggtctcgaattcctggcctcaagtgatcctccctccttggcctcccaaagtgctgggatgacaggtgtgagccactgcacctagccggacatactatttgtttgttgctggttgtcttagtcctcctaccggaattaggttaggtttctacatataatatgcaatgacttttttgagacaaggtctcactctgttgcccaggatagagtgcagtgacatgatcttggctcactgcaacctccacctcccaggctcaagcgatcctcccagcctccggagtagttgggaatacaggcatgcaccaccacacctgggtaatttttgtattttctgtagagatgggggttttgccatgttgcccaggctggtcttgaactcctgagctcaagtgatccacccacctcagcctcccaaagtgctggagattacagagtgagccaccacacccggcctggaatgactttttattcattgattcatacctagtaactgcagcagtgcctggatgtgtggtaggatctcaatctttgttgaataaactaatggatggtgggcaaataaatggatagaagatgggtatatctatctttctctgtactttatgagcactctttcaattattgttttatattacaccagtaatttttaagtagtgttaaaaactagtaaacaatgtaggggtttggagaaaaatgctaattccttatctcccggaaaagggaaaccatcaggaatcagaaatggagaaatgcttcccccacctggtgattgcatcttgctgtatgggatcaggcctgaaaagtgagttaagtctgttggtgctggaactcatcactgaggaacagcctatgtctgtgccttcaggggtgacagacagtggaccaaggccatgcctgcatattcctccctggacccctcattcaaagccagaatctctttcctgccagagcagtcctttgtccacatgggtttctgcagtagcccaagtttgcaggcccttgatagggctggagtgtgagctgtaatcctatgggcttgaaataatctctgctatgggctctttaaaataaccccaagtaacactcatgtcttatttaggtatccccagaagcaaaccctgagataagaattcaagtgtaaagtacctgtagtttgtttgggaggtgaagatagggggatatattaggaagtgagacagagaaaagaaaacaggagaaaaggacagagtgtcaagccagccacaactatgggcagctgggcttactcccactggggaaccctgggtccacagagcaagctccttggggttcttctgcctgcgtggtgaggagtctggggcctttatccacctgctcccagcagctgttgattgagggctgctcctgaaggcattaagatcttgacacttctggcctgttgtttgcaggggcagagcagttttatgacaagaaaaagtcctcaggtgaaaaaatgcaggtgtcagcaggtggagacacagggcaggggatctggaggaacatcagtggggtctgcgacaacctgtgaccacctcacagacaaggtgacttctggcttctcagtgactcagccacacttctctttttcactcactcttctttctggtcctcactaagacaaaatacagaatacagagcagcagttcacgggctatagcatttgaggagattaaatacaggcctccaaccacacaggccatctggaagctttggcctccagatgaggacataacgaggtcatctctgctttcagggagctctcagagtctcaggaacagatgtacatggtccatcagagtgtggctcagggcccagggtgggttggggaaaaggtgagttatttagcattggaggagcctgtttgtagccatggctgccaacatgcatgagccacttagaagggcttagggtggtgagggtacaggtctacctgtgaagctgagtgatagtcacggtaattacagtcacctactatagcctcacaatgagccattataaaaatgaggaaactggggctccagaaagatttctcagccccaggacggtgcagccaggaaatatcatagctgggatttgagcccagcttgtctggacactgagcctgtgttttgcacactatgcacacacttctcccagatgaagatttgccttcatccaaggggaatgtctgtgtgagacagtggcagcctctgatgggttcctgccgattggcaaggtggttagagctgtgtattgagaggtcttctccaaggtatcagtttttctctgggagggttaaagaaggaccttgcaaagcccatggcctttgaatagagagctctgttctgtttgcagtgactcccctcaaaaggcagaatgcaattctctaaagggaaaaaaaaatgaggtggctgctctctggggttaagcagagaaaaccgtcaggcaggagaggtggggctgtatttgagagggtgggagtggcccaggagacctcacggtacagtcagctgcaggagaggagctgctaaccctcatcttaagaatatcactctcttgacaatcacagttgggaaatgtgtaatctcagggtgcctccttgcccgggcatcttcattataaaagcttagtctttctaaatgcagccaagctctcctctgacaagagatgtgagaattccgttgacactcactgaccacctagaaaccagagacccagaaacccaaaggtgggtcacatggtcgccctgtccctggggaatgcacaggaaaagagctctgcctcccggaaggttccaggtgttggggtaaatagagatcctgctgctgcctctactcccttactggtctccctggggacatatttgaacatattttactcataaattctcatctcagggtctgtttctaaccagacctaaaacagacaggtcccccccttttttaatcagtaactttggtttattacagcagaaacttcccaaattactgatctgaccaattagatatgttttaatttttttatgaccggaatcttttccttcaaatgaacctgtttggattctcttatctgtgcaatacaacctaatgtaagtctactttgtaagtatttgttctgagattatttgttctgaaggaggcccaatccagttcagttaaatctgaagtttttgatcaattgggttgctgagattacaactttctttttcattaactattagtacttaaaatattgacatgctaagtttttagtcttctcttttttgacctataaaaaaggtcaattatatcttaaaagtttcaccttctatttggctattgtgtatcattctttaaatatctggctgggttcaacttgctaagattttatttagtatatttgtatctatagtcataaacaagatttctctgtaattttctttcttgtcaggttttggtgtcagatttctgctagtgtttgcaaaaataagcagaaagcttgcacttttctctgttctctgaagacatacaaccaacatagttgcaacagcaggcagtgagagctgacccttactgagagcttgtttatgtgccagaggctgctcaacactttttattaacgtgtttaaccctcacagcaacccagtgaggtatgtgcagttaccatctcagttttcctgatgaggaaaccatggcttagcaagcttaaggaggtgactcaacttccttagtgagtggtggggctgggattcaggcacaggcaggctggtacttaatctctctcctacaaataccagcttccttggtgagtattggggctggggttcaggcacaggcaggctgactccagtgtgctctaatgcatcttctttgcataaagaggcttatttacatgtcttttggggtatgctggctgctcacgtggctttgtagacattaccctctggagtgccaggtgctttgtgaattagatctttcttattacatcacggccagttttttgtggaggggggcaatgggcaaggaagcattgatgaattttctgagacagctgcgatttgtctaaacaaggcttttccttcagtacccaaggattctggcacacagacccagctccccaccagcctcccctggaatgagctttcctgaggtgcccgcgtgtctccactccaggtcctggaaagctggcagcagcctcactcttgggttttcctctctggaattaatttgtccccaagtgaactcaaataaaaggaagagcacctatgagagctttgcctttgactggggctgggaaggtggaaatagcatggtctatcctgttttctcatttgcccgttgagcactgaacgactggaagtagagtatgatgtgaagtcttaccctttgtgagtcagggggcttgggctgtctgcacacactgtctccaactccaccaccaccatccaactcaggcccaatatcactgggaaaaacccagatcccctacagaaatacaacaccggtgacttgctggatgctggtggctttgtgctattggcatggtgggtctgaaactcttgtagacaccaaagaaattggtaggttatggaatgattgattatatcctgtgtcagctggaatcctgcgacatgttctagtttcctagtgtgcagagtacaatgtgggcaatgctgggttgtagaacatctgtgattttcatgggataaaagcccttatttttgttttgttttattttaagtcaaaagcaatttctaccagtaagagactgaatgaataacaggaagccccttgtttgcatggttcagaactaggcattgcaaagataaccatttactctgatttcagaggtctaaaggtgttagttcccctcttagaagtaccaaacttacaaatgggaaagtggatgcttagaatggcatgaatgttggctggcttgatcatgagtgggatcacgatggcattcactctttcattcagcaaagttatgtgttaacaggtattaagtataccgttatcatttttccttactttagaagataagccaaaaaatttgaccttaatgaaaatagaggatttttaatggagatcagaattttcacttataaaagtaccatttacacatttcgtcactgctgacagtcattagctagtggatagatccaagctttaaatctgaatcttgtcataggaggatggaagctcaagttgttaaaggcctaaaaggttgcatgttacatatagaacaaggccctgggaaaggaaatggtctgttgaaagtcacaaggccaaatggcataccaggtttttggtccttgtttaagaaaaccaaatgtaggttcagaatagtttcttctttcttccacgtctctgaaagtccagcttcgtgtgggagagctctgaggccctctcccagccctcgtttttcagctcggggttaccacgtgtattccgtgaaatgctctacctgctttctgtatcggctttctagccagttgcagtgtacaatattagttttggctttgggaaatgaggtttctttgacttggctggaagtatacagcaaccattttatttttcttgtgcctcatgaattaatagggcagtgagaggaaagagcatgcatactgagcatctgagcttttttaaagcaatgattcacccagctttctagtataaaaaacttcctctggcccaccccgagcaaaccctcattcactgctcagtcctcccatttgttcatctggaaagaaggaatgttctagtggggccaggccccatgtggtatcttccttttctgaagtcatccattcattctcttcctggtggggacttaaggttggaggcagcaaaaagtggaaagactggtagatagtctgtcagctctgtggggtgggtgtgccatttggggggaaatgaaaccagaggaagtttggctttgcagagtgaggacccaggcaagttcattttttacactctggttccatctccttccccctgcacacatgagtcagctccaggaggaccccgtgtccttgactcttccttgctgtctcttcaagctatcaatatgccctctctctatcttctccctctggaattctccctttccgtctcagttggactatctggactttttgattctgcttcttcccaaagtgctcttttcagtccattgtttttcctgagatgtaatgactcaagggtaaatggtacctgtcagttgcaacgcctgaaaccatagatgcataggtgcaggtggtttatttgagtagcgccccagaaagtaagaaagaaggaagaaaaggagggtatgtctttgaggtcactgccattggtgctaagacttttttgagaagcatatagaaagtcacctagaaatgcttacctataggacaggagactggagcactcacgccccagctccaatcccaggttgttaagggccacctccaaggaatggattgtcctgccctggccaggggtgtcattgagtttgggtgccctcagaatgctactgaagatggtacaaagctgaaatcatcagagttgggccagaaagaagtgacacagaacatctaaggcatatcataaaccatttctgaccctgatctcggaacaggatcccagaacagttcaacctgtaattgctttctgacatttgagcaaaagcatcagtagctcttctcatgaccacaatcagtttactaggatttttccataggctcaaagaaaagacagtctatgttctaagtacagatgaagaagtaaaagtttgtgttctggaggggtggggcttcaatctagaccttgcctctttctgatcactgttcttgacactggatctaaattaagaaaaacattaaatctaaaaatgtctaaaaagttaggacatttaacctatactatacaagaagttatcagctaagcaaataaaatccagactttgaaaaaggtaaataaggaactgatttactttaatcacaagttccttctgcttacaaaatgattcatactgaaatttttaaaaaatttcttaagagtttagtgcaattcacataaaaaatgtacttcagtaatttgcaaatatttacttaaggatttagtaatttagtaatgtttagtaattttttcaacaagttcttttctgtttaagtgggttctcagaagtggttgcaccttcagcaggcaaggaaaatatttatttgaagacgtttatgaaacacctcccttgtttttattatgtttgtgttcttcttatatttctttttatttgcagtaccctcaagtactttgaaggtttggggacagtaaataaaattgatggccattttttgtcatgcatcttctgaattggtatgtttttctgtgttcagaatgtcattcctcagcccccaggggacataagtacaaagtgaaatgaggcgatgtcaggatcacctgtgcacattctgcttctctccaggccctggcttctcttctttccggtagatgaacttgagcacatgatctcaccacttggagcctagtaaaatccatgctactgttctgcaattgttcttttattctttctctctactaatgttttcacctatggatgtcagttctacttctccttggggctttaactaaaaaggaagaattgtctgtggcttcttagaaagtggtgtgtggacaggcaagggctgccctgcccttggctggcagcacaggctctgcaaagggggtgggtgagtgaccacatcatcatggctaccccttcccgagtgcttcctgtgggctaggcagggcccaggtagctcaaaggtgttcccatttgttcttcacagcagctctgaattcattagcataacaaaccacccccaaatctagtgggcttaatacagcaatcatttctatttgctcataactctaggggttagctaggcagtttttcagttctgggccaggctcggctgttcttggccaaccttactcatgtgtctgtggttagctgcaggtcagctggaacccaaatgttgtctggaacaaggggagtgatttagctagtggctctcatccccagcaggctggcccaggctcctgtagggttccaaaagagtgagtagaagttccaaggctttttgaaatctaggcctggaacagacagcatcatttctgctgcattctgttggtgagagcaagtcatgatttcagctcaaattcaaggtgggggaataaaatctacctcgtgatgggagtagctgcgaagtcaaaactgcaagggatgtagttaaagggagggttggagagtgggcgtttttgcaaactatctaccccaacctctgagcggtaggtataattatcccagtggttctcaaccaagggtaattttgtctcctaagacacagttcacaacttttggagaaatttttggtttccacaactagttcagcgctattagcatctagtgggtatgccagggatgctgctaaataccccacaatgcacaggacagctccccatacaacaaagaattatccagccccaatgccaacagcattgaggctgagaaaccctggattatccctttttacacatgagatgagggtcttacaggtcttctaagtggtggagcctaggtttaatcccatttccgtactcttcagcactcactgtgctagtatccctctcaggcgtatgaatacgtcaagccacttcagcatgatggcgtttaagttttagcttgtctacaaagcagcacaatacagtggttaagagtagggttttgtcaccagactttctggcttaaatctgctcccatcccagcaccacttaatatgtgttgtaccttgggcaagttcaatgatgtctctgccttggccttagttttcttcttcttttttttaatgctgcctcaattacagaacagatgcctaagttttcttatctgtgagactgagctaagaataatgttgaccttataaatttgttgcaaagattaaattagacattcatgtaaagcacttaggaccatacctgagacatagtagcctttagttatttttgtctaattcttctttccctgatacagtgcccaccataaatccccagtcatggtgctgacctggcatgtgaagctggctgggaggaaagagatttttctctcccagcaaagtagtaaacaggctctctcaagcattcatccatctggggagcttggcacacaggacagatcctttctcttaagtgtcccaaggccaaccctgaaccttggaagccttcatttaccatcagtttttctttcaaaacttctgcaagggcataaaaatgggggactaaatagggaccaaataagtgagtccatgctttggaaatgatgacctgagagtgtgaggaaggggagagccaggagctgagtggcagcattgcgggagggctcttcctcccttggttggcagatgggcgggtgtgactgaggctcaccatgggtggactgagcagacgcctgccctcacacacaaccccatgctttcagaagaaggcgtcagacctccttgtatgggaacatcatcaccttcacgctttgtctttaatttgagaagcttatgtggaaggaaacagcacattcttgtgagaagataggttttggaaagtccggagtagacagcatgaatccagggtttctaaagtataccctctccatgcttgctactcaggaagcagaggcaggagaatcgcttgaacccaagaggcggaagttgcagtgagccaagatagcgccactgcactccagcctgggtgacaagcgcgaaactctgtgaaactttcattctgacagtaggaagaggaaaagactctggctgactccttgtgatagagcaaaccaagttgagtgttgtatttacttttctggatttattttcacaaatattcagctcagaatgtgccagggaggggaggaacacaggagctgtattggccacagccatgtgcgtcatcccaggggacacttatgtgagccctgtggagcaggaattgttattcccatcttacaggggtgacagcttagctcagaaagcttgcagtttgctccacgttacaaagctagtaagtagcagagctgagattggaaccctcgtccgtctaatggcaatgcttcctcttttgctattctgcctcacaattaaatggagtaggacctgatccccgacatcgagaaactgacggtgttgtcaagaaataaatatcccccccccacacacataaatagagaacaataaaagataacgtcggaggatgaacccacgagcgtggtttgtgtgggaggatgtcttgatcctgggctcgcagggctgtccgctgaacatgacagttatcctggcttcacagtaacctttcagaggtgctctgagtcctgaacatcggagatagattctttatctggggagtgactacataatttaaccatttgttattttttattttatcagactgggatcctttaggagctgaaagggacagtatgaataattagccctaggacaacaggcagaaaccgggactgccccaggcagttaagatgcatggtgaccccacttaatggccaaaatacaaggaaggcttggtgtctccgcagcttcctgaagagggaatgaggggcaaggctctggcctcgcagccagctgagggagcgcttctctttccactgtctgattctgggtctctgcttcctcatctggatagcagccctaacacccactgtattagttatctgttgctgtgtcacaaatcacatgtcaaaacctagtagcttaaaacaacattgattagccctcatagtgggttggggattccagagtggttctggctcgaggtctcttatgagactgcagtcaggatgttggctggggatgcagttgtctgaaggctccactggaggatctgcttcccttgtggcccctcgcttggctggctgttggccacaggccacagagcactcaggaccaaggactggagtggtggaaccctcgtccttcattaacacaagcagggcaggaggatgagggtttgtacctgctgttggcaggggggcctcagttcttcagttcttctccatatgggtccctccaacaggtagctcaagtgttccaccatgtagtgactgactttccccaatgaaaccatccaggagagcaagaactgggcagaagctcgcctttccatgacctctcagaagtcacatagcatcacttctgccacattctgtttttcaaaatcgagccactaagtctggcctacattcaaggggaggagaatcatagctcactgtaaccttgaactcttgggctcaagtaatccttccacctcagcctctggagtagctgggactatagtcacgtgccaccacgtcctgctcattttttaatttttcgtagagatggtgtcttgctgtgttgcccaggctggcctcaaactcctggcctcaagtgaccctcccacctgagcctctcacagtgctaggattataggtgtgagccagtgcaccttgcctaggcttcacctttcaaagggaggagtgtcaaataatttgtgaacatattttaaaaccactgtacttagggtcaatgttctacacttataagttaagtaccatgtgtaaagtgcctgcagcagtacctggcacccattaaaaacagaatcttggccctccagagtccagcagctgcacttctgaatgctggtgggcacggacggggtttgatgtccagtaagcctgagcagccctgcaaatacagatgagcccaagtcacctgtacagttggggcctgaggaagttaggtcagttctgaggctcccccagatgtgggacactcctcacggacaagttcagtgttgtatttacttttctggatttattttcacaaatattcagcttagaatgtgccagggaggggaggaacatacctcctatgcggcaggagctgtattgggcacagccacgagtgtcatcccagggaactcatgtgagccctgtggagcaggctctgagcctcccccagatgtgggacactcctcaagggtttccaggtgaccacagagggtcccacctcagtgtggacatttccatgtgtcctcctgaaaccctctggtgagcatccccacccaccctttggtgtctggagccatggtggctggttgtccttcccacttagggaaccaggcctcagaactacagctcagaggcctactctgtgggctgtccttttttctagggccttgattaaatttgcttctctgaacactgtgaggtatctgtacttgttttaactcttctagtgacagcaatagaaaacctaaattggtgtaggtaaaagagaatgtagggttttgcaaactgaaagtacctggggttggcttcgaccacagcttctggttggacctctggaagttgtcatagtgtctctttctctctctccatctgtcagcttctcttcctccttttggcttcgttctcaaacaggctctctgtcccttcagggtggcaaaatggttgccaggctacagtaaataaataatctcatttcctaaaagttcttgcaaaaatgtcatagagtctgattggtccaattgagttaagcctgggtcgcatgcccacctcctaacgggttgggagtgaggtggagtggggaggggatggctccccagagggaagggtagatggatgtgggtggcaagaaacatgtctgccatggtattgttatcctcatttaccaatgaagtgttggcactcagagcaggcaagtagcttggccagagtctcacagataatagcaggtgcagaccgtcatcctcctgccccactagtgttgatgaaggacgagggtctcacctttccagtccttggtcctgagtgctctgtggccatcttccacttaaagctctaggacagaccagcagctctggaagtgactggattaaaaccccaccaactgaagacagtggcgtgggatgatggctcgctgatgggagacagaatttctgtctctcctgtcagaagccctttgaagaactcagctgtctggacaacaaaagtgggagcttttgttgtctagaagttcatgtgacctttcctttcaccttttagtgctgcctaagtgtaagatttaagcacagcattcttttcccatgtgtcatttttcagcagttaaaaatccatcagctgaggccacacaaagttggcactccctcctccaccaaccctcagctaaaaggttcagtggaagggactgatgctgtctccagatgcagactggggccatggattgagccacagagggaggagggaggagggtctcaaattaaaaagacaagaaacaaacaatctccccaaataagcagaaagtctgagcgtggaactgagctggttggagctggggagggggtgcgggaggtactttcagcactccctcgtgagatcatggaacagggcaggaaatctgaacctgctgccaaagaaaactcgctttgccttttgtaaaaagcctgtcgagctttcttcacaagggagctgctggtggggactcacaaatgggcatgctgcctgccagcaagggtctcctggccagccctaaaggcccgggctgctctgcttacagccacacggctgtttctgagctgaggatgaccctccaggtggctgagattccctccaatctttttatttctggttgggaaaccctacacagaccagtgtctgtctcacggtttaaaaggctgcatgcaaaacatttcctcccctggtagaaatgctgcattgagccacagccctccctctgcagcctgtgcagtgtcaaggggacagtggctgcatgatgatgtgcctagcagggtgtcccccatcaggacagtcacaggggtggaacaaatgcaggagccatggagccaaactgaactgggttggaatcccagtttcagccacttaatagttacatggatattgccaagtagcctgagttctcagaggcttgatatcctcatctgtaaggtgggaagtataagacctacctcacggtgtcagtgttaaataagacagggcaaaatgatgaaggtactctgtaaatgtatgtccattccttcctcctcctctgggttccttttcagcacttcctcaccacagcaccattcttaagttttctagcctcatttattttagaaggggaactggaggcagcttggagggaggtaacatctggatgtcgcagtgacagctggtggctggtgaggagtccacaggtcaggggcaacgggccctgcagacttctcagcatcccctgctcagaaggggctctcagagtccatgggctcagcaggctgattcttcccctctcctatgagaccatcctccatgtgggtcccatccaggaagctgcttccctcccaagggaaggaagccaccagtgtttctagaatctacatcagtgccactcaaagcgtggtctcctgaccactagcatccacaccagctggggcctggtcagaaaaacaaccgtgggctcctccccagacctattgagtcaaactctgggggtagtcccagcagtctgtgttttagcaagcctccatgactcgaatgtgtgccacagttggagagccactgtgctacgggcaggttatcccagagcaaaggaaggaaaacctcctctgcacaatgcactctgaaggccccactgaatacgggcatctgtgaggcagcatgggacctgatcactctaccatatatagctgttgtgtgaccttggaaagttccctcaccctctctgggtctctgtgtcctcatctgcaaaatggaacaatcataatactggattgaggatgagaagcatcaatctgttcatcctagcaaaatgtttagcaaaatgccacgtgttcagagctcaggacaggttagctccatcctgttaatgttgaggcagcccacccaggttaagggtctcattctgagagtggctttggacagcttgagaatctacaactgtaggtgacagagcaaagaaaactcttgaaaagtttctcttagagcctaatagcaataaccattaccatggtggcagccaccagagtaactcattatatcattccagcaacgctgtgggttaggagttactatctgtatttttacagggaggtacttaaggcaccacttgataagtggtagagccaagtcagtttgaaaaaaacataatcattgtgcaatgacaatttgagacattttcagggtcccagttccatcccctaggaatctgtaaagaggagagtggcttcaacctgctgttcagggcctctgccctcattccctggaggctggtttggacagtgtgagaggcatccttcccaaagcagacaaagagaaaacacatgggaatggtaattaaatgagtccatgtttaaggggcacttaagtggattaaaatcaatatgtagtcacataagtctgctaagccatccttaatgtttggcgggtggatttctttgtttaaaaaatcctggtttgcttgaaactggctgccccattgaagcatgagataggacgagagattcccaggacctggaagaccacttgctcagagtctgaaatgtttacactgcctctgactggcatctctataccagaaaggagaagagggggactagatgtttttgtgtggtagtctctttcctgctatcttaggctgagttccctaaaacaaaatcctgagatgagacatcatgtaaaaataatttgttaggaagtgttctcaggggaatgggaagtagagcttcaaagggaaggaggccaaacaaggatgtgatatcaagcaaagtccccaggagacagaaagaaggtgggtgactttggcaccgtctaaagtataggtcacatctcactgtcccaatcagggacaaaagagcatggctgaggattcccccaaggggatgtgaattctcaagcacttccatctctccatgttcatgcaaagaaggtgccaggagccccgtggccatcctcccacaaaagacacacaggtggtggcatctggggggtcaatgtgcatggttgtgcatggtagagacccctggatggagctccatgatgtgggatttacatcccgcccatactctgctgtgagagagatggtatgcagccagtccagccatctgaagcagaacgaaaaaatggtatggaaagcaaggcacctgaaaaaattttcaaagggagaaaaagaatgagcaaaactatcctgtagaggagagagacattgaaaatgacatatacagacacagaaaaggttgctcagtcaacaacttctgcaggctcaaagcatgggaagtaatcagtaaatggccaatttatctctccctcacagccaagccaactcctaacataattggaagtttaatatattccaacaagttcagaacaagcatactagatcttaaggcaatctcatggccctgcagctcatcctttttttcaaagaaattaattttcaaaaaatgactctattgagattgaatttagatcttatccattgccataaccaaaagcaacccttactatttgtgtgtgcaagtcgttttaaacagctggcccattaactgaaaaatgtcaaaaacaaatataggagaaaagtaagataatcttggaaggcaaagcctgtctccctatattgttcttaaaaatacaaaagggacacataacttcatcatttaattatattaggaggtccgtcattcagtgctcttgtaaaactgtcttgcccttgttctaattgcgtattgatcaccgaggttcttggcatcgggcttttctttgatgtgtgcatgatcagaacacactaagagacagcctgtgtgctccttcctgtcctcgtgggcatttcctaaagcttcagccctaagctggtatatgtttctctgttacatcaactgccaaggcaattactttacatctgatatttaatggaaaagcttctgaggacagggctatactcacatacctccacacctggcacagtagatgagctcactatctgttgaataagttcgtgacagaacagaagttctactgcagccacaaaggcctattcacagtctttaagcctgatgaagttctgaataagtaaacccttagctacatcaggcagtttatgaatggtgttttttgttactgtcatttgtaatagcttttgacctatgtgtttgtattagtccgttttcacactgctataacgaactacccgagactgggcaatttatgaagaaagaggtttaactgattgacagttccacaggcttcacaggaagcacgactaggaggcctcaggaaacttacaatcacggcagaaggtgaacggaagcaagaaccttcttcacatggtggcaggagagaagggggctggtgggggagtgccacacacttttaaaccttcagatctcatgagaactcactcactatcacaagaacaataaggggaaaatccacctccatgatccagtcaccttccaccagatccctccttaaattcaacatgagatttgggtagggacacaaatccagaccatatcagtgtgcaaatgatgagctaattttcccactaaagtaagcactggtatggtacatagtatgactatggtagtccagtattggattccataatttaaataactagtagactttttagttagttgaaaggtaaaacaatggtaataacaatgagctgtaaaatacgacctgtggggtgggaatggggacagccaatgcttctctggtaaagggaggccagtttcagcccctggtgcaacagcacccccatgcattcatcatgtgagatgataagtgtctttccttgaaccagttcttcttcttcctcctaggctgggaacttctccttggagacagcaggaactgtgttacaaaggcatatggcccaacaaaggacactgaggctactcagtaattattaaatgagagcatgaacaaaggaatgtaagatgtaacagaaaacatacgtgtctcacacatgagaattattgtgtagaagctgtttcccatttgagacaaaataagaaacacttgttgaacgagtagatgggcttcctctgggagcacagcaggtaggcacccatgttggagccagccatggtctgcagagttcatttctctgagtccctgccccagaggcacatgacataggaggctccagacaactgactcaaagacagagaggaccataataccagggttcctcagtcctcaccagcataagaatcccagagaaggcattttttttctcacatactctaggtctcaatctcttaacttcaaaaatggcagtggctacattagctcttgggaccagtgtttcaaaggctagtgtagaacacttgcctcagatgattcaagatccaggtttcctgactctgcttctgctgtaaagaatcccactctggaggctggggcctgcaatctgcatctttaacaagcccaccagagaatttcaatgcagtttcacttttgagggtttttaacttgattgtccatcagaaccacctggggagctttcagcaaatgcatgccgacgccacatgcattaattctgcggccacacagaggggcctgcatctgggtcttttttacaaagcttttcataggattgtcatcgtcacctttccagcactgttatgcaaattggagagactcatgccaaggtgaagggcttggtgagagcagccaggtcttctatgcagtgatcagcctgcacagctgggtgtggcatctctggctcccaggtggttccagtgcacacccccagttaagaaccaatgaagaatgttgcttgttaacaacctttgaaggctttttagcaaaaacaaagtgtcatattgggattcatctgtggcagtttgcagaacatatcaggggagagaggtgtgtgcaaggcatccaccaggaggccgttttgtgctggtctaggtaagaggagattggagctgacctgttgaagcaacaaagagaaagggaggaaggatcatcctagaagtggataccagttctttaagaagagtcctgagatgtacccaggagtagcaaagtggatgtgccaacccgagggaagagattagtaagctgctgccccctgagacagggctccatgagctgacaggttgatctgtggagatacactctgaaggtgctagactaggaagaggtcctctcaggccccatcccttcatcttcagccaaaggaagttcagcagtagctgcccctggcctctgttctcagtccacagctccaccagcccagttgcttgtgcagagggagaggatgtgggagagatgctgtcaacaccctccatgtcccctccacccaccctggaggccgcctatgacagttcgccataggcgaactgtttctctggttaggaactttctctggctacaggagtgtgctgcacccgagtcaggagggctggaagtgcaggatagttaacgtccccagtacagttttctaccaaggagagaccggtgagatggatagatgccccagctttctcacccgttgatgacacacttcactaccctctcctggagctccctgagatcactgcccatacaaactaattgcaccccaatgcttgtcccaaagtctgctcagataagggccgtgtgaatagacaggtcttcagttccagaaaagtgtatactcacacaggaaatatctctcaaataacatgggcagtgtatatgttatttttctggagggcagagggcatcatgaggaaggtggtcttcgtggggtgaatatcatgtttcctccagggagggctcagtgacatggagcagtgcttctcaaatgtccatgttcgcagaggttagcttctaactcatcaggtctagggtggggcctgagaatctgcatttctaacagtgagcatgtccagggaccacactttgagtagcaagaccttgacagcttcaagttgcaaaccagttttgaatgagcagagtagaagggggtttgcaggtgagaaggaactcttcaccatgagtacatttctatgaagatttctggccaggattttagtaagtacctgagccccttcaaacatttgactcccgcataaccttttcatccaaacaccattcatgagttgtttttatgccatgaggttaaattctttcctatcatttcaggggaggtccccacttgttgagttttccgtcagcctataaggcaaaggaaaagagtgatagaaaataaaaataacttgattcattagatggaattcaacttgaattcttagtttgttgactaagaatttgcagcctccgaggaaattttttttaattgaagaaaaactaatttttaaaaatctgaaaataattcgtttgtgactatttaacagaaggaaaaacttcctgagtgagcatcaaatactttaattacttcttaggcttcagaagggatggcttgctagtctttgtactttgggctttctgttacgactggttgacttagatttatttgtttatttagcttcttaatttcatatcctgtggtcctgaagaggacaatcaccaggatttaggggagtgtttttgtctttattcactttggaaaaatgtaaagattagtcctaagcagggttgattcaccgcactacagagggacacgttaggaacgagacagcttattcaagtgcttttgaatttgtattggttttttaaaatgtaagattatttttacttattttaaatctttcaaagcacttttttcctcagggccaagtggactctttgggaggagacctcgccgtctccatttgatcacataattgcttctgatgccagccagtctgcaactgccagtgattggcacagggttatttcatgtgcacttcaatcaaatttcttttcttgcctttttttttttttttttttttttttaagaaaaaatctcactgtggcacccaggctggagtgcagtggtgcaatcatatctcactgcaaccttcaattcctgggcctgtgatcttcccacctcaactcccaagtagctgggaccacaggtgtgtgccaccacctctggctaatttttatttttgttgagacagggtcttactatgttgtctaggctggccttgaactcctggcctcaagtgaacctcctgccttggcctcccaaaatgccgggattacaggtgtgagccatccatacctggcctccaaatttcactacctaacttgggagaggaattttgcattagcagttacatggttcatctgcctcaaacatttgttttgactctagcttttgcttgtttcacttttttaagcttggaaagaacaaacttagaatagtgtaggccttggcttccacatggatgttttgacaaaatttcaaggaagcaactggctttgtagtgctttctttgtcctgcttctccaaattccccaagtgcatgggtaatcacctctggttccctcggagtgttcgtggccagctccttcccagccttgccagcccattgtctgcatttggcatctgcgctggagtcactgtgtgctccagttccttaaggatacttttagtttatctgatctgtgctccacacctcttcagactccatttccatgaatgttttgggagaggtgaggaagaaaccttttctgctcattgttgcgcgttccccaccccaggccccgtctgatctattcttacatcacaactaaaaatattcttaaaaatgtgaatcagatggtatgactcccctgctcagaaccctccagtgccttccctctgtacttggaaccaagtccaaactcctgatgagcagcagggctccgcatggcctggcctttcatctgttgcttcccaaacgtgtggcctctggttggtttctggaactcaccatgcctttccccacacatgctggttcttctgccagggacactcttcactctcccttcatgtgcttagccccttcttagcttgcaggtctcagctaaatggtacctcctcaaaagggccttccctccacctataccaggtataatgctgtttgcctccttcagaatgcctctcacaggctgtgattactttaaacagattcgttgagatatagttcagatgccatgcaattaacccttttaatgtatacaattcagtgggtttgagtatattttcagagttgtgcatctattgccagagtcaattttagaacatttcattacctcaaaaagaaccaccatacttcttagctgtcgtaccccttcccctatttccaccagccaaaggcaaccagaaatctactttctttctctctagatttgcctattctggacattgtgtataagtggaatcatttatatgaaatggagccagtcctttgtgactggcttctgtcacttagcgtaatgttttcagagttcatttgtttgtggcatatgtcatacttcattctttttcatggctgaataatattccattgtatggatataccacattgtgtttattcattcatcagttgctggacattagattgtttccagtttttggctattacaaattatgctgctatcaatatttgtgtacacatttttgtgtgggctcatgtttttatttctcttgggtacatacctaagagtgggattgctgggttacatggtaacttatatttcactgttaagaaactgccaggctgcttttcaaagccactatactattttacattcccatcagtagtatgtaatggttccagtttgtccacatctagtccagcatttgttattgtttgtctttttgattgtagccattctaatgagtaggaagtagcatctctttgtggttttgatttagatttccctgaaggttaatgatgttgagcatcttttcatgtgattattggccatctgtatgtattttttggaaaaactattcagatcctttacccatttgatagttaggttacttatctttttattattgagctgcaagactttttaaaaatgtatcctaaagttcctattagacatatgatttaaaatattctcatcctgtggattttttcactttcttaatggtgtcctttgaaacacatgagttttaaattttgatgatatccagattatccagttttttttgctacttttgtaattattattattatttttattattattatttgaggcagagtctcgatgtgtcacccaggatgaaatgcagtagtgcgatctcggctcactgcaatctccgcctgctgggttcaattgatccttccacctcagcctcccaagtagctggggctacagatgtgtgctactacaactgggctaatttttgtgtttttagtagagacagggttttgttatgttggccaggctggtcacaaactcctggccccaagtgatccacctgccttggcctcccaaggtgctgggattacaggcatgagacactgtgccctgccagttatttttcatttccttttgaattttttgtttttgccatctccccgtgtaggctgcatgtgctgcgacggcagcgctgtgtttgccattgtagccccatcccctagaacagggcgtgatatagggcagcggtcagtgaatagctcttcagtgagttagtaaacaaagtggttctcaaaatgtaaaattcttccttgactcactaagcaaccttctgattgcaactgctttccctttttggcctccaagacaggaattctctggccctgctgacaggagccccatgttgcacagggcaactatgtcactcattggaaattaacatgtctgccctctgacttcagtatttctcccaggagcagaggatggaagttcttcacagctggatctgctgtatcattcagaagctggcttcagagcctgtgtagctggaagcctcgggctcacatcaaggaagggaatgccactcagcctctgggcacacagctgcaacttcccctggtgctgtctctcttggtgctaccctatactagccttgtcctgaaacatctaccccattcatttcaccctctctgctactatgtcactgcctctcccatcacagtattccacccaaatgaggcaaattcttatcctttcaagacctaccctagagtcaccttttttgatatatttgcttttttatttactccaccaggcaaagagggtggcaccctgctatgagctcttggaacaatttatttataagttccttatagcctggatcgtattcaaccaatagtttttccccctctattaaaatgcgttaatttggagtctttgcttactaaatgctgtctcctttttttttgagacagagtttcgctcttgttgcccagcctagagtgcaatggtgcaaactcggcttactgcaacctctgcctcctgggtccaagcgattctcctgcctcagcctcccaagtagctgggattacaggcatctgcccaccacgcccagctaattttttgtatttttattagagacggagtttcaccatgttggccaggctggtctcaaacgcctgacctcaggtgatccacccacctcagcctcccaaattgctgggattacagtcgtgagccactgagcccggtcaaaatcccttcttacctgtcatttgtattctccccattctgtgtctgacatcttgtaggtgtttgttagatgattggtgagtgaattaatgaatgtacagatggatgatgtataagtcctttcagagggaaactttgagtatgttaagaccccaggaaggcttatacttgatctttgtatccagaatgttgccaacattctggatacaaagaaaagcaccctctctgtgacttctcagatcccatctgcctctgatctttcatgacccctgctggattgactacatgagcctctttcagaagtttgactagcaaatcaacaaaacagttcaccctctgcatctctgctcagggatcaacaggagtgcttgcttatgtggcttcattccagtgggaggttcatattttcttagttatgtatcatgtagtcttccttgattcaagagtaccatgacttgtgtttgttctgactccaggactatccatgagtaaccctcagccaagagtgtatcatcagggcctgagcaagtggcaggagacaaggtatagtgtgaatctagtacatggaagagaatgtcttgacagctggggtctgtaattcatatgctgttcaaatgacaggccttttccccacacctgtgtgtattcaaagcaccatgtcatgttctgtagggagataggcaggggagttgggtcaggagaaggaagttaagattgaaggagaacatgcagaggagctttgggaaggaatgtgcccggctcacatcctggctccatcatttaccaactgggaaaccctgggcaagtgatataacttcacattccagtttcctcctcataaaaatggaaataaagagaaggtgtacatagagtttttagataatggatttaaaacactacctggcacacagtaaaccattactaagtagaggctatgtactccatcctacacgcatcagcagtggcagtccagcaatactcctataaggcacatgttatgacttcattttactggtaaggaactggaggcttagagaaaggatggttaatttgcctgacaacacattgctggtatatatctgagccaataatcaaaattgggacactaatgccaaaggttttacaatttctatgctgcaggctcaggtgtttttcttcatgggtaggaactttatggctcaagcccgaaggattcccctctgggaatacgactgttctggtaaggttcaagctgactcatcattgagtgctgctaataaagtgtttgctgagaatgttttctgttaactcattgagccaggttattaagaacctgtgctcacctctgacacctcagttgattggggaatttgggatgaagtgcttccaaaatttatttgaattctaaattaactaagtgagttaacgtggaagccgcttttaccagcccacaagggtcacgcttgttgtgtctggaagaaggaaagggtcttagaggaacacaaattgccagactgacagtcagatatggagacaccagggtcatcttcagtttaacaaacacatgtcagaactagaaagttggaagtgagacttcaaactctacctagcattgagcataagcaggtcactgaccacaaagatattctgttcccaaagagcaccatattcgtggtcaagtaaggccagagtctagactgacatcaaatgcttgtatgattgggaggaaggagcccgaaggccaaagaggctcactaatttcattattcgattcttccaaccactgcacgttacaaacagggctgtagcctgggtctactggccaagcttccggggctgggacaggcaaggtatgtctggatgagagaaggtctttgccaagacaagcatctcttgtgccaggcagaccagcaaatgagctgcttcttgcagccccttctttggcatctcccataagccaaggcctattcatttaataaatgcagactcaggagctactaagtgccaggctcggtgccagacactgagaatacggaaatgagtacgcataaatcaagtgtgcttttcatcactgtgtttttaaaaatgttaactgatgatttcctgatcctgagagtaatgtgcagatgctccttgaactatgttggggttatgtcctgataaacccatagttagttgaaaatatcataagttgaaaatgcatttaatacactcagcctacgaaacatcatagcttagcctagcctacttaaacatgcttagaacagttccattaacctacagttgggcagaatcatctggcaacacagccctccatagagtatcgattgtttaccctggtgatgatgtggctgacgaggtgctacagctcgctgcgctggccagcatcttgagagtattgtacagctttctaccactttccactgaatacctattgtttttacaccatcagaaagttgaaaaatcttaagtagaaccatcataagtcagggactatctgtatggtagtagaaatttttaattgaatcttctgtaatcttcagcaagaaaccctgagaatattgaacgtctttgccagacaaggaaaagtgggactggggaaaaggccagttatgtgaatcctcttaaaatagggtctaaaattttataataaaaatgtattttaaaagttttgattgagactttgcctgaaatgtgaaactgaaaattacgaaattaggtttattttatcctgcatttattcagtggcactcaaaacattgtaattataattgtcaaagatatcttagaccaaaggcaaaagattatttgctttattagagtctttaaaataacagtgccctaacttctgaaacaaaagaaggaattgagtgctggataggcagcttttgaatgtgaattttcctactatttcataagataacatcctttgcttcatattttgtctggttttcggtacaatcacaaaaggatcattttaacaatggtcacttttttctaagggcttctcttgatcttttttatttaaatctttgtcttctgaagcatcttaaagtagtatccaggagaattttgactccttcaacagttaactgatctaactctgccagatccagatttatcagtggttttgcagtggttttatccatttttcaacatcactttcattgatttcatgaaagtctgcatcttttagagcaagatttctgcttcactctgtatttgatttgcattgtattgtagtcagataatcagatgtctgcactagcagtcagggacattagatagacagtttgctcactggtccgcgttcccagtcagctaagagtctcataaccatcagccttgataaatgctaatgttaagttctctaagttaaagccagtgtaggcaatgattggaacttggaagcaatcagagcacagaagaagcctggtccctggaatctctcccatatgcatcctggtggataccaagtgcctggcagaagtcataggcaactcccaaccagagcgctctccactgacatgttgcttagagctggggacagcttagattagccatatctccccaaaatttgtatttttaattgaattgattttttaaattgaatccattttaaacatgggattttatttttatttaaagaattaccttgtgggtatgtctgtgactcttgggtgcctgcctggctgccaagaagacatgtggctccatgatgactctgctttttaaggttatgccctgggcatgatctgaaaccaggagaacaaagtgggtactggtgttgccttgaatgaagtgctcccctaatgggggaagccttgcaacctttataaactgcagtcaggactgttttctcttccttagtatggatttaaacaagaatcataaacacgtgagctttctcctcatcctccttttgttgcctctccccacctgggagcaaatgcctaggactttccaagtggttctcggtgccagcagcctcataagggaagagtattatctgagttcaggttcatcagaagcagcacccgagatggactctcatgaaggggatttattggggcaagaggagcgaagggagcagaatgaggaggggaagaaaccaaacaggcatgtgggctcagctggagtctgcttcacccagtcctatgggagctctggaacattaattgtacaacagagttggtcttgtcttgaggcaaaggggacatccttgggtacccacatcaatcagaggctacggaatgcttttggggaaggtgtcataacctcccaggcaaagcgactccattcaagctgttgtacttatctagtaaggggttctgagtggagcaccaccagcatccacacaaggagtggtactgcttgccaaagcccatgctctgatacacctctgggcctccttggaaatcacagtagtagaagagaggggtatagaattaaaaacatttggtcagggcagttgacatggccagtataaacagctatgttggtgctgacaggcagcagaagggtaatccatgacatcccttcctgtaacaccatcccggagcacatgagtcatgaaccataagctcagctctcttgttcctagagatgatgtctttggtttactcttttggcctgtcctcaccaagatccaaccagaattttgaaatttttatttgactgagtaaggtggaagagagaccagaaatagttaaataaatgctgatataaatgttacgttctagcatttgggaattaacaaaaataaggtagctgagcagcttttgaatgatcaaaagtactgttgtcttaggtcaaagctaattaaactgaggtttcctcgagttccagagtacatttttgaagacatttatttcacacatgcaaaaactgaagaagtctttggggcaataaatctttttgatttcttttttttttttttttttttttgagacagagtcttgctctgtcaccaggctggagtgcagtggtgcgatctcggctcactgcaacctccacctcccaggttcaagtgattctcctgccgcagccttctgagtagctgggactacaggcatgcaccaccacacccagctaatttttatatttgtagtagaaacagggtttcaccatgttggccaggatggtctcaatttcttgacctcgtgaaccgcctgcctcggcctcccagagtgctgggattacaggcatgagccacagcgcccagccaataaatctttacttcaagaacagacctttgacttaaaattaaagcttctctcctggtttgaaaggaattcccagtgaggtattgggcattacaagagaaactggaaacagagttaggtaagcatgtaatatatgtatatgtgtatgtgtgagatacacacacacacatacacttatatatatttgcttatcctgggacactcttgagactaattataccagaatgacagaaatgaaccaggaccgtccccaggaaaccaagagaactaaagtcatccaagactttggcttgctgcctctgatgtccacaggccaattagccaggatttagggtagtgtctacttgggacagttgtgggtgttgcttctggcaggaggaatatgaggaagaagatggtagggaaaggccatctatggtgaatcattaatgccatgcagttcttgagacagcatttgagaaattattctctggttttccttattgaaattgccaatgcctgttctctaggttctaagagcagccctcacacttgccatcacacagctatgtaaacacctatgtctctgctgggaggtccccacctcttctgaactctgagctctacgaggacagcgattaacatctctcagatatgttctctcagtgctgaaatgtggtgtgtgatacgacaactcagctacccagtgcatgctcagggcgcgttctgaatcctgtgccatttgcatgttacatacatgagcttgccatccatgagtgtttggggacaagacagaggaagaaaaccttgggggaagggctaaggaaaggtgctccttgacagtgaggacaacttaaacagaggtgtgaacataagagcaggcagggtgtgtgtagaatagtagcatatacgtgccacggggcaggggtggaagaaccacaacagaacaggatgggccaaaatggaagctgggatcttaagatttgagactttattctgtttgcagtggggacagacatattttaagaagcttcctctggcagccagccaaatggactgaaggggaaggaaagctcatagcagcagctaccaaacatcattatccggcagaatcactaattttatcactcaataattttatgtattaaaaatgctcatcccagaccctgcagtctctgtgtctactcagaaaagactcatgctgtgcaattagagtgtggcccaggaatctgcattttatttatttatttattttttagacggagtctcgcactctcgcccaggctggagtgcagtggcaccatctctgctcactgcaagctccgcctcccgggttcacgccattctcctgcctcaaccttaaagaggctcccaaggtgatactaacgctggcgatcctgggtctctgtgtgaataacactggctaagagcacagagagatgttagaaaactaatcatcattgagatcagttatatccgagactggatgctgaaaagatatattagagtttagttttatatttatatatctcttatcttttgtttaattgtatttgggcttttaggggttttgtttcattgctattttctaagtaagagtgtattgatgtttaacaaacaaacaaaaatatacaagttattaagttcccagctcaatgaactttcacaaaatgatcaaacctgtgtaacctgcactcagaactgccttccacttattccataattactgtcttgatttctagccccatagattatttaccttttatcacctttatttttggtgcatttgataatgttcataatatattagaataataagatatgtataattggataatttaagtagatatattatggtaaatgctcacatgtttttaccagttggacacaaaataaaaatgtttttcatccacctgtctagatgccttgaaatgttagtctgagctgagatgtgagtcctggaaattggaggacctctgtaccttctcttccaaaatctgtaaacatactgtttccgcttggcagtcttgatttgctttcagtgactctgagaagccctgtggtttgtgaagagcctcttggctttcctttgaccttggttggaagccatgtgcccaggtggaaagacagcagttccctacagcctttctcttctgtttctctcaagtcgctgtgtgcagagtccagcctaagctggctacacttggaaacctctcctcacccttgtaccctccccacaccctggggagacttgctggtggacagcccagccctcactgcttcaggctttaggaagaaaccctctcttttcttggtgtgattttcttagagtttgtctttcctgaaccaccaagatctgaaaaggcaggattagggtgtgggcttaggagaaaggggccaagaagatgacagggttgccttttcatccaaaccttaggaggtctccagctcagccatggcccagcccacctcaccaggactgccctagggtttgaacccaaagcattagttaggaatgaagagtggttttgtcctcttacctgtcttcccagggaacccatgaaaaagtgggcagctggaagggggctggagacggcctggtcagggcatctcgtcccactggtgcctaccgtctgagcactgctctgaaggactcgattgccccgtggagcctgctcccacacacctgccttttgtgcagccggcccatctgttggtgctttttctttcaggaggagatgggcatctcctgtgagctgctggaatcggacttcctcaaatgcagcgtgggatttcctttcatgaggtcaaagtcaaaggtaagggacacagacgggacccttcctcagcagcaggcccccagcccttccaccagccactgattccgccgcctccctgaggtgaggagtcctcccaccccctgcctcccatagcagctggggcggccactgaagccctgacatgctcctgtccctggctgtgtacaccggggtatactccggaggggctgcatcatatggtctttctcttcgattcacatgatgtaccccaaatgtgaaagtgaaggacacaccacagcctctgcactttagcacgtgccatttagttgaccttcctaaaataattttttttctgagacattctgtgcctctttgagtcccctagacaacacagaagaagatgtggtctgtcacctatagtcctgtcattcccttgggtgctcacagttttctgaagagaactctcaaaattctcaaaacataaatacctgtatcccacttcatttttaagaagagtaaagaaattaagtcactttggtattggtatggagacagattttctaagttcaaatagtatactacagcatcttcagacattcatggaacattgtagtatgtgccatcattataaggagatacaaacataggtaaaaagatgtggtgattggaggcaaaactagaatctaaaagaccaagtctgcctttggaaatggaagctattttccctgccatgaacagagtgagactccgtctcacaaaaaaaaaaaaaaaaaaaaaaaaaaaaagtgaaagcttcatccttttctcctgcctgggtcatacactcagatcattttaatctccaaggctctttggtcccagtatctagtagctatttgtaaaccaatggtgagaatattctggtgagggagaagacttggtcatttcttagcaaatcacttgaacccataagccccattgaatgcacctcgatcttggactttccagccttcagaactgtgagaaataaatgtttaaaccacccaagctagggtaatttgtgatagaatcccaaactgactagggcaaaaaggtaataactttctcactgttagggtcaatgttgttcagtgctgtgttcacatatcacccaagataatctcatgaaccacctaaaataatcttagtgtaccactcccagtgtgaacatcctgtgatttgggtaacactgccccaaacaaatggtgttcaccatatacatatcaggcacgtgtgggaatgtgggaggaacccctgggtaggggttataggaccaggctctaccacaaactgtgtgatcttggcgaaaccacagtggccaagtggccaagtggcccatgactcctcggatttttttctgcctctcttcctcattctgtccacattcaccccaggaggagggaaacctcaataagtgtctgcccttggaaaatggattacatgtggatggcagagtacaggccaagtcccattagactccaggtagggtgagggtggagataaaggaggacgaccacaatccatggacactattgcctatagtaatgtatgtggcacatctgcacacaaatttaattaaaatcttttgagtaacagataataggcttaactggaaaacttgcaacagtttccatttcattttaaactccagcctatatcacatatcagacctaagatgtgtctttctctctctagtggagtgttacattttgtcaaatttttgtttgtttgagagggagtctctctctgtcgcccaggctggagtgcagtggcgcaatcttggctcactgcaacctccgcctcccaggttcaagggattctcctgcctcagcctccctggtagctgggattacaggtgcccaccaccatgcccagctaattttttgtgtgtttttagtagagacaggtttcactgtgttggccaggctggtcttgaactcctgacctcaagtgatctgcccacctaggtctcccaaagtgctgggattacaggcgtgagccaccgtgcccagccaacatttattagatagagcccacagaagtatgaacattggaatgttggttgttttcccagctggtaatgctaccactttcctcccacatacagatgctgggacctgaagcaagactgactaaacctggggattggggggcatgggagcagagggtgattccctggagaaagcccaacaagtcacccagcagagacggggctccccgtatccgcagcccagcgtgcactcccatgtccttccaaccctgagggtcctcaggctccaggccacatgctaagcctcatggctatactttggcttaccttggatggccatgtatttctctctctcacagcctgcccagtttctgacattctgttcttccaggcctccatccctgattttggcttctcacccaattcttttgcctgtcatctcactgtgctctttaatgtttttaatttaattcagatctcctcccagtgctgactctacaccagtcaagaccctgcctctctcttccttcttgtcctcttcccgccctgtctccatgcctgccccccaccccacagtaagctgaccagtcccacagcaacagaaatttctgtctagaaagagatgtccatgttcactgtagatgatggtccattgtaatggaccaatgtccgttgctttcaggaaacattcagtagaattcagtgttgcaaatattagaccattgcctagaattcaccataatggaacccaaaggtttagacattgtataagttataggctctcaaaatttgatgaaatttaagaaccgttttgtccaacctcctttttttattgaaatgcaaagacagtatcttagccaagatcacagtcagtttgtggtggaacctggtcctgtgacccctacccaagggttcctcccacattctcacacatgcctgacatgtatatggtgaacaccatttacttagggcagtgccccctactcacaggatgttcaccactaagtggtacactagataattttagatggttcatgaaattatcgtgggtgatacgtggacgcagcactgaacaacattgaccctaacagtgacccttttcaccttagtcagttcagtcatctataacaaattaccctgggctgggtggtttaaacaacagacatgtatttctcacagttcttaaggctgagaagttcaaggtcatggtcccggcagattcagttcctggcgagagttctcttcctggttcataaacagaaccttctctatgtgtgcccatctggctttcccttggtgtgtgtgcatggagagagagagatctctttgtcttctcttcttctgagtgcactaattccatcatgaaggcctcaccctcatctaaacctaagtaccttccaaagaccccatctccacataccatcacataggggggttaggccttccacatattaatttgaggagtggcggggggacacaaacattcagcgcataagacttttcaatagtcttccaatcctagccacactcaggagaacgtctccaatcctgctagcacatctttaacacttctctatcaccagcaaatctcccttttcaacaaagatggagtagaccttaggctcagaggcttccaaaggcaacagagttcagcattgctctgttttcattgtgttcatttttacaactaccttctctttttggcaagtgatcctggattcccatctatgacagtgatataaattgttcttttaaaacaatctttaaactaaaagagtaaggcaacaaaaatatgaacaaatatcccaggtgatgtaatttgcagatgtggcagaaattgaaaagatggtatgtgagtgaaacttagaaagtcccggttaaagagtgtaaacgcatcacttcctaaggagagcctcggtggcggaacaggagcagcaggtctctggccagagtatgtgtcaggcttggttttactgttaaagctgtgactttggcctgacagtcagaaagctatacataaaactaaagcttatcatgcaaatgagcttccagaggtcataaactgcagaagatggaagagaacagtttaagtttggaatgcctgctgatgccaaataccacttcctttttcactagtatgaattcagcgtgatctttgatacaagccacctgtctggggaagaggaagttctcagcttcattgttactgctcagaggtaaggggggggtttaaacacttttttcaaagatgagagatttatgggaccaggaaaggatgtgtcctggttaagctttgatgaatcccaggatgctgaggaggaagaaatggttactcagtgataaagccttgagccgcaaagtggaattggatttcttggggatggtggttgcctagtgctgcttgcatagccgccactgcagattgaactgagaggaactgggcatcagccactcagaggtgatgattctacagctgaggagagacaggcccaggggggtgaggctctagtccaaggtcagttcccacttggctgtgtatttcccagatcagacagatgtcctctgcaaattgtctggctgggcccactgctgcttttggacatggtgctgtatcccttgatggagtgggcaggtcacctgcagcctgagggcctggctgagcctgttggcagaggccccaagagatgctactcaagagagggcttaatttggaagccaagtggatggataggaaaggggatcgtggggtggcagcttctcccctcagtagcatgtgcccgcccctctccaggatagccatgagtgcctgtgggggcttctggggagttacaagatgccttctccagggcagatccagcatgccttgaagcagcatctaggtagcacttggctggcagctccagtggagggaggggcgttcaggtgggtgaacagggagacacaagctttgattggggtggtggttggacacccaaggcaaccttttcattttcacttggaaatgatcttaaacttaacagaagtcttacaagaatagtgcaaggaactcctatataccctttacccagattcacccagtgttaacattttgcctcatctattttatcatcctctttctatataattttttttgttaaccatgtgaaagttgcagaaatcatgcctcttgattcataaatacttcagtgtgcattcccaagaatgaggctgttctcttaataaactgtagtatagttatcacattcaggaaattgaacattgacactatgctattagctaatccgcagtttatgttctgattatgccagttatcccaataatgtctttttagccgcttctttttactggtccacaagacttggttattttctattgacactattttcaagatcacataatttacatcacataaaacatgactgtgatctaatagaagcctatgcaaagcatagatagggtagacttcattcccattgcacaaaatccagaagggcttcagtggggaggtagcatttaaacagaggagtctgttttcaggctgaagcaacatgggcacggcagtgaggctgtccatggggcaagaagccctgttacacctgtgtaggtggtgggcacgagagtgtactggggattcgtgcaccttctcagaagaaggatggggagcacacaagcacagtgggaatggggctgaaagaggagcctgggcgctaaaccatgggggacaaaggtcacctagaaaatctgaactatatcctgatggcactgaggagccactgaaagtttttgaaaaggggagtggcacagtgcaacagcttggccccagagcatgaggttgatgaatttgataaggggcggcagatgcccattcaaacctgaaaattctcattctcttgccatttcttggatccacagaacactcgccattgttgggcagacccatcaatgtgctctcttggtccttccacacctgaggcagcctgtatgcctgggaaggaatgtgacatggaagagatttcccttgtcaaaatagaagacacttcctgcctccacctaattcagggctaatcataacagtcagagagggcagggaaccagtattgcaattgtgaaaggttcatttgttagaataacatgtccacacagcagcagtgctctggttttggatgcatattagaatcgcctggggagctttcaaaaatatcgatgcctgatctatccccagagaccctgaccctgcctctgcctggggtgagacctgggcaatggagttttcagaagggctcaccaaatgattctaatgagcagccaaggctaagaaccactatttataatcccttactctgtgctgggcacattttcactcagtaaatatttattgtgcaccttatatttaccagttgcagtgctaaatgctgggcacatgagaaaatgacagtaacctactaaattcaagaacaccccctatgtacattaacagtgctgcatagcttcaggaagccctaggatctgtagcttcaataatataaaaatttctagtttcttaaatcacaaatgttaagatgaccatattatcttctaagcacacaccagaatatttcagatgctcatttcttttcaggcattggtgaagatatggtctgactgccccggagggcacccacacacagcgcttgactccctgctatgacggaaagatccttaaagctccttatcttgaaaactacagttaaaatctcaattgttcctttcttccatcaccaccctttgaaggtctctttgcctacttgtagatttagggggacataacattgagactgagcagtttcttgaacctctcctctcagcagccaccagcctggcttttgcagaccactggaaagtatcccagctcattagcttttggaatgacgggaagccttttgatgtttgacgtctttatctcaactcttcaacttagctcattctggagcagtcacacgatgacagatgagacggttgggcctgagccggccaaacaaacggcagggcaagacctggcaggatgctggggtgggggcgggagtgggccaggatggtgttaacccatccacaggggagtcgcctttggcctgcccacagcagtgatcccaaggcttttgtcaccccttgggaaaggaaggacaaggaagtcaggctgtgtgggcacctgatcctgctgcttttgcaaactgtggatgcccctgagggactgatgtcaccccatgtaggaagacagatgaggagccagggcagagactgtggccctatggggtcagcgtcacacagcaccattgtttcagaacaataggagggagaaggagaggggatgtgagagctatttaagtgctgttgccattcagcacttgctggttgagagaggaaggcagtggggcagggcttggagggggcagagagagggcacagagcagacagggactcagcagatgttcagggaacggcgtggtggggaacagtcaggatgagctgagccagcctcagcaggtctaggggactcttttcttccgcccatgcagggtgaacttgggaaccaactgtgaatgtaggttcaagaacatgtacccaagagccacgcattttcccaaggaataatgatcacaattcctattagaaatttaataaagtaataaagggaaactaggtcttctctctcttcctcctgttccttctcctcccttcttcttttgctcctcttccttctcgctcccaaatctggcatcaggagcaggagtcacagctgagagagccctagtttgaagtctgactgagctggttggaatctcagctctggtttgcaggggggccttgggcagttacctgatttatctgacttgctccttacctgtcaaaggtgggtgctccatctccctctggggttgctctgaggtctcagtgaggccatgctgagaaatgcccggcatagtgcctggcacatagtagccacttaacagcatcaattccctcatgttcacctttccagaatgatctcacaagaatccccgttctgtgctttctcacccggaggccttatgtggatgtattttagaatcacctggggagctttcaaaaatatcgatgcctgatctacccccatagacttgctatagccagggtctatagcgagagcttccatgatgtttatagtggtaggtttggtcagggcctctttcctgggcttggctgtccatggatgatgggtggtcctttcaggtgagacatagctgctgaagtctagcaactccttcctggctgcaataccctaacttcattggtccattgttcgtggaacaggcacttacacaagtagcacacacagtaggtgccctgcccataacccctcagccctcacccttcccaatctatccgcaaactgggcagattccggctcccagcaccagccaccctgctgaggctttctctggccagagcccactcacttgcctgacaggcaggtgccagggggttcattccaccccacccccacccccagcagcagcaacagcagctctcaggagtcagtggataaaggcctggctcccatgccctcagctaggaagactgactctgcctcacagagtccccgcgagactgggccctggctgccgacagcacgaccctcctgtatggcatgcctttattgtctcctttcctttgctctctcccttctccactctccagtcctactggcatttcctggggccacctctcgaataaactacttacactcaaatctttgtgtggaacacaaccaagacaatagagtgcccttgatagatatgtacagggaccaaaaacagactgaaggcaatgaggtgccatctgcccttggagaatgtagagattcaactctaaagtggaacagagaaagcccactgctggacagctagtgttggccagcgttcattcattctcctctctctgcacagtggcaacacggagcgctctgaatccctgcatgacaacaccctcgtgctgatggtgccactgatgcacgaggtggacacgtccatcaccgggtgagtagcctggtcctgggttgccacaacacaggagtgccctccagtggaacactgtgcttctcatatttgcatgtgtagccagccaggagccaagggctgtgccacctccacttcctcccagccttgaaaagcaggatgaagctttagctgcagtaactcatacactcctccctccttgttttctcctctgtcccacctacccacccacctggtagataatctgagaagtttgatgacaagtttaagccccataatttctttgaacattccatatacctttatgtgcatatattctcatccgcccctagtccctccagaatgctgtatggtaacaagcagcatggctcctgggattaaaatctcagctggaagttgctgggccagagattatcaccagatgtgtctccagtcctggctcacaggaggaccactttctgattagctccacaggcagtgctggctttgcttgtttctgttaactccctctgcagagccagaggtggcttttcctgatgtctataatggtctggaatgggcagggaaccatcccatcggccacactgtctgtctgggtcaagtccacggtcattcagtgccgctggcattgttggaaagcaggaccctgggctgcagtctgtggagacctgaaacaacctgtgtcagttttcaaccaaagccccagcttggaaaaatgagaactccatttctttccagcttcagaaaacagagtgcatacctctttgatagtggaaaaaagatttacacaattagtttagatcaggtgaggacccactgaacccttgacccaaatgcaagctgaactttctggaggttcacagtttctaatttttcggttttcaagtgcttctgggtctcagccttgattagcagtagaaatgttgatcccttgcagggagagccatccctgcactagcccgcactgctgggagccagtggaatgagtctccaagcattcctgctcctgagcttttggcatttttggtcatgttttttaaacatgaggtactgatggaatatatttgcaaattagcatatttttgcctctgttcacagctctatttttaactgtatcatttatttacttgtctcatcaaaggcacagcaagaatatacccagaaccaagccctatccttggggacaaagagaaaacattctccccaccacccccagacacttgatcatgtaatcagtccttagaggaccttgttgggaggtgttaacagcccctgatgaagccatcagttaaacaaatgagtcaacctctgatctctccaggaacctaaaacagctcttgccatttggtaatgctgggaactcactaccttactaaaataatgcactaaacattgaaaatggatgagttgttgtctattcggacttagtctcaaaaatctgccattgttgtgtttaggtgagtgagtggcctccagcatctagaagtcgatatttgtctgggagtgtcagtcagagctttgtttcttctcaggaatgtgttcatataagcaacattgaaagcattgctgcaaactgagcttgaattcttctcacctcttatgtagcctccgaaatccaagggaaaatgctatcaatgaacggattcagctttcaaatgcctaacttctagtcatcttggcagtctgataaatttaagttttttaagtgaatttgtcatagagtggggtttaggatgccaaatacataactcatttatatttattttttaaaagcttatgatcatcttcttcaacccataaaacatttttcgaatgacaaaacagaaaatgtatacttttataatccagtttttaaaaagtcaaagctatgataatcttgtcatttcagaaaggtaatcccagtgcatatttctccatgcagcttattgacgtaacctaagatgagaagacactactattcatgcctggtcagaaagcacagactggctatgtaacagccccagcagggaagcactgggtgcaagacactggattaaattgagacaaatgtttgcttctcagaatggcagtgaccatgggtgcttgactgtgggtggggatgacagatttcatgctttcctctttcagaatcatgtctccaacctcctttgtatatggcgagtccgtggacgcagccaacttcattcagctggatgacctggagtgtcactttcagcccatcaatatcacccttcaggtacccactcctggagacctcctctgtccgtgggggctaacggaagggcacatgggatgtctctcctacagagggctaagctcttgtcaggagaaacccttctgtggttggctggtgtggtgtgtgtgtgagatctgtaaccacacacagaatgaatccttttcgatgcctggtactctgctgtgcaggcccctctgctttttcaggatttggaaggacaggtccacgtcatgaatgccagttttccccaagaagccctctgtgtggtggaggcctcagccaatgtcccagcccagatgaccccatgaggacccctttctgttctccatcattccccaccttctgggcagggctgcctcagaggatttgctgtgtcccttcctcctgagattttcttgccagctcatccaggagcccactcctcctgcaggggaacagcctttcggaagggcagttttataagaacagaggagtgtgagcccctgtgagcccccacgggaggcacgctgctccctcactgagccatggctggcttgcccaggcacacaggcatcatttccagcaagtccacttggtgtagactgtggacctcatgaaggacactgtttcttctcttagttgggggtcagcaaactttttctgaaaagagccatggggtaatttaggctttgtgggccatttggcctctgcagcatctattcaaccatacttctgtagttcaaaggcagccatagataacacagaaacaaaattttagttccttatagacaatgaaatttgaatttcgtataattttcacatcatgaaatgtaggcccaagcgagaaaggatatcctgaaggtcccagagctgggagaagccgggctggggccaagacctggcggcactggccggaccctgtgtggatgaagtgaaggagatgggcccaactcacccataggacacaacagtccatatctcctcactctctggttctacctcccagaactcttctctgcctcttgcgtccttccccatggagagatggtttcccactctggcattcactgctgtggctaaataataattattttctttccttgtggcctctcctaggtggacttaggggatgacaaataatgacagggtgagggtctagagaatgtggcagtaaaacatttgtgggctctgacaaacaatggtcttcctctccccagagtattctcccagcaacagactgcgaaaccatgatacataacacatgtccccagctcacagaggatgtgccttctgaccaactaagcccctgctgtcacaccctgctcttgatttacaggggagaaagggaaggatggggttagagcttgtttttgagacagtagagtgattgctgtgaacagcacctctgcatttctgaattgcttctcagagttattttatttttctcctttgcttttcgtaattgggtaggaaatagataaagacctgatgggtttatttcatcttagttgtttctactctttcctactcttatagttttgggggtgtcttgcaattaaagatgtagttcagaaaattatttagaagggttcaagtaacacagaccatgtaatgaagagggtatgagtgttgaaagaaggaaaagaagaacaggggttgcacagaatataccaaatgttcttatcaccctctggggaacaaaagaaagaaatctgagggtatgcagcttatccttccagttgtttctctgaaggtaatttttacagtgagtttaaagtttggtattcaggcaaatagttttcttcacatctgacctgaaataggactcaggctagagaatccagccctggggaatgagtgattggcatgtcccttagataaactcctccgtgatccattgcctcaggaagtgcacagcattcaatccagggttgagagagttgggtctgaaagattgatagtgtgtgccattgattagaaggagatccttctgtgctagcaaagcccactttttccttgagaattgtctgactacttatttattggtataatggttgttattgtggttgtcctgcaggaaggtcactaaccagcttggcagtgataatgaccagaaggtgaaaatactgtggaaggaggccaggaatacggagaaaatgtttctatatttccttattccagtaatattgttcctgaaggagaacataagactttccatatgaacagatttttctatgcttttaaaaatcggttattcaacaagctacataattgtttaaaggctccactgccattgtacacaggagaaaggcagaaatactagtcttgggcctgctttttacatttcatcatagtttttaaacagacacattaatttctcgacaataagaggcttttttggcatcaaaatttaaagcatttccccacctgaaaaacaatggccaaaaataatgcagatattacacatgaacatttgcagagaatccagtataaagacatttgttaaaaataaagatggtaatacaagctctcctgtcctcctggctctgatgagtgaaatagtgcaaatcagcatccttttcttcattgcttaccccattcatgcttgaaatgggatttcccagacatgccaggatgtttctttttaattctgtgcactcatgtttcacttcaaattagttatttcagctatggtcagatattccttccttttctatgtcttcaggttgtttggtgaatattgttcttttttgaatcaggagttggcaacccactcatctgctctatcagtttttatctatttattctttgaagtggaaccaactattgcagaaaaccaaagacacagttttctagggaagagctagctggagctagatcttcatacatcctgtcatgtgtgaagacctggtaagatttctggctttttgttggctctgcccttctgacctcaacttcagagttgcagattccctggattctctctctagtgcccaggccaccaagcagcatgtcattccttcctctctcctacttatcctttttaaacatttagttttaaattgacaaaacttatatattttatattttactcatctttttaaaaataacacctttattgagatatgattacataccttaaagttcacccatttaaagcatacaattcaattattttaatatgtttacacaattgtgaacctgtcatcatcatctagttgtagaatatttttaaatttttttcattttaatttttgtgagtacatggtaggtgtatatatttataggatacatgagatgttttgatacaggcatgcagtgcataataatcatgtaaaatgggggtatccatcccctcaagaaatcccttgtgtttcagacaatccaattatactcttttagttactttaaaatgtactattaaattattattgactatagtcaccctattgtgctatcaattgctaggtcttattctttcaatttttttaatccattaaccatccccaccaccccccgccacagccatccccccattatccttcccagcctctggttagcatccctctactctctgtctgcatgagttcaattgttttggttttgagttcaattgttttggttcaattttgtttgattttcacaaataagaacatgtgatgtttgtctttctatatctggcttatttctttccttttttttcttttttttttttgttttgttttgttttttgaggcagtgtctcactgtcactcaggctgctggagtgcagtggtgcagtctcagctcattgcagcctcaacctcctgggctcaagcaatcctcccacctcagcctcctgagtagctgggactagagttacacaccaccacgcctagctaattttttttgtggagagggggtcgggttttagatacggggtttcaccacgttgcccagctggtctcaaacatgcctgcctcccaaggcttattttacttagcataatgacctccagttccgtccttgttgttgcaaaattttggaacatttcaatcacccccaaaagaaatttcggccttttggccagaaccaccatcttccagtaattcgccaaaatgtcgaacacaaagggaaagaggaaaggcacctgatatatgttctctaggctttttagaaaacatggagttgtttttttggccacgtgtatgcaaatctataagaaaggtgacattatagacatcaagggaatgggtactgttcaaaaaggaaggccccgcaagtattaccatggctaaactgaaagagtctacggtgttacccagcatgctgttggcattgttataaacacacaagttaagggcaagattcttgccaagaaaattaatgtacgtattgagcacattaagcactctaagagccaagatagcttcctgaaacacgtgaaggaaaatgatcagaaaaagaaggaagctggcggcacagtagctcacgcctgtaatcctaacactttgggaggccgaggcaggcggatcacctgaggtcaggagtttgagaccaacctggccaacatggtgaaatcccgtctctactaaaatacaaaaattagccggggatggtggcagccacctgtaatcccagctactcaggaggctgaggcagggagaattgttcgaatccaggaggtggaagttgcagtgagccgaggttggcccactgcactccagcctgggcgacagagcaagactctgtcttaaaaaaaaaaaaaaaaaaaagaaggaagccaaacagaaagatacctgggtccaactgaagcaccagcctgcaccacccagagaagcacactttgtgagaaccaatgggaaggagcctgagctgctggaacctgttccctatgaattcatggcataataggtgtctaaaaaatgaaagacctctggactgtttaaaaaaaaaaagaaaaaagaaaaatccttaacccattgacatagcttcttgtattaatttcttattgctgctgtaacaaattactacaacatttgtggcttaaaacaacacaaatttgttatcttacagttctgaagaacagaagtccaaaatgggccccgctgggctaaaaccaaagtatcagggcctgtgttcttgccagaggcaccaggggaaaatccacttcttgcctttgccagcctctaagggctgcctgcattctttggctcatggcccccttccatcttcaaagccagcaatggctggtcaagtcttaggatgttctctttctgatctgacttctgcctcttccctatataaggactcttgtgagtacaatgtgctcacctggataattcaagataccctctttattttgaggtcgcttgattagcaaccttaattccccctggccacataacattcacaggttccacagatgaggacatggacatctttggggggcctgtcatgctgcctgtcctactccctattcttcctgctccccagccctaggcaaccgctaatctactttctgtctctagagatctactcactttttttattcctctgcatattctgtttcttcctcgagtttcatgttcagctttttcctctccctccttgctcttactggtctctgtgacctccatctttttcctcatttctcaggaaatgattgacttctgaagacagaaaatggagaaatgctagggaaaacaagagaggcaaagttttatagaaccaaatgctgagacagaagaggggtacagttgtgcaagtgatgagctgcagattgcctggaaaccaaatcagctggctcatgtagtaaaaacagccctttctgtatattcgatcgcttggttttgggatgacccacttggtccttgagggcctcagttacctcaaactggcaaaggaaagaggttggaccagatctgtgggtctcaagtggtggttcctggaccagcagcagcagcatctcctgggaccatgttataaatatgaatctgccagccccaccctagacctactgagtcagaaactcggcatgacccccactccatacccccccaccaaaatgtgttttaacaagcccctcagatggttctgatgttttgctgaaatttgagaaccactggactagattatgatgtctgagttctcaccaagtgtaatagtctatgagtaaattcctatgcatgtaaaaagaaaagttttagcaggaagaagacaaaatgctgaaagagaatatggtagtttcaaagtttgagatttttagatgcatgttagaagtgtttctattttgttgaaatttcccgtcattcagtagttcactttacttcaagttgtgaccttccagatccgaaccttagagtttctgtatgtgatttcaaagaatcttagaatatatattgcatgacaggaaatggaggtctgctattttccactgagacttgctgtgtgtgttccacacccacaggtctacaacactggcccaagcacccttccagggtcatctgtcagcatctctttccctaatcgactctcatctggtggtgcagagatgtttcatgtccaggaaatggtggtgagttctccatttgttttcactattgctttcagctttgagccagcccattcaaattttgtattccaccctaccctgacatccaccttgagggtttggaaaattcaactcattctaccctttggagacatatctggagaggccaggggacctgtgatacctgaatttctacattgagaccatttggttaatgctgtaagaagacctctttggagatggggaagagttaattacgaaccagctcctgggatggacttcgctggctctgggaacccccagcagcatctgcagttgcatgcgtctgaatgcattttgctgagtgcattttgcacagggaaagtgcctgcagtccatgttgagaggattgtgaaagcattgctctctataggggcacgtgaaggacattcagccaaagggacagtttttccatagatagcttgaaaatcagggcagcaaggcccatatggagcaggtgaatatctgagccgagagttgaagaggacacagcccacagggtggaggttcagaaaacattgtgtgatggtgacagtaatttctggcattgctgccctctgggtcatgtggactgaaaaccagacgcatgtgaatgttgaatgtagaacaggtcactcctcccgagatgccagctcagatgttaacatccctcatgatgttccattccagttccatggcatccccttgtctttgggctctgctgacccagcagaagaaagccgccagtgttccgcacctatgatgtactatggttggaacttagcatgaggtgaacaaaccacacaggcttctggctaccctcttaaatattattaaccatgctgaccatgccacatttccccagcatctaggagtgttctcttcctagagcatgctttctgagttgttcacgtgaacatctacagtgttgcaggagcctttttttttcctatgggcaaaatcatctattgaccaaaacaagacatttaagtcactcagattctgaaggtaccccaaaaccagggataccccttttcctctttactgatcatcgagccaaggaaaagccactggaagggacttgggctcacacttacaaatagctggcttgcatggaaggcattagaagtggtttcctgaagacctggacaactgcctggctatcgttctggctgagtggaccctcagatacccaagtggtgtgagctggctgcactctgttctttgggctctgagaaacaaatcctttggattttcaaaactatatttagaattttcataaagtctgtaacagacttggccctaggatggccaagtctccatctggatagcccagcctgtgatcaaaggctgtgggcatcttcatcgtatggaaaagtaaattcactggcacatctcactaagcaagtaggaaagctctctgtgttcttataaacgatcaccactgagcccagaatgacaacaagagtagaagcataaaagcgagtgcatgaggtgctgtagtgaagaggcgagagtccccagatacttgtttcagaggcccacagctggcacaccctctgccttaaagccctcggcaagggcctcctgtggctccgcccctcccttgctcagtagggcctgagaatgctcactgggtcaggtgtgattcagagctcatgacggtttccactttggccttatgggactttgaatggagcagggctttcattctggggatttgggtggcttggtgcaagtgaaattcagtcctattaggagaaaccagcactcattctctgtactgcactaggaggtgaccctttggcctggtggcattccctccccacccccactctcagccaccaccattccccaacctccaaaggctactgaacagctgggcaccagctggacatgttaagccaactgaagcagaaacagattataggcatggagggaaggctcatctgtcattcctctccacacccttgggaccctcaaattgtttctccctctctaacagtgcccttggtgtctgtattgcctgtgatcatcatccatagagcataatgaggatgggcttactcgccctatgggccctgggctgtcaccctacctacggacccacgtgtggcacagttttctgacttggttcagaattcatttagaagtctctggggctgcttctggggtccctgggcaggaccaacctgcctctagctttcaccaaagagtcttttgtgtttgcccaaagcatttcttgaggtccagctgtctgtaagtggagagtgtctggcttatatatgggaggtttttacggggagcctaatgaagtgtaaccactccaaactcccagccttggctcgtgatcttctttccttgtagctaatgtctctgagcccctctgctgtgcttgtatttaccttaaaaacagagccacggtggtggcctgaggaaagactatcaattttcactgcttcccacccacgggggttgtgtggaccctactctgacttcccacagcacagaaaaaaaaggaaacaggtcactgtggacctagtgtctgtccatcaggaagccaggttgtaatgatcatgaaaataatagaggggaagaatgacagacctttctagtctatctgaaatagcaaaattactagtaacaaatcattcttgatttgttcacaaacactggctcagcaagtacctattacgtgccaggctccaaggagaggaataagtcccacatctgccccagaactcactgtcttgcaggaaacagatacataaaatgccattgtaataccgtataacaaatgcaataatggaggcatgcccagaccccaggatgctacaaaggttcagtgcttcacaaaggaacctcttcaagtcagggcttagaggatgtctagttcaccaagagaacaggtgaagaagagaacattccagatagaggaacagtcaccacttgtgagtgtatgatgagtatctgctgtgctgggagctacacccggttctccattctgtttgcctagctcttatacaaataggcaagagtaagtgttccgtatgccttctgcagatgtacagcagatagatattttggcagaatgacagagagtactgaaccacagtcatttcctctgtcagtttgtaaattaatcactcttcttgggtacatcgtgtgtgtgctgtagacctgaaccttcctacctgctgacttaggcatggagaaggccaagctccctgtttgatactagagtctaactacatgtcatggacattgtcagcaaaccacccttggcctgctgcaatgagcagtagctactgacctccctagcttacttttttccttctattggacagtcattctaaaaaactcacctgatttccaggaataaaatgagtgagccagacagcttatgggaggcaggctgtgtccacttgctccttagagatttctttttgaagtgaagatagatcatcttctcaatttttcagaacagacctgaaaaattgaaccacttcactttattgccattcttctgcagaggcgagccgtgtagcatagcccctgagcacaggtctaagattgcaccaagataacacatctgtcacaagcttcatggcttatgaagggaagagggtagtggtctttccaaagttaagttttactcacaatttctgaaggttcaatggaagagatgggagctttatctcagactgcaagcttcacttgatggagttaaaaacctgtatctgtgagcagctttctcacactggaggagaaggctttgggatttggctcttgttaatatgcaagaaggggaaaagtcagaaatgatagctaacagggagtgaagggctagaacttttattccaggtgaaagtactggatttttgaaagaactctagtgttagtccagaagagatataaaataaatatcataccattcattcctcctcctgcaaaaccaattgaaaatattggcctctctggcttgttgttttcttgctatggggcagtgattctaaagaactgacctgatttccaggaggtaaaattgtagggatgaatgataattttctaaggagatatatcaatgtctttgccatagggtaccattaggacattgacttcaatatggcatgaataccaacatctgttagaatattccaagttggtgccaggactcatattttagtaaactgtaaaatcttccctccccatgcttgtacagtagacaggcctacccatgatgtacgatgggtatcccacaatgagtcagttgatgtgggaacttcaattaatttatagtgggactgctcacatccctatgaagaaaatatgcacctgatacatcactgaccataacaggagcttaaaattagacataaatggaggaatgaattgttttccccaaggatgacctggaggagcttcttaagttggggccatcaaatcagtcgatataatccaaagctaaagagtaaagaaattactcctgaataactgacccccccaaaaaaatgaataccatttattgctgtcccaaggctttagtagcctttttcatgtgctgtcaaatttaatccttatggcaccttcataaggtaagatcagcatcccaagttgaggaaccaagcttcaaggatttgcccaacctgacacagctgctaaaaagtagagctgggtttgtaaccaggtctgactccaaagttcacgtggttcccattgtgctgaattgcacactgctcctgaaagtgctgcccactccctaatcaccagaggcaggctcagtcaataggacagacagatgaggagtagacccccaagaatcacccaccagaggaggagcatcaacaccagggcagagaggcagcaaccgcaatcaaaagaactaataccagagggtgcagtaacaaggccaacagaaggcttctgaataagcaagactgatgtcttcagagcaatgcaaaaagacagtgtttccatgaaacagaataaactagagatttgtaaattcaagatattgatcattcaaatgaaacttcaatataagccatagagtagaataaatattaaagaataaagtaggggattcgaaacttggattttctgagaatgtattgcagaagaacaaaaaagccagttaaacttattcctttttttaaatagcaatctggaatgaaaatatcagatgatcataatataagagttagaagtcaagagagatggaaatgaaagcaagtcaagattcttgtcttggggggacaagtttatgtaccaattagctcaaggctttggtaaaataaatgtttaaatatgtaaaattttaagggcaacaaaaaacaatgtaggacatccaaaccactaaagaagaagaatttaaaacataattaaattcaaaacaatccaaaaggaaagaatttatgaagaaaaaaataaatgtataataagatggaagtaataaacctaaatatttcaataatcaaaataataattaatggattaaatgccctaaagacactctcagattagaattttaaaaatccaagtaccaaataacttgtaagaaatacaccttcaaagttacccagaatgtaaggcattcaaaaaaaaaaggcaaatattaacccaaagaaataaagtatagcaatattaacagcaaatgaagtataattaaagcccaaaacccacaaacattaaacagagcaaaagaaaatatatttcagagtgttaaagatttagtccactaagaatttgtaacataaatgaaattttatataaccaacaacacagctttaaccatagaaacacaaaaagaaattgacacattcacagtcattgcaagaaaatttattgctttcccctcaaaaatcatcacacaagtaggagtaaaataatgagtatttgaataatgcaactagagttgcgatcatttatatagagaccaagacagaatgagtcagaatgtctgattttcattactgctcccttgtttaccagctatggcaacctataggaagttaccttaactccccaatcttattttcctcatctgtaaaatgaactagtagtagtacctatctcacactgtaaggactgaagaaactaatttatatggagtaattaacagagatcctaacataaataagggaatgcacattcttttcaaatgtgaacatttacaaattattcaacatacaacaacacaaaaataagcatcaatggaatttttaaagtcaaagcagtagaagccacagtctctgaccacaatgcaataaacttggaagctaaaaacaaaaggttaggcaaacaaccaaccaaaaacaaatccacttgggaaattttaaacaccattcaaattaactttttagaaaaaaaagaaatcaaagttgaagggatgaacaaattagaagtgaaagacagtgagcggttgttcatatcaaaaccaatgggatttagacaaaaccaacacagaggaaaatgccactacttacatgtggaaaatagggaagactgaaaataagtgaactaaattgacaacataaaaactagacaagggacaatgaaataaacccaactcaaagaaagtaaaatgaaggtattattaaagacaaagcatatcctgaaatagaaaaaataataacaacaaaagtattccacattagcaaaatcaaaagctgtttttttgtccaaaaaaatagacaaacctgcagcaagcttcaacaagaaataaagaagagcgatgatgccaaaaaacaacactagaaatactttttaaagaagtaccatacttatatgaagatttaaaatttataacatcttttgagctgggcatggttggctcatgcctgtaatcccaggactttaggaggctaaggcaagaagatccttgagcctaggagttcaagaccagcccagacaaggaagtaagaccttgtctccacaaaaaataaaaaacaaattagccaggcatgtggcataaactacttgggaggctgaggtgggaggatcccttgagtccagaaggtcaaggctgcagtgagccatgttcacaccactgtactcaagccaggatgacagatcctgtctcaaaaaaacaaaaacaaaacaaaaaaatcttttcaattttattcacacaaagataaaatctgaataaaatatgcatgaggttaaaaaaaaagtccaactagactatcttagaaaaaaatgtaaaagtagacaaagacctatatcttaaaaaaaatcaccgacccagatagctatataggcagattctagtaggctttcaaggaatggataattcttatgttaatataagctgttccagagagtagaaaaagataaagaaactcattccagaaaactaacatagccctggtacagaaaccagaaatggagagcgggcacactcacgcaaaaataggaagcagtgagccaaactcactttgaaaacagatacaaaagttctaaataaattgcaaattgagggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagatactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaaaaaattgcaaattgattcctattagaagaataatatagtctgggtaaaacaggatgtaatccaggaatgctaagttggttctccatgaggaaactgattaatataactcattatatattattattaataataaaaggattaaatgaaaaataaccaaatgataatcttgataagggtttctaaaaagttaaaaattaaattcaacatttatttatgatattttattacatttccagtaaggaaagcatagaagacttcctcaacttgacaaagaccctttgccagaaacctataggaaacttcaagctaagtgaggaacaggcatgagtccctgctagtgtctcttcagtttagttgtgttggaggccttaacaataaaaagaaatgatagcctttattcttaaaaaaaaaagtatcctattgtaaaaattgttattgtctccctaaaaaaatccaagagaatcaactgattggccctgaggacttgtgaatacagaaggtaagagctgaagctgactgtaaactgcctgatcttcaaatgctttccccagagacacacacagacccaccaactgagggtgaaaaccttcctagatcaagatgtttacatacagcctctgaccagtcactggctgatcactaagctgtgctgatccaggacagcccctacaaaaccaggcttaaaaataaaaacaagtgataaatatatatatacatatatatatacccacacacacacacacacacacacatatacccacatacatatatatgcatacatgcaatatatattttgccagcagaaacatcagaggctgcacactccaggaaaaacagactccagagactatgtctaggcaagtcactaaacaaacaaaacaaaaaaaaagtaacaactacccctcaatgggaggggtaagaatccagaattgctacaatatattatctaaaatgtccaatttaaatacacacagacactgtatatatcatatatatttctcatgtgctatacaggaagaaaaaaacagttaataaaaactgaggaacccagatgttggatttaacaaagacttcaaagcagctattacaaatgtttaaagaactaaaatcagtttaaataaagtatgacagcaatgattcatcaaataaagaatatcagtaataatattgatgaataaattaaaataagtggaaattaaataaatgaataataaaatagatggaaattataagaaccaaggggaaattctggaattgaaagtaaaacatgggctgagcatggtggctcatgcctgtaatcccagcactttgggaggctgagttgggcatatcacctgaggtcaggagttggagaccagccaggccaacatggtgaaaccctgtctgtactaaaaatacacaaaaattagccaggtgtcgtgggcaggtgcctgtaatcccagctactcgggaggctgaggcaggagaatcgcttgaacccgggaagcagagattgcagtaagccgagatgtgccactgcactccagcctgaatgacagagcaagactccatctcaaaaaaaaaacaacaaataaataaaagaaagttaaacacctgactgggcacggtggctcatgcctgtaatcccagcactttgggaggctgaggcgggtgtgaggttaggagttcaagaccagcctggccaacatggtgaaaccccatctctaccaaaaatacaaaaaattagctgggagtggtggcagatgcctgtaatcccagctactcaggaggccgaggcaggagagtcgtctgtaatctcagctactcaggaggctgaggcaggagaattgcttgaacccaggaggcggaggttgcggtgagccgagatcacaccactgcacttcagcctgggcaaaagagtgagactctgtctcaatttaattaaaaaaaaaaaaagcaaaacacctgaaatgaacaattcattagaggggctcaatagcatatttgagctgacacagaatcagtgaacttgaagctggattacagtacagattttccaatctgaagaacagaaggaaaaaagaataaaacacaagcaaaatggttgaagccccagaggcctttggtgtgctttgtgggacaccacaaagtttatcaagatatacacaattggagttgcagagaaagacgatagagaaaagagggcagaaaaaaaaatttgatgaaatatcgttccaaaacagtggcagtgtataaactcttcaataaatgatatgaagacaattggctatccatttgggaagacattagagaaagcctgtacctcacagaaaaaaacaaacaaacaaaaaacaggtgaattaaagttagatgttaaaaaaaatatttgcagaactgaatattttcataatctttagatgggaagctcttcttcctaagcaagccataaaatcctgaaaccataaagaaaaaattaacaaatttaaacctataaaaatgttaaacttttatgtgatcaaaatacatcataagggaaaagatatttgggagaacatatttgcaacatgggtaacaaatagataatatataaattacttctacaaaataatgcagaaaagaccaaaaattataaaaatggttgaagttatatgaacaggaaattcacaaaagaagaaattttaggggctgggtgtggtggctcatgcctgtcatcccagcactttgggaggctgaagcaggaggatcacttgaggccaggagttcaaaaagaaattttaatagcaaataaacatatagaaagatgcctagcctcactggtaatcagagcaatgcaaacttaaaatgaggtttttctcctcattaaactggcaaaaatctaaaaaattgttaagatccattgttggttaagatgaagagaaatgagcactttcaaatactgctggtatgaaaggcaatttgacaataactaccaaaatttaaaatatgaatatcaacaattccacttttaggaacctgtctcaaaattttcacataatatatccaggagaaacttctaattttctgatagtaggtgtatattatcagggttctcagcataaatgttgacttctattttggtgaagcagaatataactttaataatgctcccttaggattctgagagaaagttgttagattcagaccaaaaagtatgaaatcttactaacttattacagataggtatagtgcagagatactgtatcaagtactttacaagaacaaattaatctaatcttcataataatttcttaaggaaattgaggcaaggaagagttagagggaaggccaaggtaaattggtaagtggctaagttgacgttcactcttaacagtggggttcactgtgaaataggagttcagcaggacttgtttctcaagacgcaggtcacagagaccccgctgataaagcaggatgtggtaaagaagccagctgaagacagccagaatcaagatggtgacactaatgataattcaccagcaccatgacaatttacagatgccatggcaactcctagaagttactctgtatgctctaaaaacagaaggaaccctgggttctgagaattcgcagcccctctcctgtaaaactcatgaataatccactccttttttagcatttaatcaagaaataaccattaaaataggcaagcagcagcccttggggctgtgttacctatggggtaaccaccttttatttctttactttcttaataaacttgctttcactttactctctgggcttcctcttgaattctttcctttaggaagccaaaacccaccggccctcccaggccaaaccccaatttgggggttcatcctgccacaactgtacagtgtggggtcaaggggaacccttggtctttttcactgaaaaatcaactcagaaaaggcagattaataggagaaaaggcacacagatttatttaacttgtatacaggggaggcttcagaatgaagacccaatcccctggtaaggtacagaagcttatataccatcttgaggttatagaaagaatgcaggctcagagcatgaccacaaccaggttttaatggcaagacatgtcatgggggagagaaagaaggaggcttggctagcaaaggtggcattgttatgtagatgaagccttccaggtcataactcctagagagaatagatggtgaatttcttttcagacttgtaaaggtgtcagactcaatctgtcctagatctgggaaaggcctggaaagagaagggctggctgcattcaaggagattctctacaggtgcaaaatttccccacaagagacagttttgcaaggccacttctgtctgctggcccagcagcagccatttcaaacgatgtcaaagaaatctattttgggataaaacattttgatttcctttagccacttgcagggtcttgcgccatccttttgtctgggtgcgtagctgtccagcagctctagcactacctggaagttgaggcatggtcatgcagaactaaggccccacccaggcctgctgagtcagagccttcacttcagcaagatccccagggattcctttgtctgttcatatttaagaagccctggtctaaagcatgagacttaaatctctgctctcccattttcttatctgtaaaatggtgatgacagtcctcaccacaagaggctgttgtggggatatttttatacacatgttcattctttcaacaaatactttgcgcccagcatatgctaagcacctagtgcagagaggaaaacagacaaaaagtaatttccagccatcatgtagcttacattctggtggggaaagagtaataagtaaagcatatagtttattacatgatggtaaatgctctggagaaaaatttaaaaagcaagaggatagggattgggaaaggctgtaattttaaacggagtggtcagggacagtttcacggagacctttattcagaagttgcagggaccaaagctatcttacgggagtttgcaatgagaatttctttgcccatggagtccttgccaagtctatgtcttttctgagaattctctcccccttgatttcagccctgtttgatttctgacctttgaaatgccagcccccatgctgccgttgtgtggggttccgactggacatccagaagtctccgtgtgtgttctcattagctttcactctgggggagttttctgccacaatgtgaatcacttattttgctggcagcagcagttgacagtgacactgatttttaaagcctgcacatttcacatcagaaaagtcctggattttatgacttagctatgcttagaggataattgcaacaagaagtctcccctgcagccagcttattggagctgagacttgtataagagccagacctggcactttaaacagcccagcaaataacccaaaacaaaaatgaacaatgcacatttttatctatgctgctcttccccatcatgaacacatgcttctttttttcctcgccttcaccctcaattttttttgtggaaattcaatggttgactgtaccaagccagctctctgggtgagaggttccttctaacaaggattagaaacccctctcatgtaggaagaggtggatttgggggattatatgatccaaccctctacctttggacagaatacaatcgagatgtctccccagtacacagaactgcttttccagcaagttctctttgttaagccattctggtatccctcaaatcccttgttatgactatccacaattctccatgccccatgaccctttcttagctaaaatgaaaaataattgcctagttccctcatgtagagaagttgagctattaccttgacttcccccttctcttccaaaaaagattacaattcctttaattttctttcccatcctagggtgtcctctttgctctctccatattctccaaataaaaattcaaaactgagcagcaaatcctgtgcctcttcatccaacccctcctcatcatgaatcattatcactcaggaagtaaggacctggtttactatctgagaactttagtcctaataatttctctacaccaacttctagtcctaataatttatccgtataatgctcagaaacactccgagattctcagtaaaaaaaaaaaaaaaaaaaaaaaaatcaaggaaatcttaatggccaaagccataggtccaaaacccggcgttccctcccacccaactttccaggccattttctccaatagcccctcatccctgaccttgtcttccagcctccctggaccatgaatgctgctgaaggctctcactttgtacttccctgggccccctgcccttgctagtgacttctcctcccctctggctgtggaaagctactcattcttcaagacccagttcatatgtcctctctgtcaaggcttcccagatgccttcacagatggccctgcctcagggcctttgcacctgcctttgctgagaacactgttccctccaatctttgcatagctggctccttcttattatgcagatctgagcccagagttcactttctcaataagtcttccctgaacactttacctaaagttgcaaacccccattactctctatctcatttgtatgttgttttcttcatagcacttgtcactatgtgaaattactctcttatcatcagtcttcttccaccagattaaaaacaccatgagagtaaagggcaaggtccttattttctgtgtatttgcagcatttggtgccgagaccatagtgagtggtgagacaaatgaaagaaatggctgcttccactctgttagtggcatcctcagacacacagtcaccccttgtatctcctggggattggctccaggacatccccccatctctacttgagatcgcccagtaggaatattttgaacaaattcctttaacccatggcagaggttgccttaatttcaatgtgagaataagaaggtgaaattttgaaataagagattgaattacttatcagaaacgaaagcttcttagagcaaatttaaactctacaaactttggtcagggatttgaacacatatttccttccccctcagtttctctcacacagacactgctgatctcagtaatggccctaaactttcttttctttttcttttgcattttcttctttctgcacatgtatgaatgcaagctgaatagtcaagttcctgaaatgggtcaggattaggtttgccttaaatctttttctcaacagaagccaaacacttaaaagaagggagatggctgattgaattctggaacaaaagttacattcctaggctcttggttaatttgagcttggctagagggagaaagcgtgtgtgtttctgtgcacaagttacactcaacacacaccctctggaaggtgggggtaagcttcagtcccggctgtccgtacagagtgtggttcagaggctgccctttaacctgtgtggccagagagaataaatcaagccagcagtgctgtctccctgctgactgaaggcgcccggccttatcaaggagcccaaatgtcttgtgctcacagctgctgtgacatctggaagcattaacactttgttgccagcatgtaggctagttgaatgccgatgcgtaggtgcctggtgttttctggtctgctacatgaataggcgtcaaaagttggtggtgaggagtttgcttacgttcattccttaaaagcaacatgacacagagccttgccatggcaggggtgatgggttgttaccaaagtcgataacaggaaatctcactgaggataaacagggctcatcggccattgccgagaaacacatggttctcatttaacctgccaaggactaattgtgtatgcttcggaagcgcaaaaacaggaaaacgcttttctgacatacaccccaagtttcttcagaccaaaaagaactgcctcaatgttgttagacgctgagaagtaatgatctccccagctgtcagggagccaacctcacttacttctctttaatctaaacttatgacctaaagcatatttcaggcctcccatgaagtccttgaaacttgagacttaatgaaggacactgaggtttcacttttcactgctctggtgtatgtactctcagaaaagcagtggaagaggttagatagatggtgatgtaggaatcatggcatccagaaaatgagtgtgatttaccctttgataaaagggaactaataaagcaatatatgcaggaaatgcagagacaacccagtgaataggtgtgctgctttagcctttaagggaagatgggtctgagcttcattctttaccttaagatgggtccaagagctagaaccagaatttaaacaagcagatacaattccaaggaccatgttttgtctcatatgggggctattcactcatttattacccaaatcaacagaccattctgcttccaaaatatttcattatctgtggaaggaaaacatttttggtatgcatgtcaagtgctcagataacatatttatgtatcgctttttcactaaagagaatctgacggcatctggaaattcttttgtgtcactgcctctctcagactacttcccatctgtatcgctttaactccaataaaaggccatccccatgcctgggaaatgggctttgtctggggaacttgtctttctctgattacatgtaaattaattaaagcccatcccgttttacagggcagcctggtggtggtggcctgcactcttgactttccagcatgttggcctgtcacacgcaaaggaagagggaggaggggaggatgcaggggcattgttttagccaaaccctaaagctgatggaaatgaaatccactggcttttatcatgagaagtgaaattgttcatgaaataatggcagcctcatacagaggctgtgcattggattatactcaacctttcctctgaaacgttggtctggaggctttgcccctttattttcagtttcagatttgatctcagtaacaccctgaccttttcagactccataccacttttcacagggatgactgccttaagggatggggaaagggttagagaaagcaagtattttatttagaagacagttttcagttagaaagggagaagacatctagagttaaagttacgatcttttcctttctgtgcttaagtgatactaggtcattctttaacttcttgctccacctgctctatccccagctctgcaggtttggagtgggctgtcatgtgattttgtttacccgtttcggttcaaagacagaactctttatttgaacactgaagctagcagggactgtccaaagccagagcccctcatattagcctagcttatgttgttgtgatcatcagactgtttctgttttttggatttttgtccttaaataaacaccttggaaccactagctacacagaggggtaaatatcagaaaatccaaatttggtgcactaatgaacacggggtctcttttcacaaagcaaaagaccatcattcttcagaaggatctcccaaagaatgccattgaaaactcctcattaccttcaaatggggtgatgcacacacgagtagcatgaaattagccatgttcatattaaggagcaatctaagatcattattgctgtttctctggccttatattaaatagtgtcattgcaattgaaaaattagagtaaatgaacagagcctgtgagcatccaccctttgtaggttatcctgagtctgcattattacagggtcttgaaatgaatggtgatacgtgaaagtatttgtcctaggattcattaatattattatattttagtctttggtcaatatgaagaaatactcaatagtaaatcatagcaacatgatttaacatgagatataatttgaagggctctttaaggctgctaagcaaccatgaatcatggtttgcatttttctagatggataatatgaagctatcttatttatctttctagaactagacaccttaggtcaggctaatcaaccagctggtatcatttctcagttattgtatgactactatctttatttcaaaccctgaagtcctaaaattaatgtcaccacagccattgtagtatgtgttcagccgcctgtgccggaataggggcttactgtcttttgatgccttggttctcagagtaggcaatgggtaattgaattagcaaagtagacattcaaaacattctctgagttttcaaactcaaggagcgtgtgacttcagagaagcaggcgataagtcagggggtgggtcatgtttacccggttgccgtcagctgcgattggtgtaatatgatatggaaaagtggcccagggatgtaactgagaacataaagtcaatgaataacacagaaacgtgagttaacaggaaacacatgttattctaaaatgaacctaggtcccttttaacccaagccaattcaacaaacatagcttttagatcataccttttaggtttttttttttttacccaaaaaccacactggggatgactccagccgtggctcatggggaacactactgtcattcagtttgttcctctgctaatttaatcttccattttcctttgattggtgatgcacgcattcaaggggcatcaagccatggacactttggtgaccctccctatccttggaaccccagccagctgatggggttcgtactggtaaaatggcaaactggtagaggcatctatgcttctgcctgttaaaaatatactaataggccaggcgtggtggctcacacctgtaatcccagcattttgggaggccgaggtggacggatcatctgaggtcaggagtttgagaccagcctgaccaacatggtgaaaccccatctctactaaaaatacaaaattagccaggcatggtggcacacacccatcatcccagctactcgggaggctgaggcaggagaatcgcttgaacccggaaggcagaggttgtggtgagctgagattgcaccattgcactccagcctgggcaataagagcaaaactctgtctcaaaaaaaaaaaaaaaaaagctaaaaatatcacataccaaagctgcaaattatttctttaattttgagcgacgttaatccacatgatctaaatcatacattctcacacattctcctacttcaaagctttccctggttcctattaccttctgggtaactacctccacccacgccatgtgtaagacttgtcacatgccctcctctgtgtccaggcccatctcccctgcctcagttctggccactgctacccagcattcatccagtgcttgacctgtgttgaactccttggctctctagactccagtctcaagtttgcccctctatgcttttgcacatgctgttctcttcctggaattcctttctccctcctccctttactcctgagaagttttctttatcctttgcgatctacctgcaatgccacttcctctgggtcagatatgagaggggctgacttcctggtggagggagaaatttgtagacaagatttataatctcattaggagctgtgctctgaggggctgcgaatggataaacagtgaggtggtggtcaggtggtgtttgggcttcagtatgtggaatagctactatgcagcctggtgcaaggaagatggagtgggacagagcatcctggtggggattttcgagatgtgcttctcagacatgacaggttacttaacctctctgggcctcagttttctcatctgtaaaaaggggtggaatttaaggagagcagaagttaaagcttatctgtcacatccctgataaatgtctctgtgctgctgttctagctggttgaacctcaaaaatgtcccagtttagacaataaattatatggtcacccttctgagagcagtaccctccacacatgggtgccgtaaggattcagcatatgccgttctctaacatactaatagcacctaatattgtattatttccattgatatctgaactcagtatagagatgggaccataagcgatttcccaggatgatgtgcttggagcatgacacttagaaaaaagatcagaggacttttctgcctcttcagtgttcaaacccaggcacagggactgtgtttggctgctctgtttggggccctgtgggaggaaacctgtgtcctctctcttgctctgagtcaacagacaactcttagaagtgcctgactgagcctacaacatggaaatgccatttcctccaagccgtttatctgaccacctcagcctggaaagtaacagctcttgacttcccttctccacctgggatcagatgacgacaacatttgaaacaaagggtctgctctctttctcagtatcacacctatggaatcagccctgattcacacttcaaacccactacttcatgaagcaaggtcttgccagatcccctagagtgaacaggggattctttatcctctcacaggcctggcaccgtggtggcttctgaccatgacagctcctttcactgaggctgacccagactctgccaccaagtgatggccactccttgggctcccacagccagggttcctgacagcttccccagtcaccaccatttcatggtttcagtttgcacaatgtcctctttggggtaaaggggaggacagatgccaacagaaaaccctcagtacctgccttggtagaatacagccttgtcactgtgtcctgcatcctcctttccttgtttgggtgcctggtgaagtccttttgttcaaattctaatagccatggacctctgccagctcccagaggccctgagagataagcagccatgtcatgagaagcatttggactccggtagcctgggaaataaatgaggactgactgggcagagaagagcaagggggcgatggccacagagtccttagccagccaaggaaatgacattgttggtcattggccggggatgcttgggttgtctgcaacacatgaaaaaagcatcatgtccccttgactttgagcaaagagtgcggttaaaaccaagttgtgggaggatggatagtcagtaattgtttatctgtgtgatgagataaggtagtcccctgctgtaatgaaaatgcacagacagttcatgaagtgaggaattagcaactaaggacaacctgagtgactacatgggccaacatcctcatgtgtagatgaggaaactgaggccctggagacccaaactggcacggctgttagcaggcagagctagggctgaagccaggactattgagtattcatcaagagcgtctgtaccacagaacttcactggggcccggacatgaccttggacaagtcgctgaactcggggacctctgtttccttatctgtcagctgaggccacaaggactgcatgatctcgcagctgccttccagaaacaacattccagaatgctctgttccccccttccagcccaagagactgtgcagaataggcctcttctcagtcagcaggcacttttgtctcccatggtctaggcaggagtcatttttttttgctacagtggtggaaatgggtcaggctggagaatgctgaggtttccaggctagtggtttcttcctctgaccacagtaagaggaaaggaagctttccctccacctctactcctctgtgactcctgccccagccccatcctcagcttccacctaagaggtagtgcaggaaagtggtgataagcagatgtctgcagctgtgtgacgtgtgtcccagcccagttctgtggcctgctacctggggagcctctggttgtaattgggcctcctgttgcctctcagcttgcctccatctgtaaaatggggacagtaggccaggggctgtggctcacacctgtaatctcaacactttgggaggccaaggcaggtggatctcctgaggtcaggagttcaagaccagcctgaccaatatggtgaaaccccatctctactaaaaatccaaaaagcttagccaggcatggtggcgtgtgcctgtaattccagctactggggagggtgaggcaggagaattacttgaacccaggaggcagaggtttcagtgagccaagatcgcaccactgcactacagcctgggtaacagagcaagactccatctcaaaaaaaaaacaaaaatgtggggacagtaatagcacctgcttcagggaactgctgtgaggactgaatgttaatgtgtggaaagcaccgagagcctggcgtgcagtaagggccatgcaagtgttaggtgccgttgtcatggctgtcacattggtacctgttcaacacacttagaggaccgcctccctccaccttgatgacccttggtaggtactgagttcctgagttttagctgaggactgaaggtgtgactgcaataggattagctggtctgaatcagacttatgtagcaccaggcaaccttcaatctccttttgaaaggggaccaccctgaacctttcagaaaaacgttgctttccccgattgaagtgattcccatgtaaccacagtcgggagcacaactggccaagattttcattcaccgcagactcagtcctcatttcccctttccagatcccaccaggggcagatgaggtgtcacattgcatcacatcacgccatcgccattaccctgttcacaggccaccccagaaactcccggcgggagacagaaactaacttctgagctgtgactctgccccttggggttgacactgaggcttaggctgtttctcactcgcttgccctgcctttcccagctccctgcccctctccgctggcgtcttgtggccagatgacagtgctagctcttcacacctgaagcacattagcaacactggctgggctggagctctgctcccaagcttcctctccctgcctagaaacctgaagcaccgatgtgcagagcaaggaggaactctgctcccacgcctgattttaatgagggatggatgcatcctgcagggctcagaggttctgtttctctaaacccagaccaaatgtgtttgggtggccaggcctcgtaatctcagcagaggaatgtgcatgccacagggctgcagaaaacagtttccagcggtctgtcagcagatgtccactccagaagacagacagggaatttggagacctacaggctttggagtgaaaaagtgatggatattaagagcacaactacacacattcggattctcaaacgcccaataaacataaatattttccatccacaatgtactatatatgcctaaatatagggcaagccccaaatagcacatcctccatttccctaattagataaatttaactctctttttttttttgccaacttaataggaatcagaactatgattgcctttgaggtggggggagtgggcagtgggaattgactggcaagggactggtgggaactttctggagtgagagacaagttctgtactttcatgggggtggtagttactgggtgacataattcatcaaactgcaccctttagatctgtggattttaatgcctgtaaatttacctcaataaaaagaagtttggagaaatgaagaaataatcaactatctgtgtataatgtttaacttaatcatgtggttgaatgcttaaaattttataagaatgatatattaatctataatactcttcattcttatgtttcacacaataattttatccaagtgtgcatcttctgagattgatgggtttcatttctaagccacatttttagtcagcagtttaccagaatatatcatctacaatttgcctaatttagttgaaatgcagaacttcttgaatccatgttggtgctgaaatttgattggcacacaccaacgcccacttgcgtagcactgcagcagttgttttcctcatttgtcttgcaagtgaatattcatgctgctccccacatcaacagcttacgtattgctttctaaaatgggctttcaaatatttattgcaactttcaacaattgaacccaaggaataattaccaaatcttcattaaagctcattgcctccttcccattgtttccctctcgtgacctctaaaatcgtccagacctgatgttgattgagatcatttcaggctagtgtgttttccccaaatgttgtcgttcaaataaagtaattgaggctgggtgcagtggctcatgcctataatcccagtgctttggaaggccaagacaggcagattgcttgagctaaggagttcgagaccagcctgggtaatgtggcaaaactctatctctaccaaaaaaaaaaaaaagaaaccagcaaaaaacaaaacaaaacaaaaactagccatgtgtggtggcatgtgcctatagtcccagctactcaggaggctgaggaaggaggatcacctgagcccaggaggttgaagctgcagtgagctggactactgtacttcagcctgggagacagagaccctgtctccaaaaaaaaaacaaaaaacaaaaaacaaaatttccaaattattagacacttaaattttaaaggacagtaagtcccaaactgtgagaaacttttataggcaacatcctcttttctaatagtttaacttgaggatataaaccttcaccttatttattttcagacatatatagtaaatcctggaatgtattcagatcaaagataaaatagagataaatttagcaaattttggtggtcttgttttataattcactattaatagattagcattgttagctttagtttatttgtgtagcaaaaactgaccaatagaatctaattaaactgaagagcttctacacagcaaaagagactatcaacagagtaaacagacaacctacagaatggaagaaaatatttgcaaactatgcatctgacgaaggtctgatctctgtcatctataagggacttaaatttgcaagaataaaacaactccattaaaaggagggcaaaggacatgaacagacacttttctaaagaagacatacctgcagacaacaagcatgtgaaaaactcagtatcactggtcattacagaaatgcaaatcaaaaccacggtgagataccatctcataccagtcagaatggctattattaaaaagtcaaaaattggcctggtgcggtggctcatgcctgtaatcccagcactttgggaggccgaggcgggcggatcatgaggtcaggagatggagaccatcctggctaacacggtgaaccccatatctactaaaaatacaaaaaaaaattagccgggcatggtggcaggtgcctgttgtcccagctactcgggaggctgaggcaggagaatggcttgaacccaggaggcggagcttgcagtgagccaagatcgcgccactgcactccagcctgggcaacagtgagcgactccatctcaaaaaaaaaaaaaaagcaaaagtcaaaaatcaacagatgatggagaggttttggagaaaagagaatgcttatacactgttggtgggagtataaatgtgctcaaccattgtggaaagcagtgtggctattcctcaaagagctaaaagcagaactgccaattaacccagcatcccattactgggtatatatatacccaaatgaatataaatcattctaccgtaaagacacatgcacatgaatgttcattgcagcactgttcacaatagcaaagacatggaatcaacctaaatacccatcaaagacagattggataaagaaaatgttgtacagatataccatggaatactatgcagccataaaaaagaatgagatcatgccctttgcaggaacatggatggagctggaggccattatccctagcaaactaacacaggaacagaaaaccaaatatcacatgatctcaatgataagtgggagctaaattatgagaactcatgaacacaaagaagggaacaacagacactggagtctatttgagaatggaggttggaaggagggagaggagtagaaaaaataactattgggtactaggcttagtacctgggtgatgaaataatctgtaccaaaaacctccatgacacaagtttacctatataacacacctgcacatgtactcccaaacataaaataaaagttaaaaaaaaaccaacagcaaaaaaagtttttgttccctaccatgaataaaaagttgaaacattcttgaacaactatattttactcaagggcattatagacagggcaatttaacagatgcctgtggttagccatgggattgtaagcacaattctaaattatgaattactaattattaattttctggtttaacctcacatcctgtccagccttcagctacaaccagtgtgatatggtgatatataaagaagacttcatttttctaacagttcctcaatttaaacatcagaaagagtgctgttcttaaggaaatcatcaagaaagactaagcaccattgttttgtttctgatgttgctgtcactcagcaccgttgccattgctgtcagaagcaaaatcaaatcactcaccaagagctcggcaagcatgcaggtccccgtctggctcagggcagagactggtcagttatttttttggtagcaaaactctggctttagagttggaccatgagcagtcctgcttgctgctcattccctttctctagaaggacccctaaggagttttacagcaccgtgggggctttctagaatggttgaaaacctctggcagcagatcatccatcaggcttggtcccaagttccagacctgggttcttgactccatgactgttggccagtgacctaagttcagtctcattttcctcattcagacaagaattgcttgtaaggatgttcttaagtgtgctttcaaaaccatggagtataaggcttattttactccttaagtcttcctatttcctagtcacatctcatttgcatgttatatgccatctcatcaattattgggggacctaagatccacattttctattatttggccctgttgatgctacaacttctgcctttcagcttttcagccattgttctccacttcaaaatggacaaggaggaaaggtgaattggggttctaccactcctgcctctacaataagaggctccagcatcatgattcattcttgagaatgactcctctgacaggcctcttttcatttgcaggtgggccaagagaagggaaactgctctttccagaaaaacccaactccctgcatcatccctcaagaacaagaaaatatcttccacacaatatttgcttttttcacaaagtctggaagaaaagtcttggtaaggatttgtttagtggttggggtaacacgggtggtcctcactcggaagacaccagttttctatttgatatttattatttcctaaatctggttttaatcaatttgacttacaaaggcacagactgtggtcaactcctaattttcagtctgaggtttcaatcaaaatgttaaatttacattccaaatcctattacctggaaaagggataaatctttgcaacccaccaagcacaaagtaaaatgtttcttccactagaatgagtctaaacaagagtgattattcttgtgcaaacattttgggaaactgtttgataatatctactaaaacaaaacgtgtgtatcctatgacacagccattctactcttgagtatatccccaagaaaaatgagtacttgtgcttcccagaaaagacatgaaaaaggatgctcacagaaatgttaaaatagctgaaagctgagaacaatgcagatatccatcaataggagaataagtaagcaattgtggtatatccatacactggaatattacacagtaatgaaaaataacaaactactgctaatgaatgaatctcacagacagaatatattgagtggaagaagctagagacaaaagccacatattgtaatatttcacttatacgaagttcagaaatagcaaaaactaatcatgatgatagaggtcaagaaggtggttactttcagaggaatgtggatgggatggggcatgagggagcctgcttagatgctggaaatgtcctacatcctaatcagggtggtagtcctccaggtataaacacatgtaaaaatttttaaagacaggccgggcacggtggctcatgcctgtaataccagcacttagggaggctgagggggtggatcacctgaggtcaggagtttgagaccagcctggccaacatggtgaaaccctgtatctactaaaaatacaaaaattagctggatgtggtagtgggcgcctgtaatcccagctactagggaggctgaggcaggagaatcggttgaatcagggaggcagaggttgcagtgagccaagatcgtgccactgtactccagcctgggcaacagagcaagactctgtctcaaaaaaaaaaaaaaattataaagacacacacttcagatttgttctatttactatatttgttacacctccatttttaaaaagtgcaggtattgaagatggaatgacaatgctttccaaagcctccttttttttatctttggttacatttctctaagctccttatttcagccctggcacatctcacctttatcatttcctttctcattcttttctcctgttggagaagggtgactgtttgccacttgaaaggttgggttttttttttttttttttttttttacttacatagtgagggtgatattgttgaaagcccttagacttgttagatgtagtgatacctagtgattttatagttacgactctgtctggctgaaaattttgccgtatagatgaaacatcatcaaggtatgtatacgcattttggaacctatcatataaaaaagaaaacttttgtaacttaaatttgggatttatgtttttggttttttgtttgtttgtttgttttgagatggagtcttgctctgtcgcccagggtggagtgcagtggcatgatctcggctcactgcagcttctgcctctcgggttcatgcagttctcccgcctcagcctccccagcagctgggactacaggcggccaccactatgcctggctaacttctgtattttttgtagagacagggtttcaccatgttggccaaactggtcttgaactcctgatctcaggtgacccccctacctcagcctcccgaagtgctgggattacaggcgtgagccactgcgcccagccgagatttacgtctctattgtaacttttgtgttttcttgaggaagtgtcacatgacttcttagccctcttattcacctacctaataaataggcatgaaagtatatttgccactacacaggtggaagtcacataatgtaggaaacgtgtctgtgttcaaaactcataagaatgctttcagaatgcaaaatttaagtttgtgggtttaaaaaaaaaaacaattatttctctttgtgaattcatccaattcttggtaggataaattagtgagctgttttctcccagttgcttgacttaaaggcatgctctggttcccactgggtgggaaatcccttgaatgccctctggtggcgagaaagaacgattgcatcttcttgtggatttcctctgcctggaattgccttagtcaccaagttcatggagcccactactctgtaaattgttgtggatttgtctttgttcttaattccattggaaatttttctgacttttcttctcaggactgtgaaaaaccaggaatttcttgcctaacagcacactgtaactttagtgctcttgctaaagaagaaagtcgtactatagacatttacatgctgctgaacacagaaatactgaaaaaggtaagccctaatgaaccgcacttgtggatgcatttagaagcatttgaattgttgacatctgattttgggtaaaaaaaaggaaaaaggaaagcatttgaattggtgtcctcatgacaatctggctgcccccccttttggctgtctacaagagactgtttttatttttatgtatttagggggtacaagtgcagacttcttatatgaatatattgtatcgtgatgaaatctgggcttttagtgtacccaatagtgaacatggtacccaacaggtaacttttcaaccctcacccccctcccacattttggagtctccaatgtctgttaattccactctttatgcctatgggtacccattacttagctcccacttataagtgagaacatgcagtagttgactacttatgagttatttcacttagggaaatggacttcatttccatccatgttgctgcaaaagacataatttaattcttttttatggctgagtaatattccatggtgtgtgtgtgtgtgtatatatatatatataccacattttctataaccagtcatccattcatggacacttaagttgattccctatctttgctgttgtgaatagtgctgcaataaacttaccagtgcaggtatattttttatacaatacttctttccctttgggtatatacccattagtgtgattgctggatggaatggcagttctatttttagttctttgagaaatctcgatactgcttttttgattgtactaatttatcttcccatcaacagtgtataagtgttcccttttctttgcatcctcaccaacatctgttgttgtagttgttgttgttgaactgtttagtaatagtctggctgccccttttgaaacttttccagcaagtgccattggtaattttgctggtagataatgccagggtaaaataccagacccttgctactcaaagtgtggtccgaggaccagcagcatcagcatcacctgagagtttcttagaaatgcagaatcctgggctccaccccagacttaataaatcggcatcttcatttttaacacattccccagggattttgtttggccatttaagtttctcatgctttagcttgcatcagaatcacctggagatcttgttcaaacacagattcctttggggtgcagtctgaggctctccagttgccacaagcacccaggtgatgccagtcctgcagtctagggacctcgctttggatgaaggttggctaaccttttctgtaaagggccagtggtaaatatttcaggctttgcaggccctacagtctcttgcaactgttcaactctgccattgtattgtgaaagcagccatagacaacactcaaataaatgggcatggctgtgatccagtaaaactttataaaaacaggcagagggccagatttgacccatgagtcctagtttaaatgacggtttgttttggtccaacttttgaacctcaggtcactttgctattatgagtttatcacaggtggttcattaaaaaaccacctcaaccagtgcatcggtggctcttgaagaatcatacaaatttcctatgatttattttaaggtgagagctgctgagaggccacttccaacaagttgctgtaaaaataattacatgtgaagataaaactaaatatgcatgttagcctcagagattccaattatttttctttagaaagactaaatgtgttaatctgtacaaacctatccacgtgtgaatgaataaccttagaaaagtcattctgtggttatttttaaataggcacagaggtaacacactgacctgagaggatgcaggcatcaggggatgtttttccattttcaatctgtagccgttacagccctcacacacctgaagagagctgtgcatagttctggtttctctggtttgctctggagggaaactggtttggggcaagttggactcacactgcagtgctttcttctccctttgtacctctccctttataaaggacagtgttggaggaggaccaggcctgacttagagcaccactggccatcctctgattccataagggaggctggaaaaccccacgtctggagaagtaccttcctgaaatgtgtccgcaggccaggctggaggactatgcctctgcatatgtacctgtcctgtttgtattcttcaaaaatggtgctgcagacagttttattgcctgtgccatacttgccactgtccatagagccctggtgacagcactggtggctgtaagccactctgatgtttcctttatcctcaacccagatggctgctgcttgcacttcagttatttgcacttaatcatgcacagctctgcagcctggttcttctgcttttctatcccggcagccagtggtgaccctttgccaaggaacatgtcccagtgactactgtccccatgggccagccaggccagtagagccgcaggcaagagagctgaaagctgtagggtgtcatatgaagccttcaaggctcattctccatgtgccctttcagcagaaaccaggagcacttccaggtgcagagaaaagcttagaacaaagttgacctggaagccagatggggccccagctgctcccagagcttcagttgccctgaagccagctacagcctcccttggggagtggagcccacatggctccaggcctcccgaaggatgtggagcagcgccagccttgtggtttgcctgggcctgcagtcgtgtttattttccttttgacctcaagatctggccccagacaagggaatttgaggttttactgttttgaccttaacaagttttcatttgaaatgtaggatctgatttttaaaatcactgtaggagccgggcgcagtggctcacgcctgtaatcccagcactttgggaggctgaggtgggcatatcacaaggtcaggaattcaagaccagcctggccaacatggtgaaaccccatctctactaaaaaatacaaaaattagcctggcatggtggtgggcacctgtagtctcagctactcgggaggctgaggcagaagaatcgcttgaacctgggaggtggaggttgcagtgagccaagatcgtgccattgcactccagcctgggcaacagagcgagactctgtctcaaaaaaaaaaaatcaccgtaggattcggatttttttggaagtattcttctttcagtctgtaaggcttttctcactgattctacaaccgtgggggcccatcctgtgccagactcctcgtctgcttggcctgtaacgttggcaattatcatcatcattatcgttattaatatccaagtttatttttatttattttaatgtttttatttaaaaaaatatttttagagacaggatcttgctctgtcacccagatgggagtacagtggctcaatcatagctcactgcagcctcaaactcctgggctcaagtgatcttcctgcctcagctagtcctcagctaggactgcaggcacatgctaccatgacaggtgaatttttttttaatcttttgtagagataggatgtttccccaggctggacttgacctcctagcctcaagtgatcctcccacttcagtctctcaaagtgctgggattacaggccttaaccatcgtgcctggcccaagattattattattattcaagattgaaaatacagcatatcctgatacataaaaccccaactttataaaactgttaaattggtaaaagattatttgttgcttaaaattatttcttgcttaaagtgagttaactggagtaactcttttgaatgacaagcttcccaaaagcatttaaaatgtgtcttatggttgttttaagaaaagaatgataattggtgcataactcccaagtcacatatacagaccagggtccctgtgtgccccaggaaggtctttgtggtttctttggcagagatgagcaaagggtacccttggaactgttttctgtggagtcctctaccttcctgtttctttgagggtttaaccaaaggtggcatttaagtgtaagctccttgcatgacaggcaagctgggtagatgtaggtggggacaccacaagacaccttgcctgtggagcccctcctgccccacaggtagaatgttgaatgcactagttctctgctatctgtttccacgacagaagccaggctgcccttctgctccacaatcaacctgtaccactggcttgaggttctggcttctccccagaccacagtttttccagtccctgtcttcttccaaattctttctccatccctgttttggcgccattttctggttatctggatcagtgtctttgaatctgagcccacaggaagacctctgcctgcctctggctggggggtgattccagagtcttagctgtgctcccttatacccctgcccctttctccttaattcataagccagatatttaccccttccccatctctccatcaggcatcctctttcaatgtttaatggttttgattccaaaatgacttcatttaagagcaaagaaagagttaaaagcaactcatatgaagggtttgagggttgtggtcaaggcaggaagatgcctataaaatgtagatcagatgccttctgtggaatgccaggcctagatttgctctacacaattaaacagctttatttatcctcaactctttgtgaacatgtcaatatcaatatccaaatatctggctctaactgcttggaaaccacagcacacatcttgcgtgtgttgattactggcaaactccatcatttcccaccatccaccatgatctgcaaagaatccttaagagagaccctagtctgtgtttatgtgggtgcctgggatggagaggtatctagttcaatgataaaatttttgtctgggctacatggaatcatggaatttcagttctgcccagtccctctcaaggcccagccattatcatagaaaaatcttcaagtaagttgtgttgtttcttccacaggacagttcgtctgtcatccagttcatgtcccgcgccaaggtgaaggtggatcctgccctaagggtggtggaaatagctcatgggaacccagaagaggtgacggtgagtcagccaccccaggacagccctcctcagagggcaagggaagctgggtgacttggagacctggagctggaatttgagggtcaagacagtctctgagccaagatgttgggtttgtggcagacccaagactatgcctgccttggcttccaggccccccctggagaacttctgtggttcgttcttgtgatagcattgtcctttaggatgccatcattatgtgaatgtttcctgctatgattgtccaaagggaaaatggtctggaagtacacccacgtcaacagagttggatttccactgtggagccaggactatttatatctttcttagacctttcctaagacagaccacatctgccttacccgtcacattactccatgggtaaatactgtgttttggtttggtttggtttggtttttaagagacagggtctcactctgtcacccaggctggtgtgcagtcataactccctgtagccttgaatacctggcctcaagggatcctctcaccttagcctccagagtagctaggactacaggcacactaccatgcctaatttttaaattttttaaaatttttttgtcgggatagggttccacgatgttgctcaggctggtctcaaactcctggcttcaagcgatcctcctgcctcagcctcccaaaacactgagattacaggcaaacactgggtgttttaaaaacaagttgtttgaatgacttaaagagattacatccaaattgccaagacctagtaactgctctttaactatttaccacccccttctcctccataaagtgcagttggcaccaaggcctcagagacacgggagggtgtggcaaaccacgaggctgagagtggaggtgtgggagaggctggagggaagctatggccttggaattttattgccttttattgttgttcttgcaggagcaggggggttgaggggggttgaggggggttcatcctgtatttgatgcccacactcagatcccaggggagtagaggaggagacagcagccgatgcacttcttttgccagtgagctgtgcaatgatgctacctgtctgcttcccttctgtggaatttaccctctcttagaacagtcagtgttgctgtgacacatttacaaaagtgataagtttataatgattttgtgcttagaaactgttgttaatttactctctgacaacagtggagacaccacatgtcaaaatgtcagaatggggttcaaaccaaagactactcttacaagaccctggttgggaaagtttcatatagaaaataaatgctgggcaggcggatcatctgagatcaggagttcaagaccaacatggcgaaacgctgtctctactaaaaaatataaaaattagccagtcgtggtggtaggctcttgtaatcccagctacttgggaactgaggcaggagaatcacttgaaacccggaggcggaggttgcagtgagccaagatcatgccactctgctccagcctgggcaacggagtaagactccgtctcaaaaaaacaaaaaacaaacaaacaaaaaaaaaaaaaccaatagtaataatgcttaggacctcaataaaacttcagtcctgtccgtttttggtgagcaagagatgagaacatcagggagtctgggatgaaaatgaattcctgaatgagtgaggggttgggcattccctactcagtgaggagaatgagtgttccatgcagacttttatgctctacccacaagataagttgtccaagcactatttttgtttgtttgtttgtttctttgtttgtttgagacagggtcttgctttgtcacccaggctggagtgcactggtgcaatcatggctcactgcagcctccacctgttggctcaggccaggcactaattttaatgatagaaaccaaatggaatgatgctgggtcatttactacttagggtcagtttttctggcaggtcagatatttggagttggtgtttcccttttcttccctgccttctggccatttaactgctaattcagacctccacctgggaagtgaaaaagaaaagtggttccctgctcattgtcatagttctggtttaaaagttttatagaatgaaatacttgcccaacatgagaggtttagaatgttctggtaaaccacagtgttaataagtggaagctaatggaaatagctaacaggttttctacacgtagaatcccttgtgtagatgaaaaaaaaaaatcactgggcatattgccttccattataggactagactgtgggatccaggaaaatgttgcttaacatctcgttgttggattccaagtcatctgtactcccccaaaataccacttccattaattactgttccattttgagcactatggtgatattttcattatcaagagttcttgggaagaggccgagaggttttttttagcactcctaagaaaaaattaacacacatgggaattccacaatgccccttctccctcctttccatgactttgccttttcagtccatgagctacaatgaagttctacaatctgttgttctcaattttcctggcaggaaaaaaaaaatcttttctgagtaggaaggtttgcctttttagaacaaacacgatcttccctgcgtgattcttctgaatgcctggccttctgtcaactatcagtctgaaggggaatttccatagagcctcgccaccaaatttaaattaggcaaagtttcaaagattttagattaggcaccaaattgttatggccttggaaggaacaggaaatgtacttgcatttggtatcgagtgggggaggaaaacaatcagatttttaaccacataacgtgtgcacggtggtaaatttaactgatggagaaatcaagcaattttcctgtgatcttttttaataggagttttaaaatgcattttatattgagtagttatttcatgttttcttaaaacaattattgtattgaactaaaaataaactaggtagtttgttcacataacaaatctacattcaaagacatgcaaacaaattttccacttagtccatttttctgttctcagcattactacaaatgcctcattctgttatcacgttgaattcttcagcatcttctatatcatttccagggcatctctgggaagtagtgatgcctgtcttccctcagaagcacactgataaccccaatatacccacaattcacacttttttccttctctgaggtatgctgttttttgtcaaaacagaaaaaacacactactaggatatgaaaaacttcattctgggcctggttaggtcataaactacagaaccttaggtcatatattctcaccgggcgcttgtttctccactgcaaaaaataattcgtatttgcttggtcctttgtagtactttactgtttataaatgtagtacatttatcttcatgatgacccttaaatttaagtaaggtagtattatgctcattttatagaagaaattcaatctcaaagaggatacagtctcccaaagatcccacaagcagtaatatattaggcagagctaaactcacacactgtcactcaatttcctaatattggtacatgccatgctaataagtgtgctaaaatggatgaagcggcaatttctcaggtcccttccaatgatcctgtcctctgcttctacttgatattttttctctctttcaactagcattaacatccgaaactgtatatcatcaccacatttcatttaccatggttttttaatttaattattctttaaatttttctatttccatgttaaatccagagaaattgttactttttggaaagtttctactgctgcctgcctctgaaggccacgggacttacctgtttgtttgtcaaagcagaaatgcccaacattttgtaaacactaatttttttataactgtaaagatgattattccatacttaaaaccaattcaaaataaaataaatcctcaatacttcttattccctggggtagtaattttaattagattctattgattcattattttctcctgtgtgcctttatttgggaaatactgttagtttaccttgctatcgagtctctttccctaacaagaaaatgtcagccttacgagtcaggaaagcttttactttcactatcacatatgaagaatgaactaaacacctaacttggaaagtaaaacttaaatgagggattcaggacatttcccaaggggtcatctgaccaatttaagagttggtatgatgtgcctaaaatagcaaattaactcttctacttataataaaggtgcagatgtactgattagacatgctgacatgtacatataaaatatgcctaaaccaaattaaaagaaaacaaaatatattccatggcaatcttgaaaagtcagggagctcaatatatattaagagtatgcgctcagccaggcgcggtggctcacacctgtaatcctagcactttgggaggccaaggcgggtggaccacaaagtcaggagatcgagaccatcctggctaacgtggtgtaaccctgtctctactaaaaaataccaaaaaaaaaaaaaatgagctgggtgtggtggcgggcgcctgtagtcccagctactcgggaggctgagacaggagaatggcgtgaacccagaaggcggagcttgcagtgagctgagatcacgccactgcactccagcctgggtgacagagtgagactccgtctcaaaaaaaaaaaaaaaaaaaaaaaaaagactatgctctcacaatgagagcattaaacatttggtaattaacataatttaatatgccaaaaatgagaaaatagtcaggatgagggatgaggagtacacataggaaatttttgtgattttcttcattttgattgtattgctttcttgtcttcaggagggaagattttgacttcaaaagtaacaaaatatttaagaagggaattcacatctttctgttctaattggtattcttgcgctattttctcagcagtccatgtttctggataaagtttatgattgttaagaagtgtcagtgcttctacaatggaaattttgcctttgggaatgctcttaatatttatcatatcaaagtgatgacctttcagcaatctgaattcctttggctcttgatgtgtttcagcagcttttacctgcgcggaagacacaagatctttggaatcaacatacacatcttttagaaatggcagcagcttgtcatctttatgagcaatctctcccttaatttctggatagagactaatctgctctcacaggaggctgttggtagaggggtgcctgggagcaggagagggcttcatcttgctgatttcccattctgctcggttctctcggttggaatgcctgatcctgcgagtcactgcagcccccatctcataacatgatgccctcaggtttacgccacttgtgggaacactggcacaggaagcctccagggcgtctggagcatgcacacatgtcctgtgattctttatatcttttatttttatgccatggtacaagttgtgctttacagagcatttgggtgaataactagaaatatgccatagattcttgaggctttgcctggttcactaatgacaggctccagggcgtttctcagggagcatgttagcatgtttctaggaccagccacatcagccagacctggctctgtacagacccaaacctgagaatgccatgtgagacctgtgtgactgcagaatcaaagtgctggttgcgaggtgccaattacatgttgaatttcatcttcaacccaactctacttacctttcagggagtgatgagtagggggcgagaggggaaaatgcagaaagtgttgtttgaggcccacagaaactataaagatgaagaacaggagaaacgtagttaatcatgccctggaaagctggcctgcagaaagaaaaggaatttatctctgagaaggccttcagaaagaaaatgagtaggctccggagacgttcatctgtcttcgtgcagccataaaaagttatcaggtgaggctgaggggtgaaggcgctttctctgatccctgaattggttactgaggcccacagaagaggaaaggacccctgaagccagaaactcccccaaggcaaatcaagactttatggaatcagctctgttactgcaagacatcccctcaaactcccgtctcagtctgtgtgagaagcgtgcatgaattcttgctattttcttgatattttcaaatagcagaatacatgataaacttgtaagtccacagatgagtcggtaagctgctgccatatggagcatgcaccagactgaggtctttggtgacagctggaaagactggctctgtctcatttcagcagaatcagaatggattcgaaggctatccagtggaagtgctcagaattgcgctggaaggctggagaaccagaccaaaaatcagagggatctggaaacctgagggctataggctgcgtccaggcgcaggaagtctggcatggtgtcctggacactggacacagctatccctggcttctctctacctcgtgctctggagtcaggcagaaacctttctactttctggagttgctgagaaggttcagtgataccagcatgaagctcctagaagaagggctggtgcatagctgctgctcagggtggcacagcccctccacagtcctgcccacatgtgagttgccccttcacaccactccctaacactgccctcaccaaagatgcaagcctggtatctcaaccagagaggcatctttcaacatggcaagcaagattactccaaaaaaatgccacttaccattcctttggtgtactgcttctagaggcaaagtttactgcttttactgtcatgaaatagactgtgacttgttatttatcatttatgtgaccaattatagttacaatcatgttccatgtgacaatagaatctttccccccttgaacctcacattatgctgagatgtaggatgaagaggagggttgttgaagggtcatcaccgcccccatcctatgccatcagcagtgggtggtgagtagttctttctcttcacccacctccccacatgtgagaattaagctctgaccatcaagaattgagaaaactctcggtatagttttccaaacacacgagtcatattttctaatggtcatcatttgcttatttgtttgatgaatatttattgagggcttgctaagagccaggcactgtgctaggcactggggactcgatggggaacaaaagagacatgatccgtgccctcccagagctggccgagggggcagcagtcagcaaggacgcaaacaagaattctatttccagttgaggttagtccccagggagtagcctgctttagattgggggtcgaggaatgtttctacaaggaagctgagactggcagatgagaaggaattcgcttgccaagcatgaggaagagtgtctcagttggggaggagagctgtatggagccccaaaaggcttggcctcttcaaggcactgaaagaccaggtagcaggaagctggttagcagtgaagagaaccatggtagacctaggcagggtccatgccaggtaacaccactgggcacttacaaaggaaagccattgaaagcttctgtttggagcagggaatggcatgatccagtgtatgttctttaaaaatcgtaggccactgtgtggatggtggattttaggggcaaaggtggaaataaggagctggttagaaggctgcgattttcacctggcaagaggtcagggtggcagaggagacagagcaagtggacagtatgtctatgtcagtgaaggtgcggtgaccggtgccactcacacgtaaggaatgcttatcctggagggctgggagtgatccagtgtcatctcgatgcaaagccccttgcacagcacatccacggtggcactctgttaatagtggctgtcattgcataaagagatggccaaggagatgaaccacatgaaaaatgagcctccttctccccaaatcctcaagtcctggtcagtttactctaaatcaaagtttccagtcgtcatgatgagtatgatcatcatcattattatttttaggcaacagaacccatttctaaattgaaatatgcttcagttgactcaggggtgaggttcctggaactccctcttggtggcttccataccccctcactggacccgtgggctctaaagaagccactgctatggaaagttgtattctcagaaggttgcccagtccatcaaaggctttcactagatgctagttatacccccagtaactatgaacaagatgaaatttttaccctcaagacttccacagccccaaacaggtcaacacacacacacacacacacacacacacacacacacacacacacacacgtgcacacacatcacacccctgcagcactgtatgcatacgtgcccagagtatctgtgctgaagaggtcaagacaggtttcacagaaggagtgacccccgaacaagtattgaaggaatttcccacgtggacaaggaagatcaggcattcaagatgaagtcagatggtgtcttgggctggattctcaagaagcagaccctgagatgagggcatcatgtaagcagtttatttagggagatgctcctaatgagacccagaaataaatgggacaggataggaaagaggagaagggaagcaagggtgagatttcagggaccatcttagctccaccctgatcttgacctcggagttggtcctgcctggaagcaggggagctggggtctcacactcctgtatctgccagtcattggttggggctgttccagaggtagtaaccccaagccactttaccctctaaaagtgaggcaggcctctagaagtgaaggcatgacaaacctgggggctgggcaggccaaatcaagagaggggacccaaaaggatctgggcagagaaccgagtcttggccacagatggaaatgttctgcactcagagcttgggtgctgtgctcagtgtgcgtgtccatgtcccattaagatgaatgacctcattgtgtgaggtgtgctcgaatctgctgaattcctgtgaagtgctaggcatgtgctatgattacctcctgtcactctgacatcacccctgtgaactaggcactacaacttccatcttctttggaacagaggctccgggagtgaaggagcctgctggatgccccacagccggtcagtggaagaggaatttctggccacagctctgcctgttggcgagccctgagtctcccttgaccccttacccctctggcctgtgctgtcctgtagcccagagcccacacacagagcaggtgggaggaatcgcattcctgggtggtagacagctgaccctctgtcttaggagtgacccttggctctaatggcctcaggagcacatcatgctcagacttatttggtggtcagttggctttggaactcttcccattgtgtcctggtccttaactagatgcacagatgtgcagtcaaggggagaatgaagactcctcgggattctccatcgcttgaggtaaatgagctccatccctctctctctcaagagcaatgtgaggattatggggagtagtagatagtaaacctctcagcatggtgcctggtgcatagtaagtactctacaaatgtgatccattaccagtaacaggaattagaaagcccagctcattcctctgcaaactctgacagagaaagggattttggaaacatgacacctggcaggcatggggcatgtttgacatctctgttcatcacagcacagacttacagtgccagtcttgccaaatgtacagtttattttctgttcatttatgtcgtctccataagtctccctgtgcctctgaactggcttgccttctaggctgagttctgagagccatctgaggcatggttctgctgaaaacatttattccagccccaaccaccctgtctccctcctccctcccccacacctgcactggctattagatggaatcagaatcgggtggaaatgtcatctcactgtcacagatgttattctctttccacttcttattttatataaattccttccttctattgagacaagtgtgtgatgttgactgcagagagcatcttgcccttgtcattgaccttcagctggcctaggtctggagttgaacctcctcttggatggtattgaccgagctgtccctccgtctctggaagccctccatccagcagaagcctgggtgagatgtactgccattgtgatcatattctcaggccttgtggagacatgggcattgccagctgttacagtaggcatatttgcattgatcagaacataaaagtttccagaaacacagaagtgaatcaaatagtgtggtttaggttcacccactgcctcagactggaagctggcttctggccactccatgacaccagcttggcaacctcaggtacgttaaattctacagaagcaggcagggtgccagtgtctggacctgtctcaaaggcctgtttgccctcctcaaaggcccccttgagacagatcctcatactccccattttcgtctgttttgttagtcagcgtccagtgtgtgagccctccagccagggtccgcaccaggccatcagccatcccttcactggccagagctcctgccttccccagctcagcctgctacgaccctcacagccactcccccaaaaccagcagacttctcctcctcctcagtcaatcttctcctttcacaccacctcctttcttactgaaagcgtggatctaacctggggaaaccatttcccccgcagccctctcacgggggctttttccttgtactcccacattcagttatctcttctgacctagattcattttgcagtgtactttgcaaaatgcaaatcacatcactgccctgctcaaaatcctccagtggcttctcattcctcttaaggtaaagcatggagatcttactgcagcctccagctcctgtctctccagcatatcatgaacatcttcccgctgcttcttgttcatcctgttggctccagttcactgtccaatggcagtgtctcacccttgccaagttcactcatgccaaagggggtttgcacatcatgttccctctccttggaatgatcttccctcccttgtttagctggtaaacttctgcttgtcctttcaccttcagctcaaatggctcctcagggaactctgttcactcccatgcctctatcatgaggatcttttatcatcatgaacttctcctttgtagcacttccacagttataatgatgcatttatttttctaattgactagtagtctctagaagctggaagttctgtgaaagcaaagactgcctgttttattcatcaatgaatttccacaatgtctagcacataggagatactgcagacacatttgttggttggttggatggatggatggatggatggatggatggatgaatggatggatggaacgacggacagacggatggacagagcagatggacaggttgattgacagatggataggtggtggatgggcggatggacagatggatggatggccaggactcccccaaaagatataacatttgcaaatatatttttgaaggagagagaaaataatcacactcagagactccacttcaaatcccacatctcttttgttgcaaactgagtcgtgttcatacttcatctgattttatagcagaaatgatgttgaatgtattaatttgtatattcatgaatcatataatgaatcagtgccttggttcaggtgacaggaatgcatgcattcatgtctttattgtatacaaatcacagtttactggagtccgtagacaggaagatttatcattaccttaaagagtgagaaggacctagaactgggactctgaagtatacagctgtggttttaaaactctgttttgttggagccatgggttcccttgagtttgttcagtgcagctgaggtcaggttagggaggaacagggcttagaaagaggggctgggtcaggtgcagtggctcacctgcagaactttgggaggctgaggcatgcagataacttcagcccagaagttcaagaccagcctgggcaacatggcaaaatcctatctctacaaataataataataataattagttggctgtggtggtgtttgcctgtagtcccagctacttgggaggctgaggtgggagaatcacttgagcccacctcaagtgattgaggctatagtataggttgaggctatagtaagccaagattgtaccacttcactccagtctaagcaacagagtgagaccctgtctccaaaaaataaaaacaaatgggggctgagtagtctgggttctagctgcccacctaagaagctccattgtatacactgggatgctataggaggttgaaaatcactatgtttccaagagctcagagaatgattaattctgctgaaaacaggagtaaggcaggcttcttgggaaagcagatattggagcagagtctctcctttaaaaaaataaaatggttttacttgcctttaaaatgctcaatttaaaaaatagtaaaacgtagaaaagagaaataatattcataatatcaaaaaaacacctgtttactttaaagggttcctactgtattgctgcaaagctgaagtcttctacgtattagataatctttttattttttattttttattttatttttttgagactcactgtgtcgctcaggctggagtgcagtggcacaatctcaggtcactgcagccttcacatcctagattcaagtgattacaggtgtgcgccaccacacctggctaatttttgtagagacggggtttcgccatgttggccaggctggcttgagctcctggcctcaagttgatccacccgccttggtctcccaaagtgctggaattacaggtgtgatccaccatacccaacctatttattttattttattttattttggacggggtcttgctctgtcacccaggctggagcgcagtggcacagttacagctcacttcagcctcgatatcccatgctcaaatgatcctcctgcctcagctccccaaatagctgggacgacagttgcatgccaccatgcccagctaatttctgtgtttttgtagagacaaggtctcactatgttacccaggctcatcttgaactcctaggctcaagcaaccctcccaccctggcctcccagagtgctgggattataggcatgagccagcatcttctgattttttaacttagcataataaacatcattttcccacattattactatgttttcaaaagtatctaaaatttggaaatcaggcaaaaagatgattacatatcctttcagtgtcatactggagcatcccctcgcccctttctactcaaagtgtggtccacagaccagcagcatcagcatcatgggggagattatttgaaatctaggctctcaggccccattctagactctaattcagaatctgcattttaatagagttcctcatgtgattcttatacacagtaaaatttgagaagcactggtggaggtcccaaattctgtaaagttacctattaacttacggaaggctgataagttataaatgactcttgccagtaaagataaaaatgatttctgtttgactgaaaatatcccaaaggttagaatttattgccttgtagggtattagccagttttgtatttgatttagtaatctgatttcagtaatttttttcctgtgactacacatttttttctggtctttttaaaactagctttgccaccctgctgacttcctcaataataaattaaataaatctttgccacgtattcactatatatttgtatgagaatcatgtttttaactttttgaaaattatgctttgacaaccagctttctgtcatcatttttaatagttctgtggtattctattttgtgattgaccatagtttacttatctattgccctaatgttagacacttaggatattgctaatttagtaccaatataaataattctgcagtgaacatctttgagcataaaactttttccgtattttatatttatttcctttgagtaagttttcaagtactgaattaatggatcaaagggtatgaacatttttattttattttttaattttttatttttttaagacagagtcttgctctttcacccaggctggaatgcagtggtgccaccttgactcactgcagcctccacctcccgggctcaagtgattctcctgcctcagcctcccaagtagctgggactacagacatacaccatcacacctggctgatttttgtatttttagtagacacgaggtttcaccatgttggccagactggtcaagtatgaacattttcagatgagcaataatgagcttgtcaaatggacaaggatggaagggcatttcaggaggcaagagcagcctgcagagaggctggggaccaccggtctcacagaggagaggcctctaactggctagaatgtaaatatgtgtcctgggagcagctggaaaggcaggaaggagaccagagtatgaaggccctggtgtcctgaattagatgctcagcctaaaggaaagtcatggatactgtaaaccgagaagtgacatgatgagacctgtgccttagaaaaacaactctatcagcaaggaggcctttccaagcctcctgaaatagtgctggtgagagaagacgagatgtgagccaggaggtacctgggatggaaacaagaggatggagagaaaagttgtttagaaaggtgtaggggcttaaccaaggatcacccagctcattggtggtgatgacgggacctgatcatcagtgcttcttgcctctccatgtcgtccatgctgctgttccttccttagagttttgttttttaatctaagatatgacttcctagagctacaggacactcagctcatcactcacagatgagtttgagagttgtgatgtgagagaacaggctctgccaaagcatggagcacgcatccaaggggatgaacagcatccctaaaaataataagagatgaagcccacattccggggaagtgacagggcattcttgtggaacttgacagactaaactgtagctgctactttaacctctgtgtccacaaaaccagacctccaacgtggcgttgctggtatgcagatttcagtgtccctaagaagccatctgggttagcacagggggctgggttttacagctaaccccgctgagctcagtgtctcagtctgattcatagtcaacaataaggtttagcagacttttctcacacccaggtgctttcacagaactgccacatttccctatcagaccgccatttcacagaggaagagaaagttggttgcctacggttgcaccaggaccagattaaagccagcgctcctccctctccatctttcctaacagttcctcacagttcatctgtacaagacaccatgagagattccaaatgcaggaagtgatttgatccacagctttttaagggcaggaacccaaagacatgagtctgtctgcctttaaagatgagagctgctcatttgaactagatagaaaatagtggatttaggatgacagacttcagagcccactctgtcctaccacctcctaccagtaaatgttcttccctgagaattgcctattatctgaaaattgctctttttaataaccccaagctggaaataatctccatgcctatcaataatagcatgaataaataaacagtggtatgtccacacagaggaatactgtacagcagtgagagtggacatgccacagcctggagcaatttcccaaacataacagtgagagaaagaaaccagatgcatgcctgtaatcccagcactttgggaggctgaagcaggtggatcacctgaggccaggagttcgaggccaggagttcgagaccagccaggccaacatggtgaaaccctgtctctatgaaaaatacaaaaatcagccgagtgtggtggcatgcgcctgtaatcccagcttcttgggaggctcagacaggagaattgcttgaacccaggaggcagaggttgcagtgagttgagattgccccaccgcactgcagcctgagcaacggagcaagactccgtctcaaaaaaagaaagaaaagaaaagagaaaagaaatgaaaccaggtactgtagttcatacatcatcattccattcatagcaaggacccaaagaagcaggtgatgctaatccaagctgttagacatccttggtgggggtggggactggaaggaagggggaagggagcttctagggagccggtcaccttctgtttcttgatctgagtgctggttacacacatgcatttagcatttggtatgtgaaaattcagcgagctatacacttaggatacctatacttttctctatgtatattcgacttcaataagtaatttttaaaaagtaaaaagagctgggagtggtggctcatgcctataatgccagcactttgggagctgaggcacaagaattgcttgaacccaggatgcagaggttgcagtgagctgagattgcaccactgcactccacctgggtgacagagagaaactctgtctcaaaaaataaaataaaaactaaaaagtagccagccatgcacaacctcaaaaaaaactccctacaatgatgctaacaggaacactccatttgtcaagggcggactctgtgccagatgctatgctggggactctgtgtgcattaccccttttcaatttctgggaaggcactgttctgctcctgtcttgcggatgagaaaactgaggctcagaaactgtggtggcctgtgtgtccatttgcctcatcccctggcacacgcacacactctcctaccccagctgcgggaatggaggcaatgaagtagaggtggtctcattttctttccttatcaccagggaagagccagtaagtaattcattcagttgacaggtagcctataaagaaggccactgtcaaccaggcactgcagtgtggtgatgacaagctcagatttgggggtttggggttggctaagagctgggttcaaatcgtgactgtgcatttgaactacacaatccagagcaaatatcctctctggacctccatgttcccctctgtaaaatgggtgtggaagacctcatagggctgttgtatgacttagacaagagattgcaaaaaaaagcataaactgacacagacaatattcaataagtgttagagagggatggaagccaggccctaaaaaggttaaataagcagtgctaggcattataacatcagtattgtgcccagtcactgcttgggcttgagcaaggggctggaccagtgggcttcagcgatcagtgaggcttcttgacagaggattgaactaggtttagaaaagactttcccaaaggggaatggacattccaaagagatggcaaagcttggagaaagacctgtggttggccagcctgtctggagccaaaggagagaatgactgcccagagctgtgatttttttgtcttttgcagtgaggagcttaaatgggacagtggtgtattggggagagttatttggtagcagaagacgcaatagatgctttgaattctgcaaaaccaaactcccctgtgaccagtggggataaagcagagccgaaggggacaatcagaagtgagcactgatacatgtttaacaatcagttctctggcaggagggtaggggtgccctgatttgtttgccaaatactcccaccatagcccatttcaaactgccattgcaatgtcactaggtacggagttaggaagagatgcacagttgcctctcatgagctgatatgagccagttccacataccactgggtttcaggaaaagttgggaaaacttgcctcattggaacatgggctccaattgctgtggctcccatgggaaactacagtacagcctctcgaacgagtttctccaatgtgctaggccctaccatgagacccaagacagactgtgtcctaactctagtggggtccacagtctactggggaaactggcattaatcaaataattcctctaagtgacacattgagctgaacacttggaaagaagagctgccttacatgcagagcactcccgtgttctttgtttcaaagctgaaacaaaaggtacattgtcgttatctgttctgaatcaagaacatagtgtgtcctctaagtttttcagtacacttttgttcacttcatgatatttaaatcagggttgttgtcattacaaccctttcaagacctagggcttggatttcaagtgccttttcaggtgccagtgaaaaatccatcagtttgcaaccagaaaatcgttcagcggagcttatgtatttatttattagtaacaacagtctggatacttctctgtagttctctccaaatgtcaagcccaggctgggctccatcatgctctgcgcacttctgtttaggaaacgttttcagctggcactgtggctcgtgcctgtaatcccaaaactttgggaggccgaggtgggtggatcacctgaggtcaggagttcgagaccagcctagccaacatggtgaaaccctgtctctactaaaaatacaaaacattagccaggcacctgtaatcccagctacttgggaggctaaggcaggagaatcgcttgaacccaggaggtagaggttgcagtgagccgagattgtgccattgcactccagcctgggtgacagaacaagactctgtctcaaaaaaaaaataaaaaaggaaatgttttcactgttgcgttgcctcctaggtggtcttcgaggccctgcacaatctggagccccgtggctacgtcgtggggtggatcatcgccatcagtttgttggtgggaatcctcatcttcctgctgctggccgtgctgctctggaaggtgagtctggtgattgcaggtccccctggggtccccactcatagatgcccagctctcctgcctttccagggaagaaggagtatcctgttagagcttccttcatggcaccggtacagtgaaggacagtgacccttcaggcagggagtggaatcttggctccccttgaggccattcacaactgaggatttggaccacttcagagtgaaggcaaaagtctcagttctctcttctcttaccttcccttagagccctaacataggatggtgagaacctaactccaaaacagaagtctggggagcaactgccagaagggggcgatttcccatttgcttaaaaaagatcagaaggcgaactatagaacaattcttccttcttttcctctaaggaatgtgaggaagatttctgaccagaaaacttgagtaactgagatgggctacagtccagagtagcttcatcataacttctcccaacctcatggtggttcatttggaggtggcccagggtgcagacctgtcctgcctcaagcatcactctctcaaggagaaaggggtgtcctcatccccatgtctaggatgatttgtttgcctcacactctcctttcagagacccggagtccttttccttcagagcctctctattcatcagtaatggtattggaggctttagctgatgaaggtctgtctcttccttgtttccactgtgtccccagctccaaaacagcaccagggaccataactgcaacttcctgacaccaaagtccatacttctctagaattacaaatttcagatgtaggtgaaaacagcctcttagagtattatagatggatattttaaaataagacaactaatttctttgggattacaaaataatatgtatgtattgacctaacataacatatcaattaccaaaaaaagttgtaaaacaccaggagttcacatcccagaaataaccatgatgagcatagtattgcctcattttgacctttttctctgcatatatagatatagaccaggcattctcataacatcaacttatttttgaatagtgtattagttaaattttacagtaatatactcagcatattttcaggtgaagtacctctaaatttaaaagcagtgggttcctttttttttttaagtatggggtcttgttctgtcacccaggctggaaggcagtggcacaatcatagctctaactcctgggctcaagctgttttcctgcctcagcctcccaagtagctgggactacaggcatgcacaatgcctggctcatttttttatttttttgtaaacatagggtctcactatgtttctcatactggtcctgaactcctggcctccagctatcctcccacctcagcctcccaaagtgctgggattataggtgtgaaccaacgcacctggcctggatttgatttattaatctgggaaaaacgtatacctatttttccctgaagacagtactgtgaacatctttccatattgttcaaagcacgtttccagcacatcttaaagctgtagagtgtctgcagtctactcatccagtcccctgatactggaatttaggttgcttctgtttcacacttcttttaacagtgccacattaaatatccctggagccaaatatttgcacaaatctttcattatgtcgttaggttgaaagcctagaaatagaattgccatcaaaaggagtgtatattttaagctttttaaaaattatatttatttttttattttgagatggagttttgctcttgtctcccaggctggagtacagtggagtgatctcagctcactgcaacctccccctcccgggttcaagcaagtctcctgcctcagcctcctgaatagttgggattacaggcgtctgtcaccacaaccagctattttttttttttttttgtatttttagtagagaccaggttttgccatgttggccagggtggtcttgaactcttgacctcaggtgatcctcccgccttagcctcccaaagtgctgggattacaggtgtgagccaccccgcccggcctaagccttttattactattgcagattgccctgtagaaaggtcataccaattcaccctcccacaagcagtgtatcagaaatgtctgtttgccaatagtggatgttaccttttaaaaacaatctgccaatttgttgtttatttaatccacatcgccagatagattcttaattctcctttttctccaactccaactccttcctgctgagacagcctctggtttgtgggtggagaacaaagcctgctcagtgtttggcatctgaaaagacaaggcttcttgctgagttgagggctttggtgcatgagtgtgtgtgggtgtgtgtgtgtgtgcgtgcgcgtgtgtgtgtgtgtatgtgacttccttctgcctttatatgggctcttaaaatgagaggagctgtgtcctttatggctgggtgtgtggaaccagacagggcacagagtggggagtgttgtggccgtgccccacttccccttatagtctgcatgccctccttctggccgccccacctggctctgcctctcaggggtgtcctgtctcctctgcacagcccctgcctcctccagcccaccacctgctttgccttgcttttgctgtgtttgtttaaaaaagcatggttgcaggagatgctgtcatgggtggggagaaccctgaggtcacccagctgtgtgggatccaaagagccaggacctgagaaggcagactctgccctctgccacagactgggagggagagggcagtcacggccgccagggacacaccgtgtgcccagaccagggcttgccgtaactaacgggtggcaggaaagctttgaggaggctgttgaatgaggccacctgggtcacaacagctttgctagtcaacccagagcagtatctcatttcggctcacatttctcgaacgcttactttgccccagtccttgctttgcctggactaggcactgggatgcagcaataactgtgcccttccctgcacttgaccgcctcaccacctagcaatagacctgcaggcataatggagggtggtgagtgctgcgcagtaactgctctggaaactgagaagaaggtgccatgagtccccctcccttgcccccaaggaggagggaggattaaaaggtcacagagaacagtgtggtagatgagagcagctttcaggctgacagctgtgggcagcaatcctgactctcacacttgcctgacatgaggccttaagggggctgcttaccttctgtgaccctcagtttcttcctctgtaaaaaggagaccatcacctccagtttggtatgtagaggttatgcaaggaaaatgtttagcactgcgcttagcacacagaagccaggggatatttcataaatgaggtgtcattcgagtctgacctttagtgtggtttgagttttccaggcagggaagggtagatgaagattccatccagagggaaggaagaggtgggaaaataagcagggtttgtggagagcagcttgtaaagtttgtcagggcagtcactgacctgcagcaagaccgtctgccacagttgtgaaggccactgctaaccaggacaaagggggagcatgggaggtctgtgagcagagcggtggcatgaccagatctgtgtcgagagagagatctggggctgggtgcagtggctcatgcctgtaatcccagtgctttgggaggccaaggccagaggtttacttgagcctaagaatttgaagttgcagtgagctatgatcataccactgcaccaggtggtagagcaagaccctgtctctaaaaggaaagagagatctagggacagtgtgggggcaagagtagggccattgccatgggtcaaggtaggacaggcagggtttgctgaccagttggacttgagaggtcagggagaaaaaaagaatagctgtctctccttaagataagttcagacaaaggatgggtgcccttaatcagggtggggaaggcaagatgcgaattagtttggcaagaggaggagcttggtgttgggctttctgagtgagtggtgcttagaggaggctaggagacaaggctgggcttgcctcactccctgtcgcccccacccagcagaaggaaggtcaacagaaggaagccccttctctctacttggctacacatccgcatcattctcttcccaccgcagaccagctttctctatgtttccctacacatcgtagggagatagttgcctccagcccctccaaacttgcatctcaaggactactagccacagacgcagaatgatcagccacctctgattcctggtcccacatatctgggagagaggatctgcctggcccagctctagtcaaatgtctactcccatcaactgtggaagggaggaagggagttgggagggagagaatccacctggcccaatgtgggtcatatgtctcccacggaggctagtgggggagaaagatgcaggatggtggtttaggggatactggggaggagactctcagaaaagaaaacaattaggcaggcaccccaaaggagttcgctcctgcaggatttcatcgttgttagtgctgctgctgcctgaattgcaggctgttgtatcataccagctagctatgctgcatacaaactgcccccaaattgaatggcttttcacaaccattacatctgacaaatttctgggtcagggatccaggaagggtttggcggggtgattcttccgtcccacatgacattgagtgaggtcacttagtggcatttacctggtggctaagctggtcttcagagttcaagacagcttcattctcatgcctggcaccttggtagggacagctggaaggctggattcagtcaagtccttcttcctctccatgttgactcagggcctctccatgtggttcttccagcagatggtctgactttttatgtggtggcttaggctgaaagagagcgctgccagttgtcttaaatgctagcccacagctggcatagcatcatttattctgttggtaaaagcagtcatatgccagctcaggttcaagagaggggaaatagaccctgcttctcaatgagaggagtggcaaagccttagtggctgtcttttatctgtcacatacatgatgttcgaaatatgggcaaaatcttttctttttttttttttttttgtggcagtcccactctgtcactcaggctggagtgcagtagcatgatcttgactcactgcaacctccacctcttgggttcaagagattctcctacctcagtctcctgagtagctgggattacaggtgcctgccaccaagcctggctaagttttgtattttttgtagagacggggtttcaccatgttggccaggctggtctcgaactccaggcctcaagcgatctgcctgccttggcctcccaaagtgctgggattacaggtgtgagccaccgtgtcttttccctaaaagtcactattacaaacaaaaattcgcctaactagaagttttgttctattttaaagtagatgaaacctcatctctctcccatagtgtcatagataaaatcacagttgaactcctttggggaagaggaggcaaacagaaaatgttggtgcagcatttatgtcagagtgtgcagtctgttgaggcagtgttgtaatgtgataaggggcttggtggaggggatttctttagggaaaaaaatttttttttctcaaaaggctaactatgacttttgagacttataaagtctcaaaagactttataagaggttaaaagggcaattgaaatgtaggattattttaaagacctacgtatttctagaacttcaactacagacctcttgttaactctgattcccatgtctacaacctaagaatgatacattatgtttagtgaatagtgattcggtatcacactgacagtacggtgcagtaacccaaagacctgttaattgatggtctaaactccagcctcatatttgacttatacgggaggtcttaatgtttccggcttattgccatattccatatgtaatttcctccattcctttcaaggggaaagccactgagtgttacccagctgccactgctgaccggttgcccacttcactgagggcctttgaagacagcggttggcggggacagtgttgaagtcctcttccctttacagaaccgtggctcttgaatgtccttctagagtagctcttggcattgctacctatggtcatttgctgctgccttgaggtccggagccaaaagtggttgttcccaaaagtgttgcataaacgtgaatcgtgacatggtactgaaagctgagcagagcagctggccatgccgccgcattcacagcaccacacaagcctgaaggtctgcatgctttatgcttgcaagatggccagcaccttcactaggcaaagagtagtaggtccctactaggtggcaggccctgggcaaagggacaaagataaataaacaacagccctcacctagtctgtttcttttttttttttgacagagtctcactctgtcacccaggctggagtgcagtggtgcagtcttggctcactgcaacctccgcctcccgggttcaagcaattctcctgcctcagcctcctgtgtagctaggattataggtgtgcgccaccatgcctggctaatttttgtatttttagtagagacagggtttcaccatattggccaggctagtcttgagctcctggcctcaagtgatccacccaccttggcctcccaaactactaggattacaggtgtgagccaccatgcctggcctcaacaacagagccctcacctagtcttgaagacctttaggaaaatcagcttcagcaaagccctgaaggtgagcaggacttggcctgtgccaccagcccctggccccacctacgcatgcactgtggtgctactgtttacctaaatcagaaagcccttatcgtgtcagcaagtgtcttttccagagctgagctccaggctccctgctgatgtgctcagccagaccagcccctcatctgcctctgaccctgtgcagctcctggcggccttcaagaaagcccatctgctggcatctcaggcatcttctcatgcttggcggcagcaggccctggctctgacacaaaatccacaatgagggccccaagctaaccagaccgctcttcaaattctgaaatggatcctaatcagctttcccaaagctgagatgttagcagacactgggagccataatttaaactttatgtgcgaggattacagtagccagccaaaccaccatgcaggaagaaaactttgaaatatgaaatgcttttaaaggaagaaaagtccaaatgagtcccctctcctttcctgcagctcctgactgggttggaagatgcctgggcctggcatctcttcaagacaatcataaaggcctgtttaggaggagaaagttaaattgctcagaggtgcaggagggataacaactttgtgtgtgactggcacctttaagaaataccttcagcttatataagccagcctggtttctgtggaaagaatgaagatgatggggtgtttctccttttgaagaaagacaccccccttcccttatttagggctccaagctcttccctccctgtctttctctctgcttccctctcaccctcctcccctccccagctctgtccttgtttgtttgcagtttgccaaaacatacaggccaccactcagtgaaggagagagaccatatcctccctcactgctgtcaaccaaggaccctctctctcccatttgacccttttgcaaaccgagatggtttggagcaaagggaagtgagactgcttggccagccctatggccatgtcttcccaggaggcccaggacctacttgctcaagtggcaaagagacaggctgcagaatgtgtttgccagccctctgaaaagggctgcctcaaaccctctatcagctggggctgttccaagagcctgctgctttaggactggctttgggctcatggtttttatttgagagcattacttctgacctaaggcagaaacacttagaaaacaaatctgtgaaatggctcagagaatgtgtaaggtttggcaacccctccagaggtcactgggttatcaccttcccttcaaactgggctgggagggcatccttgcttctcctccaaagaaaaaaaatgaacagacacatgcccatgtgcttgcacacacacccttcacactgcctcaattagaaccatgtgccaatgacattcagtgggggcttgtttatgcttgggagtaaatattgggctgatgttgcactgtcgacatctcgagacagagacatgctatgtaaatagtcaagtaactgaagagaactataaacatgaagtcttgagttagtccaaaaaaggaatttgtcccaggtcctcagaatcactgtctaggaagcaacccaaaggccgcggagtgggtaggatcccccaagagaccagatgtcatggtgttgtccagctggtccctctcaccctgcagggggctggggaggaagaggctgctgctgcagggtggataccccagaactcagtcaggcctcatgcctcacgcagcacccatctaagtaaggctgtttggggcaatctgttgtttccctaggagttttctggttgcttttggatacatggttatatgagaaaattgtgtatgtctgttacgagggttcagggagctgctctttggagctgcaggaccagcagacacaaaaaccagaaagcacactgttccttcggcttccagccaagcaaagcttggcttgagtcacctcctctagggtttctatgtttcttctgctacagatagaacagttaacagagccgcttgcccctcaaatggtgaagcaagcactggaaggttccagaaaaaatgcagaaaaacattgactccattggcttggaagtgagtgtggggctgctgggcatccagcttagcccatcattaatcatttcccagcaccttcagggtgggctcagctggcaacaaaaacagagatttgcccagtgtttctcaaagctctccccaaggcacccatgcgtgctcacatgagcgggtgtgtatgtctgaaggaggcctacttaaccttgggatgtgctaatttcccaagtgtagggggactttgggtcctggcagtaatggaataggtaggactggctatgaagtactatagcaggctgaaggggctcgtgggtttcctggcatgtgtatgaagagttacagatttagaccatgtatctcttaagcaaaggaactacaggtgctccttgacttatcatattttaagtcagaaatgcatttaataccccaataaacccatcataaagtcaaaaaactgttaagtcgaggtatggtaacttggggattatttgtacttgttagatcatcaaattcagagtcactatctttagtttagtgtttatctttagtctttagtttttatattttatctttagccattatctttagttgaagtcattatctttacttaaggggatgacaaaaaccttgctaaatttagtttttcacttcctcattcctgattgacattctattagaaaatgttagctaggaagacctgttctttatttattgacttgcatttattgagaactgttgggaataatattgtgcctctagggcatttagaagataacatgcttttttctggttcttgcaaattactttcggtgacttgttctcatgggttgcttattttgagtttttatttttagagaactgatattttttctgttcttgatgaggtaatcaggcagtctctatgttacatgagttaagagtcctagacttacttagcaagtcctcaattctgacacttattataagacatctgatccagagctgcatgttcaactccatcaagccttgcctactttcctcatcggtaaaattgaccttaaaatcccacagttcaaaagactataaaagttaaataagtgaacataactgcatgtgttttgtgaattcaaagacctcataatcttttaaaatattattaaattctgttttatttgtttctttcaaaaattaacagatttttaaaaattgaaaattgaattttcaaaaaatttctcaaaaatctttgagaaaaattgagatgggacaaagactctgtgccttgttcccccttagtgtgagtcctgagtacccagctgtgtggcccacagtctagagccttgaattcactttggggaaaacagaaaaagctgtcatgatgtttcagggctggaagaggtctgagaatcccattgatctcttaggcagagacgaagacactatggctcgaagccagaaaataaccttcccaggctgggcgcggtggctcacacctgtaatcccagcactttgggaggccaaggcaggcggatcatctgaggtcaggagttcaagatcagcctggccaacatggtgaaaccccatctctaccaaaatataaaaattagccaggcctggtggtgcagacctgtaattccagctacttgggaggctgaggcaggagaatcgcttgaacccgagaggtggaggttgcagtgagccaagatcgtgccactgcactccagcctggcaacagagcgagactccatcccccacccccccaaaaaagaaacaatattagtttgacagagccaccactagactatagggtacctttgtgcaaactataatagtaaatagcaccgcttcctaaagactctttacttccatctgtcagaaaaaattcagaaaactctgattttatgagaacaagacactctactgccatctgttggaaaacagttataataaacttatacacatacatgatatctgtgatgtgagtggtatcccccagccccttaaatgcagtgtagcacctgcactactgtacctacaactccctagccatgagagtgcattatgttttaagaaatggtcttcagactctaaaaaaaggaagacatacatcagtggtagctctgatctcccatccaagagattacgcataggctgtgttaggaacaggactggagaccctgcagtgttagagtggggcatagagcttgcaaggctgtttcagccaggggtgggtgggggtgattttcaggcctaatgctgacaccactccactgagagaaagaagcttgcttccgggtgcctgcaagagatgacagtgccttcaccttgttgttagcaagaattgcatacataaaaacttgagcacatgaaagccacatgtaagagtgagttcaggtgctctaaatcctttccagattgttaacacactgtctatgtcaaatccttacactagcatagtgatgagaaagtgagccagcttttgctcttagagatgaacaagagaagtctggttcaggccgggcgcggtggctcacgcctgtaatcccagcgctttgggaagccaaggcaggcggatcacttgatgtcaggagtttgagaccagcctggccaacaagatgaaaccccgtctctactaaaaatatgaaaattagctgggcagggtggtacacgcctgcagtcccagctactcgagaggctgaggcaggagaatcacttgaacctgggaggcagaggttgcagtgagccgagatggcgccattgcactccagcctgggtgacagagtgagactctgtctcaaaaaaaaaaaaaaaagtgaaaagtccagttcagcaaggcacactaactgatgctgtttaaatctagagccctatcagctgtctgtctgattcattaagtcagcaaaaaaaatattgagtctgtaccagttaacttatgctacttgacaaaccaccccagtattcagcggcttaaaagcaatatccatctatgcaggtcacagttctgtgggttggctatttggactgagctcagtggggcagtttgagctcagcgagacttacatgtgcctctgcgggcagctgggagttggctagtctgggagggcttcaaaaaaaactggtctcttagcaggttagacataggcatttgtgtggaagcagggcagggttctgagaaagtaattggaagtgtgcacagccccttggggactgtgtaacagacacaacatctcctccctctcatccaattgtcaaagctagtctcagtggagaatcaaggctgggaaaatagactccacctcacgatgggaagagctggagagtcacatggtaaagggtgtggagggtatgtgggcatctttgcaatttatcgctggtaccaaggacaggtgagatgctgagtactggggattgaaagcacaaagcctgccttcaaagagtcctaagacaaatgcaggagataataagggggcagactgttaagtttctgcttgatagtgccatggtagggaaatgtgacttctctggaattacaactgagtgacctgggattattgacacattacaacatcagcagccaaaggtatgtgctagagaatcctatttccctgttacatccttccacagtttcatgattacattctccttcatggcatgtgaccagccacatctggccatgttttcttagccaaccacatctttatcgcaaaagaatgacatttcaagcagtagcttcttagatttccattcagtcttggtccgtttttctggccttctgtgggtgtgctgtggggatgatgtctatgactttttcttaattatccagaaaattctggccaagcaccttttcttgcagaggggagaaggtgaagaggtttcaggagagaaaagtatatgtgtgggggcgtcagaacatggcattctgatgaatgtggtcttatgctgggaagaaacctccagggctgaaatcaccaggaactcaatatctgtttacaaaactggccttgaggattgaagctcagaacacaagactcttgccagttgttctaagaaagcttctgctctttcccagtcattcaaactgcaccaccttatcgacttcccctcacggtgaatgctcaggatctccttggcaacgtgggtgaagatacctgctggctctcttgacagttctcgtctttggcttggccaataaaccccctttagggaagtagaaagatggtggcaacagacagctcctcagctccacctgccttcccttcttcaggggagcttatgaccatcagggtggctgtgatgcttccctggatgtttggctcacagtgaagaagcatgaggacaaatacacagacaacaaaaacatttgatgtgcccatgacagctgggtttgcttcacgatttgtgtaggacacgtcttatatgtgcatgcactgttggcagcagactgcagagagtcttaagggttttccagtatgacttgggaattgcaagctgatgataccatggtaccacaacctgcagtgtggcaagcctaccagcaccaggtcaagtgtgtgtctctgtttgatttcctctattcaaggggattgaaacaatgatttgagggcaagtcatttatttggaaggtgatctcaggaaaaactgttggagagcagggaaggaagccaataaaagatttgtcatcaagctggttacctctgcaggcaagctccatggggaaactggtagaacgtacacctcagggttatcccacccaaggagagagggagctggggtatttgtacacccgatacagtcagccttgtttaaaggaagatgcagagaggaatgtctgacctcataaacagagcccaccaatgttagtgagccaaggacgagagatgccgagtctctcagagcatgggaggaaaggtaagctttgggctacaaacgttgcttcactgtttggtggtgatgactatgtgagaaaaactagacacttgtcttaccatatgtgaaaagttgtaagaccaaatgtaacatcaaagggcagggtcttttcagaactaagctagaggaaattgccatcctgggtcaggatgaaacgcccgttctaagtgagaatgtgctgctgactgtggtgcacagacagcacaaattccatgggtttgagagaaagatgtaaatgacagcaaggtagaatgcagacctgcagacgctttaaacagcctctcacgtgagagcagtatttattaaattattccacagatggctaagatctctcaagatactaggtttatcaaaagccaaataagcttggggaatgtcaggtccctggtttttttccccaccggaattaatggtaatggatcctttactttccactgtacattaagactctctaaaaaaaaaaaaaaaaaaaaaaaaaagccacacttcccaaacttatttgaccatgaaaccttttttttttttttttttttttttttgagatggagtctcactctgtcgcccaggctggagtgcagtggtggcacgatctcggctcactgcaacctccgcctcccaggttcaagcgattctcgtgccccagcctcccaagtagctgggattacaggcacacaccaccatgcccagctaatttttgtatttttagtagagacagggtttcaccatgttggccaggctgctctcaaactcctgacctcaagtgatctgcctgtctcagcctcccaaagtgctgggattacaggcgtgagccactgcgcccagccatgaaacctttttttactcccaaacacctttgaacagctctcagtaactggtattccccagcacacagtctggaaaacactacaccagatgcattttagaaggaacaaacagcttacgtaatatcacccgcaggaagtccatgcattttgaaaaatgtctccacaggatgtttttcttgccagtgttttctctaatccgaggggtcctccaagcctccccagccctgtgagtgcaggtcacacctacccagggacagactgccttggggtcacaatggctgattcttcagcacttctaactcagcttctctttctttctgcctttcagatgggcttctttcgccgaaggtacaaagaaattatcgaagctgagaagaaccggaaagagaatgaagacagttgggactgggtccagaaaaaccagtgagctgccacaccagtcacatgacctgatcactagcctgtcatccttggtctttgtatcttccatatttggaagaaaaaaatcttctccagatttttcggaggccccactgatgctgttctcttcttcattctatcaagcccaggtgccagcctgaggcagccacttcggccaggtcacacgaccggggccagcaccacttcctttaaagatgaactctgaactttggagagtgagctacagagccgagcaatatttatggatgcaacacgcatggtcaaccctcaggggaaaactgttacctaaagtatttttataaatataagccttttatactgattatgtcttttatatttgtatcgatgttttattatttctattaaatagttatataattcactcaagcactgatatctggcctaaaatcttggaagtacatgtccatgaatacaaattttaaaggatgaaaatcttaccgtactttggaacttgctgtttaaaaagacagatgaaataagttgaagaaacctcatgtaatgaatccaccaggctggcagtggtgcatataaactgtgggtgtggcaagaccccgaagacatttcacatctttatcgcctcgatcaagtgtggagtcacatgctaatgtgtgctaaagaactgtaagtgttttttcatatgtacttttcattggaagattcccaacaagaatttggatggaaaacctgatccctagcaagaagtctgctctgtatcacctttatatagcagacatgtcaccctgcttctacacagatgatggatgaa

SEQ ID NO: 36823 - DNA, 23404 bp, Homo sapiens
ttgtaacagaaaattaaaatatactccactcaagggaattctgtactttgccctttgggtaaagtctcatttacatttctaaacctttcttaagaaaatcgaatttcctttgatctctcttctgaattgcagaaatcagataaaaactacttggtgaaatgacttcttgtcacattgctgaagaacatatacaaaaggttgctatctttggaggaacccatgggaatgagctaaccggagtatttctggttaagcattggctagagaatggcgctgagattcagagaacagggctggaggtaaaaccatttattactaaccccagagcagtgaagaagtgtaccagatatattgactgtgacctgaatcgcatttttgaccttgaaaatcttgggtaagactatgctttgtattgtatatgtatgtatgttgtgtgaaaagtggtaggtgtgtgaaagagaacacatatatgtatatgcagatgataattcatgtccgtacatgcagtcgtatgttgaataagatcactttcacttttaattatactgcattgtgaattgcacaattatctaaactgggcattcacatgctcttttataaaccttcttaagcaccagattattaagttttcttttcaaatgtatacagactgagacaataaatagaaaagggttttgttttaaaatcatacctttaaagaaacagatttaatactcctttgcattgagttagtgtttggccactatgcttgcatataaaattgttagctttttaggaaattcactacgttttcaagcaactatgcttacggtaatgcataaagttctagttcaaaaaatgtaatgtttcaagtaatatttgttgaatgaaagcgtgattaaatatcttttgtcagaagacatcagacactttgggaggccgaggcaggcggatcacgaggtcaggagatcgagaccatcctggctaatgcagtgaaaccccatctctactaaaaatacaaaaaattagccgggcgtagtggcgggtgcctgtagtcccagctacttgggaggctgaggcaggagaatggcgtgaacccgggaggcggagcttgcagtgagccaagattgtgccactgcactccagcctgggagacagagcaagactccgtctcaaaaaaataaataaataaataaaaataaagacatcagacctccctgtgatccgaagtagcagacgtacttaacttccatggtggattgttgtagatgggataccagagatgagaactaaagacaccatctgaattttcagagcttatattttgctgatttgtaatatattgcatacaacgtaagcagtcataacatgctaggttaggtccttattaattatttttgccttcgtttacatcataatagctaccactgtggatataatatgactccacatatttgctttttaccacttctttctttctttctctttttgagatggagtttcgctcttgttgcccagtctggagtgcaatggtgcaatctcagctcactgcagcctccacctccgggttaaagtgattctcctgcctcaacctcccgagtagctgggattacaggcacttgccaccatgtccgggtaattttttgtatttttagtagagacggggtttctccatgttggccaggctggtctcaaactcctggcctcaggtgatctgcctgcctcagcctcccaaagtgctgggattataggcatgagccaccgcgctgggccgctttttttcttttactaaaaaatattctgaaacatctgtttttctcaggaaactgtgccaggtactgggggagtacacagctctatacaacttggtttctacccctcaaggagttggtagactactagctaagatataagatacatggccgggcacagtggctcacacctgtaatcccaacactttgggaggctgaggcaggcagatcatgaggtcaggagatcaagaccatcctggctaacacggtaaaaccccgtctctactaaaaaaaatacaaaaaattagccgggcatggtggcgggcacctgtagtcccagctattcgggagactgaggcaggagaatggcgtgaacctgggaggcggagcttgcagtgagcagagatggtgccactgcactccagcctgggtgacagagcgagactccgtctcaaaaaaaaaaatatatatatatataagatatgcacaggcacaactagccactgttctatgtgcttgttttctgatcaactctaatttgagttagatcactccttaggtttagtctcaacacagatcaaaacatggacactactcttaatagaaacatgcctcactttatggaatagatgtttttcagggcaattatactgcagtcatcctgtttgtatcaaatcatatttttactagcataaattttaatttgagaaatgctttatcttcatgactgaggttatgtcaacacaattcatgcttatctattgacctaagagagctgttaactaacttctatattacaagtaagaatttgttgaaggataacttttagtcggcatattaacttcccaaataggtgtgaaatggactggggtgagtttatgagcacccagtagtatgcatttcagtgagcacagtcttttcacttaaattcactttctgctccttactgttaacactgttcagagactagactgttcccagcgtggttgaaaaattataaaatagataaactaattaacttctcccatcctgcctctcccaaatttattcattttcctatattcctcatctcagtggtggcatcattatccaccaagtcccctgtgaaaatcaccctagaaccttcccagtcctttgtctcccacgtctagtgggtcactaagtcctcccaattattccttgcaagtacttcacaaatccagccttcctctccagttttactaccttagttgatttcctctgtggacagttagaatagcctcctaaagggtctctctgcatccagacttgctctgacccttcctgtcatctattttccatctgatacctctaggaatcatcctaatatgcaaatcttatcatgtctctcccctgctgaaaattctttaaaaatgtatccagaatagatttaatcaacttagtatggctaatgcccttcagaatctcactcttccctattcttcatcccttgggactcttccaatgggagctcaactgcaggcatgagaactcaaaagtgtccatctttttgaaaacttccagacttgactctgagcaactgggtagatactagcaccatttactcaaatgcggaagaatgatatagaaccaaaattgtcgggcgcgacctcagggggttatttcatgaattaacttttaaaatgtataaatatccattaggcttggtttgcatacaataggaacctaagaatagtggtttaaacaaataagggtttcttgttcacaaataataagtccagaagtaggctgtccagggctgatggagcggccacatgatatcatcaatgccacaggctccttctaccttcccacagcactgtctcaacatggccccttccaccttcccactgcaccatctcaacgtggccctttccaccttccccctgcaccgactcgacgtggtcccttctaccttcccagtgcactatctcaagatgccggctttgtcctcatggtttttgcttcaaagtcacaaaataactactccaccttcctgatctcattccaggcaggaattagcccattgtacacagtaggtcccttgaagatactagcaaaaataaccaaggaatacaaatagatggaattttaggaaaatgtggttgaacggtttaatgaggaaaagtaaatgaaaaacattattatatctagaaaaaaaatgtatcttaaccattgtgggaagtggggagagggtagaggcccatttgagaatggaagaaaaactactggcccttgtgccagaaaaaaaatacatatatctgtacctgcaaacttgtggcctttttggagaggttagactctgaaaactctgtccctggacctctagtggttcctggacctcaattaagaatctctaattaggccaggtgtggctgctcatacttgtaattccagcactttgggaggccaaggcaggaggattgcctgaggccaagacttctgtaaccacccagcaagttctcctcatccgctgcccagacagagctgatttatcaagacaagggaactgcaataaagagtttaattcacacagagccggctgtacagaaggccagagttttattattactcaaatcagtctccccgaaaattcagacactggaatttttaaggataatttggtgggtagggggccagtgagtcgggagtgctgattgatcagattgaaggtaaaatcatagggagttggagctgtcctcttgcgctgaatcagttcctacgtggggaccacgagaccagataagccagtttatccatctgggtggtgccagctgatctgtcaactcagggtttacaaaatatctcaagccctgatcttaggttttacaatagtgatgttatccccaggagcaatttcaggaggttcagaatcttgcggccctccagctgcatgactcctaaaccataatttctcatcttgtggctaatttgttagtcctgcaaaggcagtctagtccccaggtaggaagggggcttgttttgggaaagggctgttatcatctttgtttcaaagttaagctgtaagttcctcccaaagttagttcagtttacacccaggcatgaacaaggatagcttggagattagaagcaagatggagtcaggttagatctctttcattgtaataattgtctcagttataatttttgcaaaggcagttttagttcaagaccagcctgggcaacagagcaagactgtatctccacaaaagataagaagattagctgggcatggtggcacgcacctgtagtttcagcagctactcaggaggctgagatgggaagattgcttgagcccaggagtttgagggtacagtgatccataattgggccactgcactccagcctgggcaacagagcagaatcctgtctcaaaaaattaaaaattaaaatgatctctaattagattatgtgagcccctaagtgactatatttgtgcactagaattagctaaagtgggggaaaaaaagatgcatttgatggtctagtcccataataaataacccagtgtaccataactactaagaaactgttcattaaattaatggatatgttgcgttcaagattgaaatcaaatgataaattctgtttgatatgtcctattcatgaccagccacataaatgcacgtattacttcgcaagcatgccaatgcaacattagttatatggaatcaaatgaagaaaaagaatgtaagttttcatatataaacatttcaggtaagtttttacttaccacacagatttttcatattaaagatttggcgactggttctttttacactgtgttcttattatatgtttatattatctcaggcacagatgttgttcatctttttctttctgcttataacagcaaaaaaatgtcagaagatttgccatatgaagtgagaagggctcaagaaataaatcatttatttggtccaaaagacagtgaagattcctatgacattatttttgaccttcacaacaccacctctaacatggggtgcactcttattcttgaggattccaggaataactttttaattcagatgtttcattacattaaggtaatgttaatgttattaatttataagttagcaaaggacttgtacttttaagtcaattatggatgtgagacaatcagaaaacagttatgagggaaggtgcaagagaaatggggtttattccatagccaggcttggtggttggggggaaagggtgctaccagaacacagaggcagtggtgagaggaaggagaaaaagagaggaaataagtaaaataataaacacaattaataaagtaataaaacacttgtggattcttgtgtctataaaattacacgttttatccagacagccaccagatggtggggtatttgttaaaaccaagtaaaattaatattaaaagtttaaatggtatggtcaatttgttaaaaccaagtaaaattaatattaaaactttaaatggtatgggatctcaattacaaggttttaggaaacttaagaaatagtcctttaacgtagactaaagcccagtgataaaaagattgcctccctttagtcctgccctcgtccccatttgatttagacaccccagaatacgtctaatctttcagtacttcataatcattttaaggctcagaaatctcagagaaaatttgctagaaaatagcaaccaaccagaaacacacataaggaactgtatgcttatttctgtgtactagatagccttccttcctgagagcaaggatgattgagaggaaagagtgtggcctgtgctcagatcctgactttctccttcactaaccttagacaaaacacaccattcccaaaaccttgcctccttcattttataaaattggtgtcataacaaacaacacttacccataagggtactcaaagccttaaatgacataaagtatttaaaacatttagcctcatacctggcctatagtaaagattattatttttgtttcccttcagttttggacagtaactgggtagtggtcctggtaggagatcataatgtagcgattctttttttttttaattttttttaaattttattactattatactttaagttttagggtacatgtgcaccatgtgcaggtttgttacatatgtatacatgtgccatgttggtgtgccgcacccattaactcgtcatttagcattaggtatatctcctaatgctatccctcccccctccccccaccccaattcttcattgcctattgaagagagagcggaatgctttggttgccagatatggaagcagaattgctgacactttgttatccaaaccaagaggcctgtcttcaattttcatgcagataagcaggaggagggggaatcacccaacatctgtagagagctggaccacaggaatagaaacagaattgtttaagagaccaataccaagctaaatagttagtgtaaccagtgatgaaacaaaaatcaccacatccattaagaaagaacatttatttcatgttttttgatcatggttctggagaactatttaatgtatattttacctggaaagacactgtataattcaattgtatatgaatttcatattgtataatttatttgtatgttttcaaagctataataccattgggttttaaagtatttcataaagctgtcttaccaatcttagttgatgaagtaaaacgtattgaaggtattattgactctgttgaagcaaagagaacaaaacatacggtttttacctaagaaagacgtttttgatttttttcagacttctctggctccactaccctgctacgtttatctgattgagcatccttccctcaaatatgcgaccactcgttccatagccaagtatcctgtgggtaagtcatagttcccactgtcataactcaataaaatatgtcctagctgaaactcagagaaatttattttttatcttattttatttttgagacagagtcttgctctgtcacccaggctggagtccgatggtgtgatctcagctcactgcaacctctacctctctggttcaagtgattctcctgcctcaagctccctagtagctgggattacaggcatgtgccaccctgtaatttttgtatttttagtacagacggagtttcaccatgttagccagggctggcctcaaactcctgacctcaggtgatgcacctgcctcagcctcccaaagtgctgggattacaggcatgagtcactgcctggccgagaaaattatttttaaaaaaacatttacagctaccttccatatccttaggcttataattgtcaagtaacaagcaatttagctccaggcaggctctaattgtaccgaatttccccaatttcactgagcagctttctggttttgttcatgttccctttgctgtaatgcttggcccttctatttagtctggcacaattcttctcattctcaagattcagttcacctgtcacctcctatagaactttccctgaccctcctctatagcattaattactccagaaatgtgtacatttgactaatatttatagtgtgcctaccagagaccaaccctgtgctaggtgcgggggacagaacaatgagcaagacacacagtctcccctcaaacagcttcgtatgtgatgagaaaacagacaggtaaccaggtaatcactgcacagagtgataaatgctaaataggggcaattacaggagactggaagagcaggaaagacctaacccagtcttgatggatcacagaaggcccaaagaagtgggatccatcttgaggttgtgtatgtgtatgtgtttgggggaggaaaggaaaaaaattgagagcagtcaacaggattctagacaagtgtcttgaaattatctgtgatgaaaggccattgctgatttccaatctgctatagagcaatacttttgtaaaatgtaatttaaaaatggatttctagaaaaacgatcacatacttgaatattttagcaatgtcaaattgctataaaagtttctaaacacttactttaatttctgtacatatctcgcctgggaccagcagcagacaattggtggaccagtccctgtcctcagacaatactttgaggaaaaaggaatatcatatacaagggccccaaacccctaactgatgacatgccatacttgatacactgtgttctccatttatcttagcactctctgttccctatccccttctgcaggctgataatgtatgcttactaaatattagctcaaattaccagtaagtacacaattctaacttataaatgatcatcattcacagtagggttttgttttgttttttttctggaaaagggtctcactctgttgcccaggctgagtgtagtggcacgatcacagttcactgcagccttgacctcctgggctcaggcaatcctcccatctcagcctcccaagtagcttgaactacaggcacgtgccaccacattcagctaattttttattttttgtagagacaggatctcagtatgatcaggtctcaaactcctgattcaagcgatcctcccaccttggcctcccaaagtgctgggattacaagcgtgagccaccacacctgtacctcattcacagttttaatcacacctatcccacacagacttatacaaacttatccattccttcccatgcaggttctataactataaccatatataaaatactagccaaccaggagaatcgcttgaaccccggaggtggaggttgcagtgagccgagatcatgccattgcactccagccggggcaacaaaagtgaaactccgtctcaaaaaaacaaacaaacaaaaatactagccatctaacactggaaatacatacattcatgagcttgtccggagtgatcagatttgactggatcagaaaggcaagggatctgtttctccaaagtgcttgtgctaccagtgacctactccaggttgttttctgaccctctccttatcaagacctgtcaaagatctgagaaattttacccgacttacaagctaaccattagcctagcacctctgagtggatgccagtagaagacacaagactcctaaaacagagacaaagaatagattattgacagtagtaatagcagagtgtcagcatttctgcaccattacccaagctccagttcccacagggtgacatagagagagccagatggcagctatccatgccagtggttgcattctaggagggaacctttttttttttttttgagacggagtttcgctcttgttgccaaggctggagtacagtggcacaatctcggctcactgcaacctccgcctcctgggtttaagcaattctcctgcctcagcctcctgagtagctgggattacaggtgcccaccaccatacccagcaaattttttgcatttttagtagagacagggtttcatcatgttggccaggctggtttcgaacttctgacctcaggtgatccacccgcctcggcctcccaaagtgctgggattacaggcgtgagccaccgcacccggctgtgaaccttcatttttataatgggcagtaggcacgagtgccctttgctccagggaagaccccattcctaacttccaaggctgttcactatacagacatccttgaaaagatcatctggaacaaaaatagtccgtgtcttgctcatgagacttgcagatatgcagaagatccatgaagaatcctctctccacatccctcttaccacctgctttgcaatagacatttcacgagctgtttgtcatctattcacttgtttatcctgccagttactaggctgtgacttcatctttaccttctggtaacttccaacatgcagccccacactctcacacaccctctcaaacaccctctttcttctctagtccattctctttcttgagcgcctcattagcataattaattatctgcagactacactacaattaaaattacaacttaaaatattttttgttaaatctcagatggtttagccaggagtaatgtaatttaaaagcaggttggcaaacaatataaataaattaaaatctaaaattattctggaaattcaagtagtgatacttttgtgcataataaaaggatctttatatgccatctttggtggccctattgtccaaaccaaaaattaatttttcgatacaagatctcatatcagagcagaatatttagattgtaggacatggctatggcagagtcaggggtggcgttgaatgaataataattacacaaataactttcctaagtctcaaatgagaccacggttaatctgagaaagttaggagagggctgtgtccagtcgctttcccatatttgtgtgtgtgtgtgtgtttatgtgtgtgtgtgcgtgtgtgtgtgtgatcataagagtggctgcagcaaactgcttctttctaggataaggtttgcctagaatgatcctgtcacatttcttcttccttgagaacagagtacaaaggtggtccttgtaggtgcctactagaagttaaagcaaaatttgtatgcagcaatattcttagtgtattataaaatgttgactcagaaagattgtctctctaatgttaaacatgcttttttcccagtgagtgcatgatataaaatattccaaataaaacagcaaagttggaaggagaacatataacatttctaattatttacaatgagcttaatactccctcatattgaaatattttaaagatttggctcaacttgtaagggccaaacatatcagcaatgtttgttctggctaagagtagcattgcctacaaatatcatagcctaagattgatatttgagagtttggaaatcttaagcttttatttggtgtcacagagaaacaggatctgtatctcttattgctaagcctttgatttgtttcagctaattgcctgtatttggatatttagcttactctaattccttacttcaagtattgatacttttgtgcataataaagattccttcattcttaaatcattgactaggggattattatgattgacttaaactattcaacatttactcttgaaatggagagaaatttacctaccttgaagattggaagcccaactaatatcaggattctattagaaacaggaggaaagtgaaatggatttggggtaggcaaacgacaatgtattctatagtattcctacagacatatctacaaacacactttttcacatatttgtgtaagtcatttatgcacagatgcataccttagccacatttatgacaccatatacttaaatatatgttcatacatatatgcaagaaacctaagcacaacaaataaaaaatgatgcaagagaataagataagattttgtgtattgggaaataacagaagcgggtgaaaacaagatgagtgtaaaagaatgcagtatgttaatgggatggaagagaatgagggtagtgcagttggggtaaatggtttgccaaatagagaaggtgatgactggggagatgactttgtgggagacttgaacaggaaggaagggtctacaaaagtagtttaaagaaagagtattttgtagatgtaaggatggatgcttaacagccacacaaagtagacctaatagtacaggcatcatttcatatgagttagaagaaatgaacacaagttttttcctgcataaaattaaaaccaggccaagcacgacggctcacgcctgtaatcccagcatttggggaagccgagaagggcagattacctgcggtcaggagtttgagaccagcctgaccaacatggtgaaaccctgcctctactaaaaatataaaaataagccaggaatggtggcccgtgcctgtaatcccagctactcgggaggctgaggcagaagaatcgcttgaacctgggaggcagaggttgcagtgagcagaaatcacaccactgtactccagcctgggtgacagagtgagactctgtctcgaaaaaataaataaataaataaaaccattgcactattgtgttaggatggattgctaggttaagggcaaaatcattgctcaagggtcacatagattgtcatattgactgaaatccatgattcatctagtctggatttctgtgaaatctataaaaatagatgtccttcctcccgtcacagctaaatgttagatcttaacagtttctcttcaggtccacctattattttgtcagcataaacttgttcaccttttttactatgttatgacttttaaatattttagcaatactgaaggaaatttaaagaaaaaagaccacaagagtttcctatttctaacaccactgattttttccatgttctttcccagtctttattcactatgcatctaacttaaacatgtaaatgttctgcttcacgttttgccaaacattatgtctcaaatattttccatgatgctacatggtttacctttttaataattttaacaacataattctaaatcttgatacattaaaatgcttagttttataatatattttcatacttatataaatgtgactatctctccttctgtacctaggtatagaagttggtcctcagcctcaaggggttctgagagctgatatcttggatcaaatgagaaaaatgattaaacatgctcttgattttatacatcatttcaatgaaggtaagtaataatgaaggtaacgttatcaaacttaaccaccaaacatttaaataacaattggaacctgggtcagatttgccatgctaaagatatgaagtgctttttaaaatttttattcacttcagctattccccaatggccaggatagacacattcaagaaaagcagctgccaaataaagactccacattaaatccttatttcctgctaatctccattttaaaaagaaaagacgagaaaatacaaatgcccagtaaacatatgaaaagatgttcaacatcactagtaattagagaaatgcaaattaaaataagaagtcacttcccccattaagttgggaaaatattaaagtctgcaaatatcaagcgttggtaaatgtgtaggaaaaggggaaactctcattacctgctggtgaacatataagtgaacatataagttggtaaagacattttagaggataatcttacagcatccacttcttaaaacacaccaatcttattacccagcgattccacatctcaaagaaacacaagcacaagcaacatgttgtttacaaagattgttatcgtgcatcatttataacagcaaaagaatggaaacagcatgaatgtccacctgttggtggagagttaaataaactaacatggaagaatcttcaaaacacaatggtaattagcagaaagcaagttgcagaccaagacattcagtacaccaattggctttaaaataacaataataatcatcaccttctaggatacatatatatgttaacacatcacagggaaagtcctagaagaaaacacaccaaactgataacaatagttaccggggacgggaggcaaaacccaggctaattttgtcttaattatattcaataagaataatgtatttatgtattatttctgtaattaaaaattaattaaacggggactggtggacaaggtgggtatatgcagctctatgcactatctgctcatttatttggtaaatctaaaactgcactaaaaagtctattagttataaaaaaagtttactttaaaatggaaaatagttgcttaaaatcaaagagacattctatgtaaacaattattccaacagactgagttgaaattgttgttgaggaatgggcaattataataacagagggggtgtgtacttcggtgtctgtggggagtgaattcctcaacctcagatcgtgcgcaccccactgcaatcacagacattcgttttgtgcttgggaatcctttgactccaaaatcatgaaaactgaaaatttgctttttaccatctttgtctgagggcaggttctatactgtctaatggaactggttttgagaagatcacaacatacttacaataaaccctctgaataggaagtgtgggactacaatatattaagaagtgatacattcagatagaaggccacaaatctgggtggaaaacgtggttggttttcagatcatagtccatagaatcctatcacaacggtggagaaaagcagttcctggaacaccccaccccttaaccccttatctctgcttcaaccagagctcttctgtgtaacatttcatttaagcaaaggattcggcaaatcaaaaattgtcaaccacgattaatttagactatccagcttggtggattttcaactgagcactcctatccacagaatgctgacaaatgaatcatagccgccatgtgaaaagtctgaagaagtgtgtagaagggcttcattcttgactctgtcctactcagaactgtagttagtgacttggataaagacatatgcgacatgcttagctaagtgacaggtctcaggaagatagcaggaaaacatcctggttgagaaggcagatccaagaagtcctgacaatctttaacaattgtttaaaccaaatgtttaaggttaacaacatcagggaccaaagttttgttcttatgtttaaaaaaaatcccagaataagggaggtaatggtcttttttttctgccttgaataaacaacacttgagaactgtaaataaattctgagtccgtaatccaggagaaacatctataaagaggaatttagccaaggagagcattgagaatgttgaagagcttgaaaatcataatgagaataattcctggccaggcgcggtggctcatgcctgtaatccttgcactttgggaggctgaggcaggcagatcacttgaggtcaggagttcaagaccagtctgggcaacatggggaaaaccttgtctctactaaaaatgcaaaaattagctgggtgtggtggcatgcgcctataattccagctactccgaaggctgagacatgagaatcgcttgaaccaaggaggcagagattgcagtgagccgagttcatgccactgcactccagcctcggtgacagagtgagactgtctcaaaaaaaaaaaagaaagaaagaaagaagtctacattagaaagaaattcaacacattttctgtgacccagagggcagaagagaatcaatgagataaagttatctagagacagaaatttttttcttttgttttcttttttttttttttttttgagacagggtctcactctgttgcctaggctggagtgcagtggtccaatcacagctcaatggagcctcaagttcctgggctcaagcaatcctcccacccagcctcctgagttgctgggactacaggcgtgcaccaccacacctggctaatttctgtggtttttgtagagacagggttttgccacgttgcccaggctggtcttgaactcctgagctcaagcaatctgcctgcctcggcttcccaaagcattggggttacaggcctgcgccattgcgcctggcgagacagaaatttcttattaaaaaagctgagcagcaatgaaacgggccacactttttgaggctgtaagaagtcatcttctgcatctgtaagatggccagaacaatacggagaatactcaaacatagatggaagttaggctttcaagactccttccaactgtaagtagcaaaaacatactcctttgtgttctatcagtttttactttcttcctatccaactttttggtttaaagaaatgagatctggtaagttcccatcttcatcttggaaggtgtggtagattttaattcttccctttcccgcgtccacatcctggcagtgtgatgtttcatatccttctgttcagagatagagtctatttttccacttctggaatagctggcttgcccatgtgaattgttttgtgccatagaagaggcttgaaaagcacttgcacattggagcttgctctcttcctgctcttggaaaccctgtacgtgtaccattatgtacaacagcccacattggcctgctggataatgaaagcctttgaggtggaaaactcaggcaccctaacagacagagtcatgcaactccagctgacagcccatcagacataacagtaaggccatcccataggatccagcctccaggtgagctgtcagcttaccacaaaggcaggagcaaaacaataaaaaaaatccacaaagccagtgtagacggaagaaactttccaaccaacccacagaatcatgaactaaattaggaggtggttgtttgaagccactaaattctggggtagtatgttatgcagcagaagctaactgatacagaagtgatcactgggcatacccattctaactctgctctaaaagcaaaggaaggctttcctttgagttgtgaccataacacgctgtgggccctacattggaccaaacgttcatcctgtttgctcagagatagcctggtatatgcataaactactccttttccaagtttctgggaattgggttgaggttgctgcatctttggaagttggtctccaccactggcaggctgcctgcatcacaagatctcattactcaggagctgtccaagtgtctaatgtacttagttaagaaaaagaggctgggcatggtggctcacgcctgtaatcccagcacttggggaggctgaggcgggcggatcacaaggtcaagaaatcgagaccatcctggccaacatggtgagaccccatctctactaaaaatacaaaaattagccgggcgtggtggtgcatgcccatagtcccagctactcaggaggctgaggcaggagaatcgcttgaacccgggaggtggaggttgcagtgagccaagaccacgccactgcactccagcctgggtgaaagagcgaggttccatctcaaaaaaaaaaaaaaaaaaaaaaaggaaagaaaaagagcacgatactgaagtcacctcagttgctggaactcctcctgaaaatatgcagtcataaaacatcatagctggaagggtcctccaagataagctaatccaataccttcatttgacaggtcaagaaagcgagcctcaagaagttaagcatcttgttcaaggccgcatagccaggggattagagcccaggtctcctgacccctaaacctagattctttttctctcaaactggctttttcagttctgttttctacctctggccgtcggcgtgtttgtggacagagtgctgataggaatcattcaaggacatcttttggcctagtgctgtttatgaacatccttaactaaacgttatctgttctccccatagctgtcttcattttgttattgttgctgttgttattattgtttcttccttacattgttaacttccctttttccagattttttttttttttttgagacagagtttcactcttgttgcccaggttggagtgcaatggcttactgcaacctccacctcccaggttcaagagattctcctgcctcagcctcccaagtaactaggataatcccaacctgggtatttttagtggagatggggttcaccatgttggccaggctgttctcgaactcctgacctcaggtgatccacccaactcggcctcccaaagtgctgggatgacaggcatgagccaccacacccggcccagagatgtttttagttgccattgatacatattgtttttgtcataggaaaagaatttcctccctgcgccattgaggtctataaaattatagagaaagttgattacccccgggatgaaaatggagaaattgctgctatcatccatcctaatctgcaggtaacatttgttctttctttaaaatgttgaaaataataatgctgtacctttgaatagaagtttatagctcatacagcacttcgcgtacattcgcccatttgatgctctcattagacactgagtgtagatagggaagatgttcggactgtcgctcaataaatacttattcagtgtaacctgtgctggctgtgtggacacaccagtaagtatggcctgcacgctcaatggaatttatagtgtaggtacacaaaagtctaactttagtctagaaatgaagacagccagatgagatgacagaataatgagatgggagaggagtggtcagacaaggccacttagagaaagtgaaactcctacccacattcagcgggtgggaattatgatgtctattttaatataaggaaatacagggacggaagttagaaccttcccacagccatgtagctatcaatgacagatccagagttagtgctctttcaagttggccgcatcacttgctacctccctgtgacagaataagttagagaaaaacgactggaacctctttcttctgccaccattccccaactctcctcagaacccccagaatctactccttgcctagttttatcaataatgacatagtgaagaaggaaaaaaaaaaggctcttgagagaatgtaggaggtttaaatccggaaaaggcaaagggaaaaggagagaagaacagatttccaaagccaaagtatccattccccagtgcaagtggcctgcacactcccagacctcagagatggaagagaactggtggattatctagtccagggctttcaaccccgactaacctttacctagagagcttttaaaaaacatcataatagcaatggcaggactccactctgagatactctgatctttttggcttggataatcaggattgaaaaacactgattgatccagttcctatccctgtttagtgactctaatagtcatccagacttgcaactgaatgaagtggcctgcccagtaatacagacgagtgaagcaaatcctgctttgtggcttaatgggacccaggtggaaacctgaagaagcagccttaggcagtgtttgtttttgtttttgtttttgtttttgtttttgttttttgagatggagtctcgctctgtcgcccaggctggagtgcagtggtgcaatctcagctcactgcaagctccacctcccgggttcaagcaattctcctgcctcagcctcccgagtagctgggattacaggctcacgtcaccacacccggctaacttttgtatttttagtggagatggggtttcaccatgttggccaggatggtctcaatctcctgacatcatgatccacctgcctcggcctcccaaagtggtgggattacaggcatgagccaccttgcccagccttaagcagtgttttaaaggaaaggtaaagactgggggagagaaaggaagaaagcactattggtgacaaaaatatcaagtacaagaaacagaggccaaggtgatgatatcatggcaggctaaaacaggatttttcaggttttaggatactcttgaggagtacaaaaataatcccaggcagacggagaagtgagatgaatgagatcagtagcaaactgggctagtggtaggtctcgaaagttaggaaggatggttttgatttgacagacaataatgaatggctcagtattctacaggagggattgattggttaattctgccaacaaatatttttgaatgacaactaagctcattctgggccttgagattcaagatagggaaggttcctcatggagcttccatcccaatgggtgaggagaactgaccatgaataagtaaacaatatgtaaaccaaatcatttcaaactgtaataagtgctgtaaaagaaatacacaaaataatatagcagagggtataacaaagggttccaattagacggagtggtcacaaagtgccatctcagagatggtggcactgaagttggaacctagaagatgagaagccagccatgtggaaggcaagtgagaggccctgaggctggaacaaacttggagcatctgaggaacagcaagaagacccatatccctggagaggaggagtgagcagaggacggtagagcctggagaaaacacagttcaggacccggttatgagtctagattttgtcctaagaatgacagttcttactaagggatgctaactggaatcacgtaggggaccccctcccagtgcctagaacccaccacaaactactaaagtagcgcttctcaaacttgagccacatgacaattatggggagctttttaaaaatgctgattcctggccaggagcggtggctcacgcctgtaatcccagcgctttgggaggccgaggcgggcggatcacgcggtcaggagatcgagaccatcctggctaacacggtgaaaccccatctctaccaaaaatacaaaaaattagccgggcatggtggcaggcgcctgtaatcccagctactcgggagcctgaggcaggaaaattgcttgaactcgggaggtgaaggttgcagtgagctgagattgtgccactgcactccagcctggacagagctgagattacgtctaaaaagaaaaagaaaaaatgctgatttctgagtcctcttcccaggggctctgatctaattcatcagggtgtagacagggaatcaattgagttcaccaggtgattttcatgtggctcaggtctggatagcactgcacaatgtcggaatctccacaggtggggctagccagacgtgtgttgaagaggttcctttagtgattctggggcaagtctctgcctgaaaaaccaccggttcagagaaatagttctcagccgagccaccctgtaaatcatctggggcctaaatacaataaacacagaaaacagtgaactataaatgggtagcatgagggattcgaggaggtggctgaaagaagcacgtatcctgatggcatggttgcgggttatatgactccatgctctgcaagtcagaactcatagaactgcacacaaaaatgagcgaatttcactgtaggtaaatttaaaaataaaatataaaaataatgatgcctaggccctcctctcagattctgatttgatttatctgaaatgggccagcccctctacctgtatatatgtatttaacatcccaagcgatcataatgtgccaccaggatggagaaaactgcggtgatgcggcacttcccaaacactaatgtcgtgcacgtgaacgtcaaggacctgttaacatgaagattttgatttggtaggtctgctgcgcataatgaaatcctgcttttctaacaggctcctgggtgatgcggatgctgctgggaaatgttagacatgcagaatcccaggcccccacccccaacctatagaatcagaatcttcatcttaacaaaatccccagatgatttacaagcacctcaaagtttgagaagaactgttctggggttcccgtggtgtgacagccatggtgcttgagggctcaaaggtccaaatccctggtgcgggacccttcagataactcagttgttaccctaatgtaggagcacatttggaatacacccaccttgtcccagactctccccagcccagcaccaccttctctcaccaatccccgtcagaatagaatctccttgtatgcaggtacaacatggctcatttttatatttcccaacggtagaatgtcttgcacacagaagactcctaatggatatttcctaaattttgctgaacagaatttaacttgagctggcaacaggcagactatgcacttaggtagacatgcatttagttttgccttttaatattataaatctctttggctacattcaaggtaaacctggtattgaagcaaactcttttttatttttttttagagacagggtttcattctgtcacccaggctggagtgcagtggtgtgaacatagctcactgtagcctcaacctctgggggcttgagcaatcctcccacctcagcctcctgagtatctgggactacaggcatgcaccaccacacccagctaatttttcgtattttttctagagataggatctctgtgttgcccaggctggttttgaactcctaggctcaagcgatccacccacattggcctccccaagtgctgggattacaggcaaggagccactgcacctggctgaagcaaatgttaattacacgtttcaattatacaaatgcaaaggggaactcttaaaactactgccaaaattcacgacccaatgtcagcgcagtcagatcacttgcctgcatctcaatgcctcgctcaagtatctcttttaaaacaacagaatactgtaatttgttagttgtctagagtctgacataaatttttagaggagaaaaaccaaatataatatatttattttgattgtttcctgagaggatcaagactggaaaccactgcatcctggggatcccatgtttttaactcttgatgggaagacgatcccactgggcggagactgtaccgtgtaccccgtgtttgtgaatgaggccgcatattacgaaaagaaagaagcttttgcaaagacaactaaactaacgctcaatgcaaaaagtattcgctgctgtttacattagaaatcacttccagcttacatcttacacggtgtcttacaaattctgctagtctgtaagctccttaagagtagggttgtgccttattcaactgcatacatagctcctagcacagtgccttattcggtaggcatctaagcacatttcttaaattaattaatatatctttaaagatatcatattttatgtatgtagcttattcaaagaagtgtttcctatttctatatagtttattatacatgatacttgggtagctcaacattcttaataaacagcctttgtattcagaatataaaattgaaatagatatatataaagtt

SEQ ID NO: 36824 - DNA, 175382 bp, Homo sapiens; identical to SEQ ID NO: 35898

SEQ ID NO: 36825 - DNA, 12762 bp, Homo sapiens
cacgcacctgaccacgcccacgagccggctcgaacacgcccgcgccgctgactggcgggtggggttgtcgacacgttcaacccgttctgctggctcgagaacgaagtaggccgtctcgctctgggtctccaggcccgcgaccgtccgccagtcgtcccgaggtcagtagctccagcggtgcgtcagcgtctagccaggcctcgcccacgccggccttggtcgggcttcttgtagacgcgggcctggcgctattgaggccgttgctgcgcgggcgagtggcgcgctcccgtggcggggcggggtcgggcggggcaggggtccggggctatcgaggcggggccgaggttgcgctgggcagctgcgccgccgggcggacgtggcgcgccttgaggacgtcatcgcggtgcacgctcccctttggggcttgccggaagtccttgcccggggcgcggggctgcgcctgcgtggttcgtcctcacgtggccgtcaagccctctagtgccttagattccagcgagctacgcaagcaatcctggcccagccgagcttgcttccccaaatcccgtaatccttgaccttattcccccaaagaagcggcctcccgggaaggagcgccctggcggagaagactcgaacggctcccacagccgggcgttgggggaaaggtgggcggtcttggtcgtgcgaggtcggggagggagggtcctccgctctccattgcggagcttcgctccgggaccaccgggggaccggacgccgggccgcgaagctgccgcctggggctgcggggaggagagcaacataactggaatggcacttaggggccggtgtcagggttgtcaccggggttggcggaaatgacgaaggggccccaggcacgtcgtgttactgggcgaggttccagccaaggtgcccacgcgccttgggggaaaccagaggacttctgcaccgtttcccgaggacagtttggcagtgtttcagaagggccttagaaccaggcaggcccccttctaggatggtggaaagcctaaagatctgaaaacggtctcaagtgtcgtcttagcgattggctgactaaaccgaatgcaagccggagactgcacacgatgttgccgttaacagttacactgggccgggcagtcagaggcaggcggatcacctgaggtcaggagttcgagaacagcctggccaacatggtgaaaacccgtctctactaaaaatacaaaattagccgggcgtggtggcaggcgcctataatcccagctacttgggaggttgaggtaggagaatggcttgaactcaggaggcggaggttgcggtgagccgagatcgtgccactgcactccagccggctgacaagagcgaaactccttctcaaaaaaaaaaaaaaaaaaaaaaagttacattaggctgggtgcgctgcagcctgtaatcccagcactttgggaggccgaggcgggcggatctcttgagcccaggagtttgcgaccaacatactgagtttggccaaaatagtgagacccccgtctctacaaaagatagaaaaaattagccagttgcggtagtgaacgcttgtagtcccagctacttgggacgctgagggaggaggagcacttgagccctggaagaggaggctgcagtgagctattttctcatccctgctataacgaatttgtcacaggctgttttataggcctggagctcagaagcccgaagtgagttttaggaggttaaaatcaaggtgttggcaagggtagttccttctggagtttcccaaggagaatctgcttcttttcctcttccaacttctagaggccaccttcttccatcttcaaaacctactgtctctgcataagaactctcatgattatatgccggccgcccagacaccccagggtagccttcacatctcaatattcttaatatttgcaaagtcccttttgccacttaaggtaacaccacaggtttggagattaggaggtggacatctttcagggccattcttattttaaaaaatgtactgtcgataagaatagttaaaatgtaaaatatttgaagggatttattctgaatcgaatatgagtgaccgcggccggtgacacagccctcaggggatcctgggaacatgtgcccaaggtggttggggcagtttggttttacatgttttagagagacatgaggcattaatgaaatacatttaagatatccattggtttggtccagaaaggcgggaccaaacaaaaaaaaaaagattttgaacatgcttcccgagctcaggcatgaagaactcttgactgacagaaacggagggtgtgtccaaagttttgaggacggccgagcggcgctccaaaacccgtcctcacagcctcgccccgttcgcctcagctacaacaaatcatcgtcaacctgttccaccttctccagtctggtagcaaaaaggggtgtctcaggtttgctttattttattgtttgggcaattcctggaatccggcctgcttgtgggaggaggcaggggccggtccctcgagggtggtgggagctgccagagctggagggatggtctgggggaaggcggctgtacggtggaaaggctggttggggccagagtgggaaacgggatgcggacgtcaggcttcacccccgacccaggggggagtgggaaagctggggtagtagctgggacgaggcccgggggctgagcccagagggtcgagtgggcgacgactagcgggcgcggcccccagggtggactccccgccagccccggcctggaggctccgcccgcccccgcctgggcggaaggaacgcggagcggctctggccttgggtctgcggcggcggcgtcgggtgagcgtcccgggcggagcgggcgcgggcgggggcagagaggcaggggagacccccttcgtgtttttgtgaggtttcctcccagccctttagtctgcagcagggtgtccagaactagcaggttcgagggactcgacgcgggcgcgggcgggggtcccagggaccgggaacttttgcgcgtcgcctgagcgtggcccgtgtctccctagagggtggccccgcgcccccgtcacgtcggaacataaggacctgaattggcctccagacggcccctcccatgtggctccccagggtggggcccaggccttgggtgctgcggagacctccctccgtaaggttgagaaagtctggtctccggataagggaccgttagggcctctgttcagatccctgcctcaaccaaagcaggctgccagctggtggtagtgggttcctgaatgtgcttttagctttggctgtgtagggagccagggacttctccagtcacagagaagggcgtttactcccgcattttcatggggtcctcagtgggatccgtgacccacagagattcagaagggcctttctgggatacaacagggtctggccaagcctgaggggtagggacggggctactcccgcagcgctagttgcagatggtcacgggagcactggccaccctgagctcccaccaagctttcccaggaggaggacaccctggggccacctttcatctggctgcagaggacacaggagtgtcaggctggatttggggagcgtgtgcaccctgggcagccccctgaggctctccttccacccgccctcccgcccacagtgcctcctgatgactagattctggagtcagaatttgggtgaccacaccctggtcggttttgctcacgtgcttcgggtcggttggattcagttcctccatgtggggccgtgggatgtcaccaccctttgccactgtccttgcaggccgggcgcccaggcgtgtggacccgagcccagccttgcgtctttcctcccagttggtaccaggggcctcttgcctccactcatgcagagtggaccagccgcctctgaagcagccccggggagaggagtgccaggcacacagactcaggaagctgggggtgtcagggcaccaggagcctctcaagcggtcctgttggccgtctttctgaagggcagctggggttgcatcatttccccaagtggatcctgccaactttctggggcttctggatgagagccctctccccaccccacccacccctccccgcattgtggcatcagtgctgctgcttccagggagccttcctggccatccaagcctcctctccaggttcctgccctgctgtagtccccaggccagtgcttggcaggtgctcagggaatgtatccaccaaccaaggtttggggtggctgtctctgcctgaccactttccccaggcccctggcgggtacctgagctgtgctctcagggcctcaggaacctccttccatattcagggcctgtgcctggggaggcttcagggtgtagcagctgtgcccatcccaggctgacccacccagcttgcctggtagcccagcctctgggctagtgtgccgtggggcaggggatgtgctgtagcctggtgcagagtccccaaccccagaagggggccatggaagctgacaccccaagtggccgcccccctgctctgtcttgcttcggacactgtggccgggtccaggatcctggcatcctgggaggtctctggctttgtgggcagcctgcctggcccgcacagtctgcctgtcctgagggtgagacacaggtcaagcccacagacccccttgctcccctgctggggcctccaggctcacagaccaccccaccctaccctgtccttgcccaagcaaatgagaggcaggggcttcccgggctgctgctgtcccgccctctgtggggcaggaggaggtgcccacagaggctgggtggtgatagccaggagatgggctggcatctgcattacccaagctctgctgcccatggtggcctttctgggggtgggtgctggtccctgccccctgccccacccctgatgtctgctccagagacaaaggtggggagggtgctgaagaggaagtgtttgcccagggagaggctgcggctcctcctgaaacatcagccctgtgggtcctgtttgcagaatctccggcctgtgaaactgtgaggggattcggccaagacgtcctcttccctctgcctcccacccaggccactcttcacctccaccatgagcctggacatccagagcctggacatccagtgtgaggagctgagcgacgctagatgggccgagctcctccctctgctccagcagtgccaagtggtcaggtacgcttgctctcggggtggccttggggtgctggtggggcaggctggcgggtggcggctccctctgaagggtgcattgctctggaacgccttgtttgtggacatgaagtatgaattctgtgcagctaccacgtgcatgagatgtgattcttgtgtttctttttgacaatttaggaatgtaaaacccattccaggctcatgcagcatgggctgaggtgggcgggccgaggtgggcggccactggccagtgggtctctggctccggtgtctcagctcctctccctcccttggagacacgagggcaggacacagcttgggtcccctccgtgagcctccatggggcgctgcttgtccctgccaagctgggggctgggagtcctcggccctcgaggtcctcacaaacccagcagcttcacaagcaggacacgagtgcctgggtgggccgcatcttttctctttttacctggtgatttcaagtagtgtcaggtttgcggaggagttacgaggaccggacggggctccctggtgaggtggtcctgtgtacctgcggacgctagctctggcccagcacctccaggcagggtctgcttttccgccctgcccttttcgtcttcctcactggtccaggattgcgtggccctcagccctctgtctccttagccctctcccgtctgtgactgtcccctcgtctctctgggttcttggtggtctgagggtctggccaggctcctgcaggacgtcctctgttggggcttgtctggtggtttcttgtggttgaagtcctacagttttggcaggaatgcagggagatgccgtggggcctgccaggagcgtcctgtcacaggcgccgtctgccaccctctccactgtgacgccactgcctttcctcctgtgactgatcagtgccttcgagagatactttaaattctttttatttttagagacagggcattgctctgtcacccaggctggagtggctccctcatggcttatgcggcctcaacctcctgggctcaagtgatcctcctgcctcagcctcccgagtagctgggattatgggcatgcgccaccacgcccggctacttttgtatttttagtaaagacggggtttctccatgttggtcaggttggtcttgaactcccgacctcaggtgatctgcctgcctcggcctcccaaagtgctgggattacaggcgtgagccaccgcgcctggccacgtgcgagcatcttaaacaaaactttcatggaacagttcctcctttttgtttcatttctgaaatgtcttgtgtgacttgccttgctgtcttctgggcccactgataggttgtaacctgcacgtggggtggtggtggaggctgaggccagtgctgtctgcgtggtccacatgaccctggggtctgctcacaggctggacgactgtggcctcacggaagcacggtgcaaggacatcagctctgcacttcgagtcaaccctgcactggcagagctcaacctgcgcagcaacgagctgggcgatgtcggcgtgcattgcgtgctccagggcctgcagaccccctcctgcaagatccagaagctgaggtgaggcggggcctggcactgcctctggcctggtgcagtctgctttggtagcccggcagcaggggacagagccgccaggggcgcgtgggcagctgcaggtggacaggcagtggcagcagacatttccaacatcagccagaggcacacaggcctggcggtctcacagcgggggggacagggcccttcctgccttatcccagcccccgcacccaagatctggccctgcccgccatccctagccttccagcatcaccacagacccccactgaaaggtgtgtctgcagacaaggtttccctgggtcgagccacatgcgtgccctccttcactcggcctggagaccccagaccccagagccccgtccagggaaggagcaggtatagacctgccgcctgaagagtgctgctccgggctctgggctctggcaggcgaagggcgtggcagcttggctcaggggagccctgctgacagccaggtatgctccagcctccagaactgctgcctgacgggggccggctgcggggtcctgtccagcacactacgcaccctgcccaccctgcaggagctgcacctcagcgacaacctcttgggggatgcgggcctgcagctgctctgcgaaggactcctggacccccagtgccgcctggaaaagctgcagtgagtttgtgtcctgccccagggcccatgctggccgctgcctgtcccccagccagccccctacatagaacatcgcctgccaggagccgtgaggaggggactcaggtcacaggggccttgtggtgctctcctttccccatgatgctgggtctggggccttgtggtgctctcctctccccatgatgctggggctggggggatctgtcatcaccctccctccccatccagttgtcctttgcaaggcacagctgccccaggacccgacggtgggaacagatgcctggccgtgagtcaggttccactcaccgcctcagtgtgtgtgggggacccggccattgtgagttgaccacagcctgggacgtgcaggtggccctgccctccagaggctggtttctttctcccgggcctggttgggccccaaagtctgaggtccgggagggggtgaggggtttccagaaggaatgccggtgtccacagaggcccgggcctctggatgagtctgtgggggtccctcagcactgacacctgatgcccaggcagaagactgaggggagatgagacaccagcacaccccgtgctccctggtatcacacccttggctggtgcacattcctgtgtggtgctgagctctgctgtcccccaggctggagtattgcagcctctcggctgccagctgcgagcccctggcctccgtgctcagggccaagccggacttcaaggagctcacggttagcaacaacgacatcaatgaggctggcgtccgtgtgctgtgccagggcctgaaggactccccctgccagctggaggcgctcaagtaggcactgggccttgggggggtgcggggtgtgggctagggggggtcccgtgctgcctcacgtgtgacccgtgtccccaggctggagagctgcggtgtgacatcagacaactgccgggacctgtgcggcattgtggcctccaaggcctcgctgcgggagctggccctgggcagcaacaagctgggtgatgtgggcatggcggagctgtgcccagggctgctccaccccagctccaggctcaggaccctgtggtgagtcatctccgcgaggcctccttcccggagggtcgggcggcgggccgtcctcagagctctcccccgcccctgggctcatctcaggccatgagacggtgctgaggaaagtctgtggtggtccatgtcctgcaggatctgggagtgtggcatcactgccaagggctgcggggatctgtgccgtgtcctcagggccaaggagagcctgaaggagctcagcctggccggcaacgagctgggggatgagggtgcccgactgctgtgtgagaccctgctggaacctggctgccagctggagtcgctgtggtgagtgtggctgtcggggcagggccctgtcgcccaagagagggccagggtgaccgaggagaccaggggaggagtgagcgactccagggaagctgctgggctcagctccgaccttcagaatgcataggccagggagcagcctgtggtttgatgggaacagtgcttggggccaaggaccaggtgtaggtgcccacttgctgggaggctgtcagatgtttttgctcaggtccacgtggggccttcaggggaagggccagtcgcagctgtgggccagcctgggcccctgccaggcgtcagtcctgtctgtgtccacagggtgaagtcctgcagcttcacagccgcctgctgctcccacttcagctcagtgctggcccagaacaggtttctcctggagctacagataagcaacaacaggctggaggatgcgggcgtgcgggagctgtgccagggcctgggccagcctggctctgtgctgcgggtgctctggtgagtgtgtgagggacacgagtatgcacatttgggagatcatatgcccgtgtgtgcacacaagggcgagagtgcacgagtatctgtgtgagcacgagtgtccgtgtgtatgtgagcacacatgggtgaggcgagtgtgagcacgtgtgtgagcatatgagtgtgagcatgggtgtccgtgagcatgtgagagtgagcacgtgtccgtgtgagcacgtgagtgagcacgagggtccgtgtgtgagcacatgggcaagaatgagcacgagtgtccgtgtgtgagcacatgggtgagcacgtgtgtgtgagcacatgggtgagagcacgagtgtccgtgtgtgagcacgtgagagtgagcacgagggtcagtgtgtgagcacatgggcaagaatgagcacgtgtccgtgtgtgagcacgtgagagtgagcacgagggtccgtgtgtgagcacatgggcaagaatgagcacgagtgtccgtgtgagtgtgagcacatgggcgagagggagcacgagtgtgtgtgagcacatgggcgagagagcatgagtgtccgtgtgtgagcacatgggtgagagcacgagtgtccgagtgtgagcacatgggtgagtgagcatgagtgtccgtgtgtgagcacgtgagagtgagcacgagggtccgtgtgtgagcacatgggcaagaatgagcacgagtgtccgtgtgtgagcacatgggcgagagtgagcatgagtgtccgtgtgtgagcacatgggcgagagtacgtgagcacatgggtgagagtgagcacgagtgtccgtgtgtgagcacatgggtgagagtgagcatgagtgtccatgtgagtgtgagcacatgggcgagtgagcacgtgagtgtggcacatgggcgagagtgagcacgagtgtccatgtgagtgtgagcacatgggcgagagtgagggtgcatgttcatgtactgggaaaggcgggctggcggcaccactctggcttagttctcattttaactctgaaagtcagaggtcatgtttcatgaagcctgagagcttcacggagctccagcctacctggccaccctgtggtccatcttcctggaagccccgcccacctttctcccttgcgggaaccccgcctgtgtcaggatgtttttccagatttgttttctttgttaaagcacgttcttttgcagctttctaagaaaaggttttgcaggaggtaatttttggggtcttgtgcccctgttctgtccttggatcatttagccgggtatagcatgcaccattatgcccggctaattttattttgtttgtttttttgagagagtcttgctctgtcgcccaggctggagtgcagtggtgcgatcttggctcactgcaagctccgcctcccaagttcatgccattctcctgtctcaacctcccgagtagctgggaccacaggcgcccgtcaccacaccaggctaattttttgtacttttagtagagatggggtttcaccgtgttagccagtatggtcttgatatcctgacctcgtgatccgcctgcctcggcctcctaaattgctgggattacaggcgtgagccaccacgcctggcctaatttttgtatttttagtagagatggggtttcaccatgttgggcaggctggtcttgaactattgacctcaagtgatgagcctgcctcagcctcccaaagtgctgcgattacaggcgtgagccactgtgaccttgtgtgcacgatctgctttttctcgttggcagcttttcaagctctctttgttcactgtgttaggggttccatgtgcttggccttgatgggggtcttggttctttgtgctggatacttggttctactaagaaaatatacctttggtgatttttttctctctcctttcttatgtttcttttttggtgtgcccatgagcctgtcctgatgtcttgtggagtgaccctctaattatgttctccaaattttcttttcgatgttttgttttatttttgggagatgttctcatttaccagccagtctactgaatttccaccctcagtgttttgtcttttgtttgctgtttcccgtgtgcctctcgccaggggctttccgtgggtggctggtcatcctgggctgggcaccaggtgcagagtgaggcccgggagccctggacagtgagccctgcaggccgagtcatggctgcgtttctcgagggcttcctcctgatgggggattttcagttccctgccaggggacaccatcctggctgccaggaccttgtgggtgttccagatgtggagaggaaccttgggtcctggtcactgcagacttgttccccctgagccactcacagggtgggggtcctgcagcttccctggcccccaccttggagaggtccagtgcaactccttggccctgctgtccggcctgtggcggctccaccccgggaagtgggtgttgggtcttctctatcccatcctcttttgtctgacccgttctcttgtctctctctggagcctaaagtctgttgtccactctgttcttgtcttggtaccctccataccctcgtttccccacagctgctcctcagtctctggctggcttctcctttgaagcccacgcagccagacggtgtcgaggtgacaagggggtgggtgtggctctctgggtggacgacatctctctcctgtcctttctcctccctgcagaagatctcaggcgagtgaggctgcttgtgcctcgcttgtctgtgccttccttgtccgtggtggggaacctgcccagggccacagggacggtgagccttggggacggccccacctgagggtcctgagttgccgagcacaggtgtccgtcgcgccccccaggcccaggcctgctctgccggtcagtgcggtgccaggcacgcccggcaccctgacccccgccctgcttcacccaggttggccgactgcgatgtgagtgacagcagctgcagcagcctcgccgcaaccctgttggccaaccacagcctgcgtgagctggacctcagcaacaactgcctgggggacgccggcatcctgcagctggtggagagcgtccggcagccgggctgcctcctggagcagctggtgtatgtgcacgcgctgggcgggtggtgcggccagggctgcccagggaggaaggcgggggtgggggaggacacgggcccatgcctcccttctggcctgtgtgcagcctgtacgacatttactggtctgaggagatggaggaccggctgcaggccctggagaaggacaagccatccctgagggtcatctcctgaggctcttcctgctgctgctctccctggacgaccggcctcgaggcaaccctggggcccaccagcccctgccatgctctcaccctgcatatcctaggtttgaagagaaacgctcagatccgcttatttctgccagtatattttggacactttataatcattaaagcactttcttggcagga

SEQ ID NO: 36826 - DNA, 22182 bp, Homo sapiens
gttcgcagctcaggtgagagcgccgggcctccacgcggattgcggacctgcagggagggatgtgctagtgtccagggggcgggaacgcgacgtcccgggaactcccccaaagcaggccgtcgctccctgtgcctcggccggcccgggacctcagcctgagaagggccggtgggggcgggctccgggggcgttaggtggggctgagtcctagttggaagatgctcggtgcgggccgaggtatgggcgccagaatgcagccaggcgtcggaaaacgcggtgctggcttcaggaggggaatgcgcgtttattgtattgaccatgaacctgccacaaagcgcgtacagcccgtgggtctgcggtgagaggccgagcctaggagctagaaggacctcgtgaattttggctctgtcacttgagcgtttgaaaatgaggatattagtaaaaactgctttgtgtcgttcagaggtaagccatcccctgtaaagcatttagctaagcgctagttactaagcagcatgtaaatgttgattcccgttatatttggaagacactttgttcttttcatgtagtatttcgtttaattctcacaaccaccctatttatatcattaaaaatgaagaaggaggagtgaaaagatagagccaagctcacaaaggatgagagagctaggatgtcaatacataaacactttactccccgaatcaggctgtttgtaatggcctacctacctaacccagcattgcagccttcacagcactgagtgattgtccccaaaaccccaggacaatgattgtgaagtcagtgtggacagaatcttactatgtggcaagtgtatttgttgtggggtttctgggatgtctccagagcctctgggttagactgaggcccctgccacctcctgtgctgtccctcctgtctctgtctttagaagtcagtctgatattctagggcagtgaagatgagtcacatacgtaattttaaatgttaaactagtagctacatgaaaatctaaaacatgaaattaattttaagaacatactgtggttttctcagtgtatccaaaatgttatttcaacatgtggtcctagccacatttccagtgctcagtagttgatgtgattggaggctgtagtcatggatagcagggttctaattaatgccaagagaatcaggtttaaggccttaggtcacttcttcaccaggaggattttgctccctagggaactttggaaatgttggagacttttttggtggggggagaggggactgagtttctctctgtcgcccaggctggagggcagtggtgtgatcttggctcactgcaacctccacctcccaggttcaactgattctcctgccccagcctcccagcttgtaatctcagctggaattacaagcatgcatggccatgcccagctaattttttgtatttttagtagaggtggggtttcaccatattggccaggcttatcttgaactcctgacctcaggtgatccacctgccttggcctcccacagtcctgggattacaggcgtgagccaccacgcccggcctggagacgtttctgattgtcacaacagggagaaggggtgtcctagtgtctagtgcatgtttagaaatgctcttaaacatcctgcaatgcacaggaccactccttatgtcagaggattatccagcccaaaatggaagttgtgctgacgtgaagaacactgttttccatgaaagtttcaactaaaataaatttgttacccaggcatcagccccagcttctctggagcaaagcagctctttatgttgcaggaaggagggagccccaggaacaggagtcccaccgaagaactgctctctgacagaacagagacctcctcaccagggcttccaaacagatgcagaagaacccagaaaggagcaggtcttgatttgcccaaccagcggcacttcttcatccccttgcccagagagcaccagacttggtgatgtcgccacatccagaagccatcacagattgtgtgacactgaacactgtgggccaacttgcagaaggtggtaagctggggttgagaggcgtgggtgactgtcagactgcacaggaaaagccacattactggagggcttttctccatggtctccaaggaaggcataaccagccagggctgaggaaattgtctctaatcctcctcatagagcccccattttcttcattcttgcctcactctttccagattctgagtcactctcacacaacatccatcacatgtagcatctagaaatttactaaggttgcctctatcctgaacctgtagaatcacaaaaatgataatacaggaaaggatttctatttctgactcttaaaaccttaaaaagtattgaacctaggatgaacagtttgtccatggtcactcaggacagagcttggagcaaagcacagtgctgttcactctgtcacaggtgagtcaccagaagtgtcttatcgaaagtcttttgagaaactataagttagaacaaaaatattttaaaatagtctttcagcatctcctttttttcagttttgtgttttctattggtgtaaataatattaacagaatattaatgttaattctgtttaagttgttagtcaaagaagacatacattttaaataaatcaataggaaaatagtctacaatcgcctgatgaaaaacagcaaggggccaggcctggtggctcacccctgcaatcccagcattttgggaggccaaggcgggcagattgcttgaggtcaggagttcgagaccagcctaagctacatggtgaaaccccatttctacaaaaaatacaaaaattagctgggtgtagtggtgggtgcctttggtcccagcaactcaggaggctgagacgggagaattgcatgaacccaggaggcagaagttgcagtgaactgagatcacaccgctgcactccagcctgggcaacagagccagatcctgtctcaaaaaaaaaaaacaaaaaaacacacacacacagcaagggttcatccacatgatcatattaaagatgcacatattcaggaggtgctttctctgtagtgctgcttgtcccttctcaaaggtcaaaggaacattttttgtagagaggcctttttccccagctggtgtgatgacattggtaggcaggtaagatggaggctgcccagatctctcatgactccttcctcacccccaggttatcctttacggttctccacactctttcaggagcagcagaaaatgaacatatctcaggtgagttaattactaatacctttttcatcatggatttcataggtgtttaagggtccacatattaatatggaaatgtagaaatggatcaaaatcattcaaggaatatatagaaaagcagggcagtagcacagcagaattggcatgtggaaagatggaggtcgcctgatgttacagattttccaaaatggaactgcagttttcattctttctgatagccatggcagagagccagacagacagtattttttttacagatttgcattgatgagaagcttaaaaccaggctgattcctcatggaatctaaagttatcaaagtcagggaaaatgtctttgttggtcttcatgtgtcagtgcaaatctttctcataacagccttgaaataaatgcagtatgttgcttctgctttttcctcagtggaagtagacggcttagtgccaaactcaggcttttattaatacagtttttcagttttattattaatacagtttttcaggtaatggaaacagacgttcaggtagacagactgtcaaagaaaggagagatcgatggtgtaggctctgttgatcagaggtggagagtttaaaaggattttgtcctgaaaaatgggtaaggttttcattgttgcagtacaggagattactgcattttgagagcaggctaaacaaggcatgcaaggtccattaagaatctttgcctattgcagtttggacttcctcttagggaataataagagaggggagggagataaaggttagagccttagtattagtttgctagggctgctataataaagaaccacagactgggtagattaaacagcaatttattttcccaccattctggagaccagaagtctgagatcaagatgtcatcgggggccgggtgaagtctgagatcaagatgtcaacaggggccgggtgcagtggctcacgcctgtgatcccagcactttgggaggccaaggagagcagatcacttgaagtcaggagttcgagaccagcctggccaacgtggtgaaaccctgtctctactaaaaatataaaaattagccgggcgtggtggcgggtgcctgtaatcccagctactcgggaggctgaggcaggagaattgcttgaacctgggaggcggaggctgcagtgagctgagatcgtgctactgcactccagcctgggcgacagagctagactccatctcaaaaaaaaaaaaacagatgtcaacaggtttggttccttctgagagctgtgagggaagggccttgctccgtggcttagatgtctgtcctcacatcatctttcctctgtatgagtctatgtccaaattttcttttcctgtaaggaattgagaaattgttcaaatatagaaagatacaaagaaataatataataaatatgttcccaccttcccaaattaccaactatatatattttgctaaatttttgtttctcttgtatgcactcttttttccttttaaaaacttagttctttaactgagatgcagttttaataccagtaaagtgtactctgaagtgtgtaactggatggatttttacatatgtaaattcatgtaatttagtacccagattaagataacaccactgctcccctctacagggcaaccacaattctgacctcatatgttagggaaaaaagataaattcatttttgaatatgataccagtagaatcatacaaagtgtattcttttacagttttcaagggaatgttttgctctgtatcttaatatttcccttttatcactgggctgtatttcattgtatgaatagaccataatttatttcctcattctcctcttagtgcattttttcatttgtttttcctgtttgaggctatcaggaataaggctgctgtgaatattcttttgtgtctttgggtatgtcctcattgcttttgggatatacttagaaatggaattgctggttcatagaataaacatatgttcagttttaatacatactgcaagtagcttgcctaagtggtcaaatcagtttacattcccactagcattctggctgtaccagattctgagcaacacttgttattatcaatctttttgtttttagccattttggtggctgtatagtgtggtatcttatcaaaatttataatttgcttttctatggtaaatactaatgttgggcaccattgtttgtgttttggacatttagacatcatttctttttatgtaatatataaagtacctattcaactctgttttaattgggttatttgctttttttaagtaggaattatttcaatattttcagtaaatgttttttgccatgtgtgcattactgatgttcttggattccatggcttgcttattcattttttaaataatatatttgacaacaaagtttttacatttaataaaggtcagatcgtcttttctttaatggcagttccttgtgtatcatatttgaaagctctttccctactcttaagatcagatattctcctatattgttactacatacttgtttattttagcttgatctacatagagttagcttttgtgtttggtataaggtgagtgtcaaggttcatatttccatacggatatccagttgctctagcaccatttgttagaaagaccatcttctgtcaactgaattgcagctgttttttgtcagtcaagtgacttgtatgcgggtctaatgtagactgtatattttcttcctttggtccaattagtttatctttttgctagtacttcactgtcataattactgttgctttatagtaagtcacaaattttgtgaatttatttactattttaggtccttttcatgttcatggaagttttatcaattttcacagaaaatcctgatggaaagtttttcagagtagaggtgaagtctttcacatcttttattatatttattcctaggtatttgatctattttgataatagcacaaatgatactgcattttaaatgtcattttccagtttattgttagtttattaaaatacgatggatttttttagtattgatcttatacctaggcattttacaaaattcactcattctaatagcttatctgtggattcttttggattttaaatgtgcaaaattttttttgcaataaagacaattttacttcttcctttacagtttttatatctttaatttctttttagccttactgctaggacttccagtaaaatgtttagtacaaatggtgataatagaaatccttgtcttatacctcacctgaggggtactcagtatttcaccattgagtcttattttaactacatgttttttgtatatgtccttaattagaataaggaagttcccttttttatttttagtttcctgagtttttttttttttaatcatgcatgagtattttgtcagatggctattcttgcttctagtgagataatcatattattttattcctttagtctgttaaagagctgaattatattgatagatttatcaatgtttaaccaaccttgcattcctgggataattcccacataaggtagtgctatcactttaagttatttctggattcaatttgttaatatttcaattaatatttttgtgtctacattaatggaaagatactggcttgcagtttttctgtcatgtcatgtcacgttttggcgtcaacattatattctcaaaaaatgagtttggaaacagttattcattttgtgttctctgaatgagtttaagattgctgttatttcatccttaaatgtttggaaaaatatacctgtgaggtagtctagcattggagtttttcttgtgcctggtttttgctcatgaactcagtttctttaacaggatatagaaaatccaaatcgtgctacttattctagtgtcctttatttttaacagctttatggagatacaattcacataccatataattcacacttttaaagtgtacaattttgtggtttttagtatatttgtagagttgtgcagtcattgccacaatcaattttagaatgttttcatcacttcaaaaggaaattccatatcatttagctatcatcccccatcctgacatacacaatctcagccctaaacaacaagtaatctgtgttctgtttctatatgtttggctattctggacatttctaataagtgaagtcacataatatgtgatctttgtgactatttctatatatatatatattttttttttgagacagagttttgctcttgtcgctcaggctggattgcaatggcacgatctcagttcactgcaacatccgccccctcaggttcaagcagttctcctgcctcagcctcccaagtagctgggattacaggcacccaccgtcatgcctggctaatttttctatttttttttttttttttagtagacacagggtgtcaccatgttggccaggctggtctcgagcgcctgacctcagatgatccgcccacctcagcttcccaaagttctgcgattacaggtgtgagccgccacacctggccctttgtgactatcctttttacttagcatactgttttcaaggttcatccatgttgtacgtatcagtacatcattcctttttgtgactgaataatattccattgtgtggatataccacattgtttattcattcaactgatgagcatttggattgtttctcccttttgactgttatgactagtgctgctattaacattcatgtacaagtttttgtttggacacctgttttctcttgggactaatcctagaaaaggaacttctgactcatatggtaactcttgacttatcttttttggtaactgccaaactgttttccacagtggctgcaccattttacattcccaccagcagtgtattagggttccactttctccacatcattaaaaccacttgttattttccctttttttaaaattatggacatcctagtgggtgtgaagtggtatcatttaactttgatttgcatttccttgattaatgacattcaacatcttttcatgcgcttattggctatttgtttatcatctttggagaaatgtctatccaagtcctttgcccattttggattacattttttgttgttcagttataagagttctttatgtattctggctactagacatttattaaatgtagtatttgtgaatattttctcctattctgtaggttcttttcactatcttgatggtatcctttgcacaaaagtttaattgtgatgaagtccaatttttttttctttggtatcatatccaggaagtcattgccaaatccaaggtcataaaggtttactcctgatttcatctaagagtcatgcagttaaactcttatatttaggtctttgatcccttttaaggccaattttttttttttttggagacggaatctttgtctgttgcccaggctggaatccagtggcacgatcttggctcactgcaacgtccttctcctgggttcaagtgattctcccacctcagccttccgagtagctggaattacaggcatgcaccacaatgcccgggtaatttttatattttttcagtagagacggagtttcaccatgttgaccaggctggtcatgaactcctgatctcaagtgatctgtctgcctcagcctcctaaagtgctgggattacaggtgtgaggcaccacacctggctgttttgaggcaattttaaaatacagtataaggtaggagtccagcttcattattttgatgagattcagttatcccagcatcatctgttgaaaactatttttttcctaataaatggccaatgtatgggtttatttctgggctctcagtgctattctgtggatctgtatgtctgtatttatgccagtaccacactctcttgattactgttgctttataataagtttttaaatcaggaaatgtaatccctccaattttttttcttttttttctagattgttttgactattcagggtcccttgcaatttcatataaattgtaggttcaacatttctgcagaaaggtcattaggattttgatatagatttcactgaatctgtatatcacttttgggagtattgtcatcttaacaattttaaatcttccaattcatgaacacaaggtgtctttccatttatttgggtcctctgatttcttctagcagtgttttctagtgttcacgtataagtcatgtaccttcttggttaaatttattcctattttattattttttgttctattgtaagtggaattgttttcttttttattattcattgctagtatttagagagataaatgattcttgtgtgttcatcttgtatcctacaattttgatgaattcatttattggctctaatagttttttgtggcttccttagtcttttccatgtattaaatctcatggtctctgagaatagagatagttttacttttttctttccaatttggatgcatttttgtcttacctatttcctctagctagaacttccagtataatgaatagaaatgatgaaagcaggcatccctgtcttattcctgatatttggaagaaaccttcttgttttttagcctagcgtattctgttagctgtggtttttcagaaatgctttttattgtgttgcagcagttctattctagtcctaccatgttaaatgtttgtttttatcatgaaaggatatttttgtcaaatgctttttctgcatcagttgagatgatcgtgtgacttgttttcttcattttattattgtgatatattacactgatttattttcttatggtgagccaccttgcattcctggaaataaattgtacttggtcatggtatatagtactttttatttgttgcaagatttggtttgcgagtattttgttgaaaacttctgcacacatattcagaagggatacatatcatagtttttgggtgatttttttatctggctttggttcaaggtaactcatagaatgagttaggaaatgttcactcatcttctatttttggaagaattagagaaggattggtgttagtttttctttaaatgtttggtagaattcaccaaacatttaaagacagactgacagttggtcttgagcctttctttgttgggaggatttggattactgattcagtcttatatcagtctgttcggatgttctgtttctttttgagtccattttggtggtttgtgtgtttctaggaatttgtccacttcatcttggttatgtaatttgttgctatacagttcactgtattctttattatagtcttttttattttgtaaggttagtagtaaggtccccacctcatttagttccttaaagtatacaattaggatactgatttgggatcatttttaatataggtgttacagctataaatttcacacttagcactgccttagctgcatctcatgcattttggtattttgtgtattcattgtgagtaatctcaatgtattttctaatttctgggtctcaggggtttgttttgttttgttttgttttgtttttttgagacagagtctcgctctatcacccaggctggagtgtagtggcacgatatcagctcactgcaacctccacctcccgggttcaagcaattctcctgcctcagacacccgagtagctgggattatgggcacgcaccaccacacctggctaatttttctatttttagtagagacagggtttcaccatgttggctaggctggtctcgaactcctgacctcaagtgattcgcctgcctcagcctcccaaagtgctggaattataggcgtgaaccaccatgcccagcctcatttctcttttgattttccctttgatcctgtagcgaggtgaaaatccacctatgtgtatggcccccagggacttcacacactcaaactagtacacatttgcctttagcaggttaaatttttctagttttatcttcctaattgtattagatggagttgagtagcatctgctccagtaagcaaatgagcacatcctgattctccctgcaggtgcctgtctcgtctctctctctcctaatagtttgaaaaaaagatactaattttctgttttcccagctatgttcttgtaaggatgttagcgttgcttttatcagctctctacatctctaagctaagatctaaagctacgctgtatgattgtaattttttgtaatttagtgagatagactgtcctttttttttaatgtgcaaaggaaaccagagagttatgttatgcagaggttatcctatatatgtcagtcaggttggttaattatgtcttttcaatcttctatatcagtggtcagaaaactttctgtaaatgtcagatagtagcctttgtgagagatacagtctctgttgcatctaccaaactctgcagctgtagtgttaagcagccatagataatacataaacaaatgaatgtggctgtgttccaagaaaactttatttacaaaaaaaaaaaattggtagtggtggtatttttcatttacaaaaaaaaaaaaatagtagtggtgagctggatttgacctttgtgctgtagttcactgactcctgttctatatccctgttggtttttcttaatctgcttttctatgagttactgggagagttacattaaaatcactaattaaaattgtagattgatatctcatttctatcaacttttgtttatatacagtcagttctcataattctcagtagtaatgttccaaaaagtcactacaaacactgaactaataaatactgaaccattactcagaggagaaatatggggttaagcctctagtcacatttttgtcagccagtcagtacataatctttttgtgtgtctttctgcataaagacaccttatttaatattgttggtttataatgattgaactaatggccaacaacaccataactaatgcctgaatgaatcttatctaacatagatattttctccatgagccataccacaggcttcttgcacataggcacactagacagcacataactgttatacatataggccatttaaaaagtgaaatcatcggccaggcgcagtggctcacgtctgtaatcccagcactttgggaggccgaggtgggtggatcacgaggtcaggagatggagaccatcatggccaacatggtgaaaccccatctctactaaaaatacaaaaattagctgggcgtggtggcacgtgcctgtagtcccaactactcaggaggctgaggcaggataattgcttgaacctgggaggcgggggttgcagtgagccgagatcacatcactgcactccagcctggcaacagagcaagactctgtctcaaaaaaaaaaaagaaaaagtgaaatcatcaagaaaaagcacaaaaatgcagtaaatatggcactaaatagactgagaagtggacacttatttacagtatcagagctgaaacaagaaagcagatcaccttgttgagcctcatctgggaacatgtaggtcaggcaattcaaattttttaccttcctgtacatgtccacaaatgactgcaaaataactgcaagtgttgattttgaggttgcaaataattttagtgtgtgaatttacaaatacgtaatccgtgaataataagaaatgctaattggacgctatgtttgccaggtgcatagcaattttgatttgttgtatcttctattgaaaggactgttttgtcattacaaatcgttactcagttttttgttgttgttgttgttgttgttttttatacaagaatctcactctgtcacccaggctggagtgcagtggcgcgatctcagctcactgcaacctccgcctcccaggtccaaacgattctcctgcctcagcctcctgagtagctaggattacaggcactcaccaccacacccggctaatttttgtatttttaatagagatggggtttcaccacgttggtcaggctggtctcaaactcctgacctcgtgatccgcctgcctcggcctcccaaagtgctaggattacaggcatgagccaccgcacccggcccgttactcattttttatacctctttcttaccttaaagtctactgtatatgatagtaatgcagtcatatcaactatcttttggttttgattatatggtatatctttttccatccttttactttcaatctccataatccctatatatataatgtttcctttgttgttgtattatactttatcttttctttaatactattatttagtccagagaatggtacatttttttctataaaggcaagtaataaatattttcagttttgacaatcataaggtctctgatggaacttctcagtgctatttcagcacaaaaacagccataaacaatgcaacatgattgggtgtgcctgtgtgccaactgactttatttaaaaagcggtaagtggccaggtacagtgactcacacttataatcccagagcttttggaggccaaggtgggaggatcacttgaggccaggagttcaagattagcctaggcaacatagcaagacactgtctttaccacacatacacaaaaaactggcaagccagatttggcccaaaggccataatttgctgactcctgccatgatgtatgcccagggtagtctgttgggatggaatacaaattgtaggaagtttatttacattttttggctacaaaaataagaataaaaaaaaagttttagtaatgtatctatttatagtatatgtatataactcataaatatatatagatcatttataaacattttctttgagacaaggtcttgctctgtcaccaaggctggtatacagtggtgtgatcatggctcattgcagcctcaaccacctgggctcaagcaatccttctgcctcagcctcccaagtagctgggactacaggcacataccaccatacctggctaattttttaaattttttgtagagacagggccttgctgtgttgcccagtctggtcttgaactcctgggctcaagcagtcctcccaccttggcctcccaaagtgctgggattacaggcatgagccactgcacctctcctataaaaacttttaccaatttaataccttcaaagtctaagattaaattagattcaaaataggcatcctttacattcgtttaagctttttagagttaaacctgataagaattgttttcatggctattttctacatcatctaattctgaacccttcagattgaatagaaatgtactgttacaggcatcagtgtcattcaaggacgtgactatagaattcacccaggaggagtggcagcaaatggcccctgttcagaagaatctgtacagagatgtgatgctggagaactacagcaacctcgtctcagtgggtaagcatgtaaacataacttacccttgtaactccatatagaaggtatttcttttttaagtgccaatacatgtgaacaatttacttaaagtttaaattatttaggcttttcattcaggattccaaagtaactatgccctgtcgaggactagaaagaatgtgttgtcaactcccagtgataaatgcaaaggagcactttcaggatactgcttccaaagctgtattttcttccacttttggagactaaaatctcatatatctggtctaagtcctcgattgtgttttattaacagggtactgctgtttcaaaccagaggtgatcttcaagttggagcaaggagaggagccttggttctcagaggaggaattctcaaaccagagtcacccaagtgagttactgagcagtagtagacataattctgcaggagtggttagactccaggtcactttaggggtgaacacctaaatattgcaagacttttcttagaaagcctaaaggcacaaaaagcagcagttaaaagaaaataattaataaagttgattccattaaaagtaagaaatttgttaatatattattcaaaaggtgaaaagacaagccaccaaccagcataatatgtatgtagtgcaaataacttagaaaggatatgcttcctgaaaatgtaaagaacttctgcgagtcattgtgggaaaagataggcaacccagatgaaaaatgggcaaaaacattgaacaagaactttttaatatgtatgcccagtaaatctttgaaaatgtgttcaatctcattagttttcatggagcacaaaataatatatgaagtgagatatgaggtgaaataacagatatgaagtgagtttacaaatatggcaatgccaagtcttggtgaggatatggaatgttagacacccttatccactgattgattggaaatataaactggtaaaaccactgtggtatcaggaggatgttttctttttcttttctttttttttttttttgagacggagtctccctctgtcactcaggctggagtgcagtggtgcaatcttggctcactgcaagctccacctcccaggtttacgccattctcctgcctcagcctccagagtagctggcagtacaggcacctgccaccacacccagccaattttttgtatttttagtagagacagggtttcaccatgttagccaggatggtcttgatctcctgaccttgtgatctgcccacctcaggctcccaaagtgctgggattacaggcatgagccactgtgcctggcctctttttttttttttttttttttaatttccacaggttttgggggaacaggtggtatttggttacacgagtaagttctttagtggtgatttgtgagattctgatgcacccatcacccaagcagtatacactgcacccaatttgtagtcttttttcccagtcccccttcccaccctaagtctccaaagtccattgtatcatttttatgcctttgcatcccaccaggatgttttctaatcaaggtaaacttttgcatatgttgtagccaagtaattccttttctaactgtatgactgacaaaaagatatgattatgttctctggaatacataaaagaatattaatggaagtattgtttatgtttggcaaaaatagtgctcatcaacagtagaatggagaaacagttgtattctttaaggaaaaattatacagccacataaaatcttgtacactgattacaaacataatattaaccaaaagaaaaaatatgcatatatggctatatttatgtaaaggtcagaagcaggcaaaattcaatgacattttaggaattcatatattgttgataaaactatgaagaaaatcaaggaaattattacataaatattaggagactggtgaattctaagcatagagaagttgtgtgaattctaagcatagagaagttgtaaccaagcataggtaaacagggatttttgcagagccatttgtgtttcatgacatggtttctgattccatgagtgttcacttaatagtattaagttgcacatgaaagttttatgcagatatatattgtttcatgcttaataaaatgttaagaggtaagcgagaagtggcagatgatatttgcaatatgacctgtcaaggataggcatttagaatgcataaagaatccagacctctcttaaatgtcattttcacagtagaactttctgtgataccctatttaaaattgtacccctcatgtcagattgaaatgtggaaactcaggatgggatgatcaggttcacttagcacttagttctgatggaataaatcaatgctatgacagccagaatggagcagtgcatctaagttagttgcatgaatggattttattttcaacaattttatacttgcttgtatttctatgaatcacaaccataagacaggttagagctataaactttttcatttaatcataaaggagttggtgctgttataaatttaatttgatgttgaattgatgagggatatcaaattgtaagaatgtagacaatagactattctaaccattataatctagataatgtcaagacctagactgtaatttactttcagcttctaaaccccctccctgttgagtctattccaaaattcctgttatctcctgattttccttgttatactacttacatttagagtttttgttgtatttatcccattctctgtttttcctgctccctaaaataactacccctataaaacgcttagttttattttattttctttcctctatctatccagttaggaaaatcttactaatcacatgcaaaatatgtattcattaccagcttcctctcccatttgcactatatcaatattattttttaaaggagggtggtctgagatatatatatttacacacacatacatctgaattatttaatcttgataaatcaaataattaggtgcaacataggctgtatgttgataaagctctacccacagaagatgtaagagtcataagatgttttcaatatttctgttttagaagattacagaggtgatgacctgatcaagcagaacaagaaaatcaaagacaaacacttggagcaagcaatatgtatcaataataaaacattgactacagaggaagagaaagttttggggaaaccatttactctgcatgtagctgctgttgcttcaacaaaaatgtcctgcaaatgcaactcatgggaagtgaatttgcaaagtatttctgaatttatcattaataatagaaactattcaacaaagaaaataggttgcggtaatgtatgtgagaattcacctttcaaaattaactttgagaaaactcagactggagagaaattttatgaacataataaaaacatgaaagctctcaattataatgaaaatcttcccaagcatccaaagtttcaaactttggagcaagcttttgaatgtaataaaattggaaaagcctttaatgataaggctaactgtgttaaacataacagttctcacacaggagaaacatcctctaaagatgatgaatttaggaaaaattgtgataagaaaactctctttgaccacaggagaactggcacagggaagaaacacctgcatcttaatcaatgtgggaaatcctttgagaagtcaactgtggaggaatataataaacttaatatgggtataaaacattatgaattaaatccaagtggaaataatttcaacagaaaggcacacctcactgatcctcaaacagctgtcatagaagagaacccattggtaagtaatgacagaacacagacttgggttaaatcctctgaatatcatgaaaataagaaatcctaccagacgtcggttcacagagttcgccgaagaagtcactcaatgatgaaaccctataaatgtaatgaatgtgggaaatccttctgtcagaaaggacatctcattcaacatcagagaactcacacaggagagaaaccatttgaatgtagtgaatgtggaaaaactttctcccagaagtcacacctcagtactcatcagagaattcatacagcagaaaaaccctataaatgtaatgaatgtggaaaaacatttgtccagaagtcaaccctcaggggacatcaaagaattcacacaggagaaaaaccctatgaatgtagtgaatgtgggaaaacttttgttcagaagtccaccctcagagatcatcacagaattcacacaggggagaaatcctttcaatgcaatcaatgtggaaaaacatttggccagaagtcaaacctcagaatacatcagagaactcacactggggagaaaacttaccagtgtaatgaatgtgaaaaatccttctggcgaaaagatcatctcattcaacatcagaaaactcacacgggagagaaaccattcaaatgtaacgaatgtgggaaaacttttgcccggacatcaaccctcagagtgcatcaaagaattcacactggggagaaaccatttaaatgtaatgaatgtgggaagaaatttgtccggaaagcaatccttagtgatcatcagagaattcacacaggggagaaaccctttcagtgtaataaatgtgggaaaacttttggccagaaatcaaacctcagaatacatcaaaggactcacagtggggagaaatcttatgaatgcaatgaatatgggaaattatgtaagaagtctaccctaagcttataccagaaaattcagggagaggggaatccctattgatgtaataactagaaaatccttttgacaaaaggaataccccatttgatatcagagatacacaaaaaaccaattgagggtagtgaatgtaagaagacagtcccagaagtaaaccctcactgtgaatcagagaattcacataggaaagaaaccagatgaagatgaatgcaggaagaattgtgtccaaaatgcaaccttcagagtgtatcaaagaattcagacaggcttctgttttcagagtactatggataggcctgaatgaagtcataccctattagatagctcccacacatcacacaggctggtaatctcttcaccagcaccaatttcattttactccaggcacatagtccagatttcccaatctccttttcatccaggttggtctttgtgactggctactaagatgtggatgtccatgatgtatatcacatcccagtctgaaacataagagacttccctaataaattaccagggccctgtcacaacaaaatggatatcatttctaggacaagcttggtgccgtgctttaatgtggcatggtacaagataaagaagtctgtgcctgaatgaatacacgcagcaaaattctcctcttctgtgtctttcccagttgaacattatgtgagcaaaatttaagcttatacagtagtccccccttatctgtattttcactttacgcaatttccattaaccatggtcaactgtactttaaagttattaaatggatccagaaataaacaattcctacattttaaactgcacccgattctgagtagtgggatgaagtctcatgccctcctgctctcccatgagggttattgaatcattccttagtctagcatatccacagtgtatacactatctgccagttagtcacttacttgacattttagttatcagatcacctgtcagggtatgacagtgcttgtattcaagtaacccttgttttactaaataatggcctgaaattgcaagagcatttctggcatgttgttgtaattattccattattagtccttaatttataaattaggcacagcaagagattaaactatcataggcatgtgtatatgtaggaaaaaaatatagtatatacagggttcagtatacccgtggtttcaaacatcaacttggaattcttggagagcattccttgtagttaagcagggactactgtattctgttgagctttcacatgtttgagtctatttgtttctacacataatttagttatcttctgctaggaaggcagaaagcttctgtgtaagccaggcttaagtcaatcagagggcacaaaccttattaggaggctagagagtcaaggagaacctcaaatatgatcagagaattgtggaaaagacatcctttcaatgtaatgaaattgatagtaccacctgatacagggctttgcatgaacctaaaagtcttttggctgaatggtgagcagccactgtgcagttcaacgtaagtgtgccttaattgcacagaggtactgcccccacacctcctgacacctccatataccccagctatatctgctttaaggagttttccctggctccaaaggccattggcacccacccaagtattatgggaaacctccagagaggggagggactcagatttatatggctttattgaatccatgcccaaggcaacatcttactagttcctgtgggggtacaggacacctagatttagctaatggggtttggcaatgggaaggcaaacaaatttaataactttatgggtgaggtactttgggccagtagagtatactacagttatgtttacatctgaaagtgtagtagggattaattcccataagttatagagagaattctaattccctgtaattcgcataagtcatagaattctaatcaggaataattgtatgtaaagatacctctgaggtccaacagctctgatcattttgggcttcaagtctctctctgtgactggtgattttgtgggttgaaacttctggcaaaagggggcagcccttgggagctgggggccaggggattgacttggttccctgacaagggtaccaggtccaccccttctgaaaagcagctgttagtttactcttgggctcttttacacattggatatctcttccttgggtagagggttctgacctaaaattccactttaggagtttgtcgtcttggactcaacaactaacaaaatgaaaaggacccagcaagcctcacttgtggaatgaaaatggggcattcaggaaagcacctgtcctggccccacagtatgtcagctgtataggcaatagtagtagctgtctcttagaagggaaataatgtatcacctctttccagaacgaagcaaagttgctggcttagtagagccctcaattcatagaggttactgtaattgggcctggctcactgatgctttcgccaactgaaactactaggatcctgtgtgtgttcaaactcagtgccattaacaaacccaaagtgaagcggtcactcctctcagtggaaagagcacgaggatgttctcagctctggccaatactccatttcataaaccatgttacatttttgttaagccttggctctggatgtggcctagatatttgatattctaattggaaattacagattaaaaagcaccctttctttgtacagtgggggtaaaagtcacagctgcttagtacaaccatctgggttgctcaagtagatgcccataataagagactattttctgataagactgactggaatcaagctgccgacagctttctccatccagattgtgacggttgctacctggatccatcattttactggtatggcaaaaaatcacccatgtgacactgggtgacatggtaaaagtacatggtacttttacagtaccatgtactgtacaaaataaaggtctctttatctg

SEQ ID NO: 36827 - DNA, 13746 bp, Homo sapiens
gcgcggggcacgctgggacgtctcgctggcgggaggccacgggctttccacagcgcgggggaacgggaggctgcaggatggtcaagctgacggcggagctgatcgagcaggcggcgcagtacaccaacgcggtgcgcgaccgggagctggacctccggggtgagtccgggggcgtgggcggccagtccccaggcggcaccgagccgccttattttccgcgctttgccgcgtgcaccgaaggccggagcttggcccgcgggccggttgtctgggctccgaccgggctgcgcagggaacgccgggcctgattcttgccgttgttgccagatgagcatccggttaagctcctgggagccttctgttagcgccgtgcctcttgacaggcacgggtgacttcattacttcctggtgcgtcctcgtggggccctgttaggccttgcttggctgtttcgccgctggctgtttgagggcccggaagagcggctcattaatggttgtaacgcaagtgcagggcgcgggattggttcttaatacttgccgccagatgatattttgagcgtagataggatatgtgttcattattcctaatgtgagggaggaaactaagtccccgaacaaccgcgattgtttcctccagtattttctacttagtagctttaattgtctggcgtttcccctatatgaagacgttttaaaaattgaactgtgtcacccaggcttgcaccgccgggtgctgtgtgtaagttgtggaagcgctcgcaattattcagattcctgtactatttcaaccttagcaagacttggtaagatactgggagggcagctagctagttggcatttcaggagacggctttaaaagggacgtgatagagcaacttctctgaggataagaccatgctgtcgtagcctgagatttgttcccatggggacctatggcctcggagcagcatcgctgcgggatctgcttagatttcttgccgacctttgggaaatcccactgttttgtgttgtgttgtgttgagatggagtctcgctctttccgccccagctggagcgcagtggcgtgatctcggctcactgcaaccgccgcctccccggttcaggtgattcctgtgtctcaagcctcccgagtagctgggaatacaggcatgcgccaccacgcccggctaattttttgtatttttagtaaagacatggtttctccatgttggtcaggctggtctcgaactcccgacctcaggtgatccgcccgccttggtctcccgaagtgctgggattacaggcttgagccactgcgcccggcccaactcaccacttttgatgatctctgccatttctctttatggagcatgtgcagtgttgagaatacgtattttgatgcagtacgtgtagtacagctctgaattgtgtcctttaactttgggtaagttctttttttagtagaccttgcttcttcggaatatttcttttcttatagtgcctaacacaataattatgcccaaattagacaaattaacatttgagtgttcacagatttattactgtatttaaaccattgatcttcaattctgaattggagctgggggaggggagggagaactgtcgtgatatgttgaggctgttctgatgggttctaagaatctggcctgtggagatgcaagagtggagaactgtcgtccacaatgtttgaacgccgtttgggcactgagactaagcagctccaagtgtaaactcctgttgtgccgattccgcttaactagcccaaacgacttaggacagtgtgaggcaccttgtaaatgttcttataaatgttagctgcctatatcagccattgttattgtccttgtccttgttgtcatcagattctaagcttcatggcactggggacttgagactcgttcagcgttttctctctagtatcttaaacagcggcaagtcatgcgtgacccgacataggtgctaggtaatacttcctgaataaatcaaagcctggagtcagatactatgaaatacagctaatgctttaaggggcaactgtttagttatattaatacctcttgtgtttttttcctccattttatagggtataaaattcccgtcattgaaaatctaggtgctacgttagaccagtttgatgctattgatttttctgacaatgagatcaggaaactggatggttttcctttgttgagaagactgaaaacattgttagtgaacaacaacagaatatggtacgtgtctgtaggggaaagtaattttttcccctagagtaaatgttgcagtgtttcctgaagaagttgtagcacgtgctactggttaaacctacatgtttctttttctttttctttttcttttttatttatattttgaaaaaatattttttccataatggaagccacattcaatacatgttttttcttaaaatgagaaatgaacttcacttttcctatagagatccagagattaacctggcattagtctagtcttacttgtatctgttcagaaatcatgtatttttattttcatggttaagtttctaaataaaaacatgttgctttgtatacattttggcttctaaaacaattatcaaaggggtcatagtaaaaggatatataaaggtaacaattatacttttgactgagcgtctctgcttttttttttttttaactgcaactaatttctagactgttacttattgaaattgagatcttttttgaccctgccttcatcagctctgtgtaaactttattggaaaaaaagcacttggtgtatagataatgtctttaaaggtactgggtggtgagtgggatttccttcagatagaaatatttctcataggttaaccattcccctatagtatagttgttgtgtcttgtacctgagctgggaatccagaattatttgtatttctgtgctgcctgcacaaaaaatcatgaagtgagttaagtagtttgtgccacccaggagttgcaccttttctcaggttccactagatggtatgacagtggaattagccccaggcagtgtctaaaatcccacttctgttgctgaccctgtggcctcagaaaagggttctttttgctttgtttcctctttatcagggtgttggaagaaggatctctaagtgtctctctgtgatcctctgagcaaggaggtagataaaattgttagcttatttaattttcacttttactaagactctatttttattttagccgtataggtgagggacttgatcaggctctgccctgtctgacagaactcattctcaccaataatagtctcgtggaactggtaagttgcacagaaggaaaatgtatttggtgggtggggttaaaggtactatgtgcttcctacagaaaatttacaaaatctagaaaatgatctcagtatcctctttcttgtctttttcttaattcaggatctgggccttttgggttctgcagccgtatgttgcaaatattttcctacttttacttgacttttgacttaggatgtcttgttagagaagttcctaatttaggtgcagtccaatgaatcaatcttcttctttattgtagcccttttgatgtttaaatttcccctattccagggttataaactcctatgttgttttctacaattgcagtgttcaatatagtaccagtaactacaggtggctacttataattgagatgtgctagaactataaaatacacactggatttcaaagacttaagtgcaaaaaaaaaaaaaagtaaactatctcagtaatttttttatatcgatgttgaaatgataacgttttggataataagttaaatggcatattattaaaattagtttcacctattttaacatggctactagaaaattttagattacatatctgatatgcattaaatcttgctgaacagttccagtctagaaaccttgttttactcttcacgttagatgaacaatccacttggaactgttttcatgctttttaaatttctgttctgtgtatccaatttttaacataattgagatactgtgtattgttttgtaacctaaattcttcacttaaacactggatgcttaaatttatattgtaggccaggtgccatagctcatgcctgtaatccaagcactttgggaagccaaggtgggaggatcacttgagcccaggagttctagaccagcctgggcaacatagtgagaccttgtctctctctataagtaatttttttagaaaagccgggtgcagtggctcatgcctgtaatcccagcactttgggaggccgaggcgggtggatcacgaggtcaggagttcaagaccagcctgggcaatatggtgaaaccccgtctctactaaaaatacaaaaattagccgggcgtggtggtgggttcctgtaatcccagcttcttgggaggctgagacaggaggattgcttgaacccaggaggcagaggttgcaatgagctgagatcatgccactgcactccagcctgggcaaagaaagagactccgtctcaaaaaaaaaaaaaaaaaaaatgccaaaagtggtagcgtgcatctgtggtcccaggtattccagtggctaaagtgggaggatcacttgagccctagccatcagtcgaggctgcagtgagacatgatcatgtctctgtactccagtctgggcaatagtgcaagacctcatctcaaaaaaaaaaaaaaatcgtataacttaattttgtgacttaaccttcctcccgtattttcctgattgttgagaatgaactgtgttcctttccttgtggacaaggtccatagcatccttcagattctcaaggagatgcttgactacaaacataagacagcactggtccatggccatgtcctttctgaagtgtgtgaagtattcaacccgaaatacatatttataggcaatgtgtctcatgataggtgctgttagagaaattagagttgtatttaaagctctttgcaaagatgaagactactgggcttatcagttattgagagaggtatgttagaatctcacagcatggtagtggatttgactatccctgaagttctgtcgattttagttttgtatattttgaagttgccttatttgatacatacaaattttaaattattcatatctttctggtgaacggaaactttttattatgttgtgaccctcgatctctattaatgctgtttaccttgaggtttcttttacctcgaaacaatctttgttttggttagttatatgcatgataaatcgttttccatccaaaatttactttcagcttgtctgtacctcttgtagtttagatttctctcttaaaaactgtatggttgaattttttttttttttttttgagatggagtggctggagtgcagtggcgagatctcggctcactgcaacctctgcctcctgggttcaagtgattctcctgctgcctcagcctcccgagtagctgggattacaggtgggcgccatcacatctggctaatttttgtattttttttttttttagtagagacgaagtttcaccatgttggtcaggctggtctcgaactcctgaccttgtgatccacccgccttggcctcccaaagtgctgggattataggcgtgagtcaccgcgcccagctctggttggaattttttacaatccagtctgaaagctcttttaagtgaattatttatatttagtctgtttacatttaatgtaattactggtgtgttccagtttgtcttctctctgttctggggcttcctgtctgtcccacccgttcttcaatccgttttctctcctttattgtagatgctctccttctgtcattccattttttcttctgatggtttagaaattactctctttcaatcttgagttagcatcgtaggaattaaaacacacatatttataaaagtttaaaattaaatgttaagatcactgtaccatgaccttcaacatttaattttaaactttgacacctttaccctgctaaacaatacagtacagtgaccttcaacatttcagcagccttcgggttgttacatatttattcttttttgaagcccatcactacatcgccattacgttttacactgtgtatgtaacaaatgttaccactttgttctttattcctttttggatcatcttcagtgggggtaaaacagtatcaagctctagagctccctctggtggtttttgtgacatatttgaagatggcagcttgctttttgagaatttctggctctgctctccctgtttttatctgtacttttttttctcattgtgcctcttgcacacacacaccccttccccaccatctacccaatttgcgcctgttccagcagtttctcttcagggcagggccgtgttgggacatgatttctattaagagtgagggcccaaattgctcttgcccctgcagcccttatcacagacccctgtagtcattattggaacatgctggtcttgggcctgcttttctcagtcactggagttctccagtttgtaagacggctcctcgcctcccctctgcttcttcctgtacaaaggccgtcaccctgcaagccttgttgctctcaacatgggttgtctctacttgttcctattttagagttactgcagaatgccttgccatctagcttggttgtagctggtaaccataggtttttgtttttttgctatccttattgcactatgttttatggaacaattggagaagattaaaaattcaccctgcccactgggcgtggtggctcacgcctgtaatcccagctctttgggaggccgaggcaggcagatcacgaggtcaggagatcgagaccatcgtggctaatacagtgaaaccccgtctctactaaaaatgcaaaaaaaattagccgggcatggtggtgggcgcctgtagtcccagctacttgggaggctgaggcaggagaatggcatgaattcgggaggcggagcttgcagtgagccaagatcacgccactgtactccagcctgggcaacagagcgagactccgtctcaaaaaaaaaaaaaaaaaaaatcaccctgccttctttccattaattcgatcatttttaagctatactattccttgtccctgcaaattttatttaaagagattttcaggggcagctaggataaatgtaccttctttcaaaagacagtatacctttgttgttcttagacgctgaagctggcgctagcaggaaagcccacttacaccaagattctggcttgcagttcccagtgtgaataggttgctccagagtcccatcagctttgccattgttttcttttccaaatcatggctcagcagccactttgagattcctgtaggaaagcaatttcttatctcctgctattgagacagaagctgttaatgccaagattttaagaagctcccatgtattcatcggtagaaattatttaaacatttgtgatgtgctagtattgggcttgttgctagagagtaaaaattcagtaaataatgaaaagacaacttgcttcaaaagcactctccatttcagaatctcaaaatagcgtgtggtattcgcgttcttacctgtggctattgcttgacagggtgatctggaccctctggcatctctcaaatcgctgacttacctaaggtatgggaattacatattgtgacaaaatgaagccctttaaaataacattacttttaccagccttgaccttaatgtaatcagataattaaaaaatgtggcacatatgcaccatggaatactatgcagccataaaaaaggatgagttcatgtcctctgtagggacatggatgaagctggaaaccatcattctcagcaaactatcgcaaggacaaaaaaccaaacaccccatgttctcactcgtaggtgagaattgaacaatgagaacacttggacacaggaaggggaacatcacacaccggggcctgttgtggggtggggaaaggggggagggaaagcattaggagatatacctaatgtaaatgacaagttaatgggtgcagcccaccaacatggcacatgtatacatatgtaacaaacctgcaagttgtgcacatgtaccctagaacttaaaagtataatttaaaaaaaaagtgccttttacaaagaaagattgaatatatttccttaatgttaaattgttacaatgttgcaatgtgaagaatgtgaatgttcccttgatttataggttccttagactattcaaacagacctcttgagtgctgtgccatgaacaagtttgccattgtgtcattccttttcttgtagtatcctaagaaatccggtaaccaataagaagcattacagattgtatgtgatttataaagttccgcaagtcagagtactggatttccagaaagtgaaactaaaagtaagtagtaatctgttgcttgtgagccattatagagttgtgtgtttttctttatatttttgttactgattattaaaattgtctaaatgagtaaattttaccattagtttgtaataaaagtgggagggaaaatgttacatcacatttttttctaatagcagagtttatgatagaacttttaagttggagctctcttatgtaatgctggctattccgaagttcgcaaagtgctgaggccacggtgagcagtcttaacagtggattgtctgcctagatacgttcccagcggagaacttaatgtaacctactttcgtgcagctccgtgtgttaggatgatttttccctttattaggaattcattattttattattcatttaattgccttcttagttccctgggatcccctccttggagctaggagaatgaactttcttcagggagctctaccaaagaaagaagaccactgtgtcttctcttaatttgaaattgctttttggtattttcaccagcccggagtactgtaggagagttcgcttccatgtcttctgaggaatgcatctaaatgcatgtggtattcctatttccattaactctgtgtgtggtgtcgctgtaggagcgtcaggaagcagagaaaatgttcaagggcaaacggggtgcacagcttgcaaaggatattgccaggagaagcaaaacgtaagacacggatatccaacttaactctacttcaccttcagaaacatgatctgatctgtctggcagttcgtctcctacaaaattaaccaaaaactctgacatattaatgtggtattaaatttgagtgcttatagtccatgtacatcaatggtccacacatcacaagaaatttctaccagcttagcagagcaaatatttcagtagtcagtcttcatgtgataccatgtacatcctattttctatataggaagatgaactggatggtgtttctgaaggagagagttcttgtatcagtttgttaacaaagataagatactacactggttgaattactttcaaaagcttttgaaagtaaaagagaagcaacttctgttggtctaggtctaacagttatgttcttccccctcttaagttttaatccaggtgctggtttgccaactgacaaaaagaaaggtgggccatctccaggggatgtagaagcaatcaaggtaatcatgtgttaggattcttggactggaatgagctaagatgggttcagaacacaaagctggataataaacatgttccgaacattgcagatttcattttcccacagttattagcatacagcaatatttctgtttaaggaaaaactagcataaagttattatttgatcagacttgaaattacacaagctaattaatgtggaggcagctttgtctttctcattttccaaggtgcatttatcacttcgaacagttacttaccttggtatgctgtctcagtgtttgccttaatttttactttcgaagatttgctgtctggcaaatccttttgactgatcagtagggaccctcgttttataatattgcctccttaaattattcagtaacataattgcaaatagttacttcacttagctacgattttagaacatgtggagtgattatttataagaaggcctgcatctcttcaccaattttagaaatttgtggtttggcttctagttttatttttgtgggccaataacattcttccccctacaccaaagtatttaatgttcctgatggagaagttgctgtgaatttctgtaggtgattgacacttagttttctgggtagctgatacttggttgaagttaatcatccatctccattgccctctgtcctccagaatgccatagcaaatgcttcaactctggctgaagtggagaggctgaaggggttgctgcagtctggtcagatccctggcagagaacgcagatcaggtgaacaaatggtgttctttgtatgttcaaattaatgttacactcagagtgtaactcacaaccatttagatgccatgactctggaatgccagagtagtgcctccttacatcaaatctaatatatgaaatctctttaaatgctctttgaagataaagtatttgatgggttgggtgcagtggctcacgcctgtaatcccagcactttgggagcctgaggcgggcggatcacctgaggtcaggagttcgagaccagcctgaccaacatggagaaaccccatctctactaaaaatacaaaattagccgggggtggtggtgcgcgcctgtaatcccagctactcgggaggctgaggcaggagaatcgcttgaacccgggaggtggaggttgtggtgagccgagatcgcacttttgtactccagcctgggcaacgagcaaaactgcagctcaaaaaaaaaaaaaaggtatttcatgaagaaagttaagttacagcactgtggggggttttatgtaaaagttgaagctagaattacttcagccatggagtgcaccgaacactagcgatagccatgtggacttttacctatatatatttgcgtgtgtgcatgatacctcagtagttaggaacacaggctctagagccaagcagtccgaggcccaaatctcagcttcaccagctctgcctttggacaagtttcttcaagtctttcctcatctttaaatctgagataacaatagtagcaaacctcaaaaggttgccgagaggctgagagactgaacacagcacaaggctcaacattagcgagtttttgataagtggtaactgttctgacatctgaatgcctgctttatgctaggctgcatgtggggcactagggatataagataaaaagtactgaaatacgtcttacaagttttgatatgaatgtaactggggacagccactcagactgccgtcttggggaagtttcctagggaaataatgtttgagctgggagctaaaaattaaaaagacatttttttcctttttgagtcggagttttgctctttttgcccaggctggagtgcagtggcgcgatctcggctcacgccaacctccgcctcccgggttcaagcgattctcctgcctcagcctcccaagtagctgggattacaggcacctgctaccgtgcccggctaattaatttttagtagagacagcgtttcaccatgttggccaggatggtctcaatctcttgaccccgtgatccacctgcctcgtcttcccaaagtgctgggattacaggcgtgagccccgtgcccagccaaaaagaaattttttaagaccagtaattctctactgtatggtttgtgggcctctgggagtctgtaaggtgaagactgattttgttgttgttgttgttttgagacggagtctcgctctgtcgcccaggctatagggcagtggtgcaatctcacctcactgcaagctccgcctcctgggttcatgccattcttctgccccagcctcccgagtagctgggactacaggcgcccgccaccaagcatggctaactttttgtattttttttttttttagtagagacagggtttctactaaaaacacatgttagccaggatggtctcgatctcctgacctcatgatccacccgccttggcctcccaaagtgctgggattacaggcgtgagccaccgcgcctggccgaagactgttttcatctaataacaccaaggtgttacttgctttagtatgaacatttgcactgatggagcaatagtgggtagaactgcgggcacctcagtaggagtcaaggcagcagcctaaataatagctgttacattcttccctgctctgcactcccagtagcgtgcataccagtttcacttaagagtgtcctggatgcagcagtaaagataattaaatatcactcctcgggcacacgtctctttgatattctgggtgacagaaagggggtgcacatgtctgcattcttgagttaggtggttatctccatgcactggtgcagttgtttcagttgagaggcagctacctgtcttctcaaacatgatgaagtgagcctgtcacttcagggaaaacaattgaaaattcaaggtttaaagcaaaaattaaaatttagaaaacttgtatccactgccgtaacctgccagcttcccagtactttaagacttttctggggaactcaatagtaatgttatgtgcatgtgaattaatgggtgtgacatttttgatgtgtaattacatggctcaacgtttggaagatctgcaaaagtcggtgaaccacagttttccaaatgatacgaaatcatgtacgggtaaaagatttgttcaaagtacaagataaaccaagtaagagtatgaaaagttcattgataaggtttcagacttttacactgccatctaaccttgaggaagctaccatttgtcaagttttagcatagtatctaaaaagagcatccaccattatctgcacaggctgttaaaatcttcctcccttttctaactgtgtgcctgtgtggccagattttcttcatgcccgtcaatcaaaatgccgtattgcacaggatggaatgatgaaaccaatacaataattcagctgactgatgttaagtcagacattaagtcaacaataacaattgtttcccaaacaattgaaggagttacaacttttttttccccctggaatacattgagcaaaatacctgccataaattgttgaacaaatgtaacattttttggtagttgttggcatatttccctaatttagagacaataaagtcattgaactgttgccagtatatggcatgtagtaggtgcccagatgtttttgagtatttccggtttctttgcctacggtagtgccatgaaaagcacatgagtataggctttaccttcaccaaaaatgaattattatcaactacaatgggaggcaacaattttgaaatctttgtgacccttttcctttgaaattgagcatcccttccagtacctgccaaagacagactagaccgtccctggacgataagctcctcaaaggcaggtgctgcttttgatctttttgtacctacttcagtgtgtaacaaacagtggccacagaacaaacacttgcatgctaagggaatggattctctaaaattgatactacttttgctttggtggttttctttagggcccactgatgatggtgaagaagagatggaagaagacacagtcacaaacgggtcctgagcagtgaggcagatgtataataataggccctcttggaacaagtcttgcttttcgaacatggtataatagccttgtttgtgttagcaaagtggaatctatcagcattgttgaaatgcttaagactgctgctgataattttgtaatataagttttgaaatctaaatgtcaattttctacaaattataaaaataaactccactcactatgctaccaa

SEQ ID NO: 36828 - DNA, 334217 bp, Homo sapiens
tcccagctactcatgagcctgaaatgggaagatcgcttgagcccaggagttcaagactgcagtgaactatgatcgtgccactgtgctctagcctgggtgacagagtgagaccttgtccccaccccacccctcaaaaacaaaacaaaacaaaaaaaaacccaaacaaggaaaaggaatgctgtttggtgcacgtgtagtagtgatattaatagttggttttcattgagcaccaattatatgccaggtatgttaataactatggctaacatttattcactgcatttattggatacactttacatgtattcctttttctcatttttccctcatagcaatccatacacataggtactgttctccccactgtacagatgaagaaagtagaggacaaaataagtttcccaaggtcacacagtgcctgaactagaatttgggacaaggtttttgtcttccttgtggtccccaaggtatgaattcttgggcatcggtgatagttaaggcttgatagaaactttcccaaaagcctggtgctgttagtcatcctctgttaataggtgtcccggggcagctgttctcaacaccccttcctggcacttgttcttgttggcattcggctttcaggtgtttggagaaccagaagcccttgcctgctttttgacttaaccccatgtttcaaagcagatcaatgtatatccctaaattaaattatggacaccgcaggcgctaattggcaggtgagctgcactttaaatagaccacattaattctggcagtggaagcggaaccctgctgggataattcttatcatcagcagcatcaccctgacaagctttaaaaggattctgtagcagtaagcaattttgcagaattgaaaggtgaaaacacactttaaagcgttcatgtagattcaaggtcggagggaggtgactgcatttttcaagacaggctgcaagtgagagtcacttgactggaaatgtgatggacgtaccgacaatggtctggggtattttgaaatacgttgttggccagctggcccagggcgttgttgtcgccagattccccgtcctggtttctgagtgaggtggagagtggaaggaaggctgttttgtacagttgtgtggattagactgatcggatgagcttgggaagtggattagtttgacatttagggatcgagacagaagacagtcttgagggacctgccctcttgctggtttttgttattcctgggaagtttattctaaatgatcccagtgattggcttgatccacaaatacttatgcacgctcatacggatgtatacatttagatgctgctaacacaaaaaggaacccacgcgaatgccctctgctgtgaagggaattaattattaagcaaatgctgattggtcatcatggactgggcactgtgctcggtgctttccttccctttctagttaccctagtaaccctgggcgattctgcacttttgtgttgattttatgggagaggattttcaggcttagcatggttgagtgacttgctcaaggtcatttggttgaatggactttttctctgttgtcctgcctgctagactggaagccccttagggacgagttcttgttgtctctagctggtgacacatagcctagctcggttcacagctcccaggaagaatgcagtggatcctagtgaagttgaattgaaacattagagtgaacttaactagcctgccatgcagtttctggagatgggtgtacttgcctccttctggaaggcaggttcaaagcctttgtcatgtttcagaggggactgtgagcctgtttagctcctagattggaagccaggtccgactgcaaagactcagcttcccccacttggaatattaaacagttgtgaacgtgatcattttgaagaaggccaagtcccctcattttgcagggcagtgtgatttagtggtttgcagtgagctctggggtccctttctgccatactgtttactaattgtgttgctgggtgagtcgcttcacttgtcctggcttcagaccttgtctttcacatggagatggccttggttgtgatgatgtcagatgtaaagtgtttactgcaatggctggtgcaaagttaatgctcagtaaatagtagttgctgttgctgctgttattattattgccagcatgaaaaactgttaaagagccaatgttaagtgaagaaaattgatcacaaaattatgtatacactagcattacaactatgaaaatatctggggttgggcatggtggctcccgactgtaatcctagcattttgggaatctcaggcaagaggatcgcttgaagccaggagtttggtactagcctgcacaacatagcagaatctcatctctacaaataaataaaaattaaaaaattagctgggcatgggggtgcgtgcctgtgtctcagctacatgggaggccgagacaggaggatcacttgagcccaggacgttgaggctgcagtgagctccagcctgggtgacagagggagaggccctgtctcaaaaataaataaataataattaacttaaaatgtatataaaaaattttaaaaatctgtgtacatgtggataaaaagtggtgggatgtgaggagatacaagtagttgtaggaatgactgtcttatggataaaaacaaactttcttaggtttcccataacgccttaaatctgttcctatcctcagactgagtaatttgacatgtggaaatctttcctaaggaactaggaatgaggacaattatttatgtataggggtgttctttactgtacagagggaaagttggccatgtgccatgcccttagcagtatggaaatagttgttttactggaaagccatcaaaaatcatctttgaaagacttttaattgtaataggaaaatgttcatgctctagacaagaaaataaatgaatcaggatccaaattacacatacaaatatgtatgcgtatacactcatacaatatgatgtggttttatttatttattttttgagacagagtggagtggagtggcgtgatcttggctctctgcaacctccgcctcctgggttcaagtgattctcctgcctcagcctcccaagtagctgggactacaggcgtgcaccaccacgcccagctaatttttgtatttttagtggagacatggtttcaccattttggccaggatggtctcgatctcttgacctcgtgatctgcctgccttggcctcccgaagtgctgggattacaggcgtgagctaccacgccagcctgttttttttttttgagacagagtcttgctctgtcgaccaggctggagtacagtggtgtgatctcggctcactgcaacctccgcctcctgggttcaagtgattctcctgcctcagcctcctgtgtagctggaattacaggcacctgccaccatgcctggctcattattgtatttttagtagagatggggtttcaccatgttggccaggctggtctcgaacccctgacctcagatgatccgctcgcatcggcctcccggagtgctgggattacagacatgagccactgtgcctggcctgatgtgttcttttcttctggctgctgtaacaaattaatacacaattggtggcttttaaacactataatttattctcccacagttctggaggccagaagtccccaatccatttcactgggctaaagtcaaggtgacagcagggctgcttccttccagaggcttcagggccgaatccgtttctggcccttccagagtctgctcgctgcccaccttccttggctatggctgccccattctagtctttgcttctctggccacatcatgtcctcctcttctgtgtcaagtttctctctgcctgcctcttatgaagatcttgtgattacatcagcctcacagggattatgcaagataacctcccagtttccagatcctaacacagttgcacagactcttttactatataaggtaatattcagagaattctggagcttaggacgtcgatatctttgaggattataattcagcctacagcaaatgttgattttattataaaaaagaaaagtgcagtaaaaaagactgaaaattcttgaaaatgtcaatattggtcttttctggatgagaggttttagagtcatttttatttttgatatactcttctgtatctcccacctttttttcttatttcattattgtttttgaggctgagtcttgttctgtcaccaggccagagtgcagtggtgcaatctcagctcactgcaacctccgtctcctggttttaagtgattctcctgcctcagcccgcccggtaggtgggattacaggtgtgcgccaccatgcccagctaatttttgcatttttagtagagatggggttttactgtgttggccaggctggtcttgaactccgagcctcaagtgatccaccacatcagcctcccaagtgctgcgattacaggcatgagccaccgttcccagcctcaatttttattttagattcagggggtacatgtgcaggtttgttacctgggtacattgtgtgatgccgaggttcagggcacgattgaacccatctcccaggtagtgaacatagtacctggtaggtagtttttccgtccgtgctctcctccctctctactctctctagcagcccccagtgtctgttgtttgccatctttatgtctgtgtgtacccagtgtttagcttccatttataagtgagactatccaatatttcgttttctatttctgtgtaattcgcttaggataatggcctccagtcatccatgttgctgcataggacacaattttgttctttttcaaggctgcatagtattccttgtgtaaatgtaccacattttgtttatctagtccactattgatgagtatctgggttgataccatgtctttggtgttatctcctaccttttccatgctaaggggatactctgttacaatctccaacatcgcctagaggctttgtgtgttcctctcccagtgctgagtgccccaggccgagtgccaggcacctgtgccctctctccgtagagcccgtgttctggtactacgtgaaggaggtcctcaacaagcacgagctgcaagcgcttctactccctgcgccacatcgcctcagacgtgggccggggccgcacctggctgcgctgtgccctcaacgaacactccctggagcgctacctgcacatgctcctggccgaccgctgcaggctcaggtacgtggccgggatgggacctggaatgggatggagcaaggggtgaagatcttggagtctgtagtcagaccacctggattttcatcctagttccccgatctggggcaagtgggcctccctctgacagctccggagtgttctgctgagctgtggagaaacttgggggagaatcattgagagactgcctgtaatgggctcggcatggcacttgcatacagccagcttggatgtggagagagctgttgtcctaggacatagcttcctcttcactttctggatttttttttttttttttttttttttaagacagagtcttgctttgtttcccaagttggagtgcagtggcatgaacacgggtcattgtagcctggaccaccctggctcaagcaatcctcccacctcagcctcctgaccagctaggaccctaagtgtatgccaccctgcctggctaatttaaaaaattgttttgtagcgatggggtctcagtgtgttgcccaggctggtctcgaactcctaggttcaagtaatcttcccgcctcagcctcccaaagtgctgggattacaggtatgagctaccatgccaggtgcagaattttaatttgggattcttgcattcattcaatcccaaactgaaaaaaacatggaaattttatattggggaaggaagtcatttttgtttgtttgtttgtttttgagacggagcctcactctgttgcccaggctggagtgcactgctgctatctgggctcactgcaacctccatctccccagttcgagtgattctcctgcctcagcctcctgagtagctgggattacaggcgtgtaccaccatacccagctgattttttgtatttttagtgcatacggggtttaatcatgttggccaggctggtctcaaactccagacctcaggtgatccacccgcctaggcctcccaaagtgctggggttacaggcgtgagctactgtgcctggccgtggccattacttttgctctgagaatggtggactagacaagttgttttgtgtccttgagtgatacggagtgaccctgatgaatcctgttctggttccttaagtaacttcctgatcagcaccgcccagatcttcaacagtgaaatttcactgaattcaataagtgggcagcttgtgagtagtgtggcgtgttcccttgattttatatcttgccctgtgttccctagtttaggtctcctcttctgctttatctactgctgtggtcacctctctactggtaatgtctcagatcttctgggattgtgcactggggctcttaaaaatacccttaaagttctctgttgcctgtggctccttgttcaattgtatggcaagactctatgtgtccaaaatgggagggcttgggagccaggaggactgacactgacgacacctgtgtactgctcacggtcggagttcggaggctgagaatgtctggacctctagggcattaaccagctttagttaaggaaaacacactcctgtttctttctttcctttttttggagaagtctcgcttttttgcctagactggagtgtagtggtgcaatcttggctcactgtaacctctgcctcctgggttcaagcgattctccttgcctcagcctcccgagtagctgggtctaccagtgcccaccaccatgcctggttaattttttgtatttttagtagagacgggtttcaccgtgttagccaggatggtctcgatctcctgacctcgtgatcctcccacctcggcctcccaaagtgctgggattacaggtgtgagctactgtgtctgacctactccttttttttgaagtgaatttctgtgaagctccttccagcatatcatttacgggtagttcagagttacatactcagtctcaaagttgaagtgaccaacaaggagaagtcagtccagcaggtaagaatcacagttgactttacctggatcaccagccacttccccagctggatgttgggaaaacacattcatttagatgcgtgaaaacgggctcagatttttaaaggattatgattttaggaatcaggtgcagtcagaatgtcagcttgagcatgtggtttgtacgtctactaacattttctgggaaagtatattggaaatgctcctcttctttctttctgttagttgtattcagtcacttcagtggctaatttttccagtctctcactcaactacaggtcatgtatccctgactttgctttagtgaaattgactttttccttgattaatttagaattcaatgacctggcggggaagttatggcattggggatttttggtttccattgcttaacatgaagtcagagagagcttggaagctggactcgggagacctgcttttaagccctggctggaccatttattggctagatgaccttggacaggccctgtgggcttccttgacacccctaccccaactgccatctagatttgtggggcatttttagcctcctagccttttccaaggataatgtgggctttcaggcctgtaacctaggcaggcattatattattattattattattattattattattattttgaggtggagtctcgctctttcgcccaagctggagtacagtggcgcaatctctgcttaccaagcctctgggttcaagcgactctcctgcctcagcctcccgagtagctgggattacaagcacctgccaccatgcccagctaattttttatatttttagtagagatggggtttcactgtgttggccaggctggtcttgaactcctgacctctagtgatcctcccaccctggcctcccaaagtgctgggattacaggtgtgagccaccgtgcctggccaaggcaggcattatattaaatgccctggttgatgaagccatagaggctctgtaatttctgtctgaaatggtctcttcttgtattaggcaaatcaggcgagccctgttggcaggcttggatttcctgtctgtctcttggggacattgcttgagtggaagtcacccacctgactgctccgttctactttgctgctttataaatacatttacatatcatgtctattttagtactctaaagctgagggtcgggggggaccagcgaggaagttgtaggatgtatgtgttcaatcttctgtttgtaaccagaagctttaaaccagcagagacctcagacaaatcatatccctcctggggtgaccaggtgcagatcttccagggagccgtctaatggaatttcctggttaatggacacagagaaccactgctaagaacgatttccttttctctttcaatctgcagtactttttatgaagactggtcttttgtgatggatgaagagaggtccagtatgcttcctaccatggcagcaggtaagcctggcccagaccagggcgccaggccttgtgacacatggcagaggggctgccttggggcagttccacagcgccatggaatgttgtgattcttctgtccctcaacaactcaatgagtcacttgctgctgtccttcttttactagcactgaatgttggtttttaaatttttatttctttaaagagagagcctcactctgtcacccaggctggagtgcagtgatgcaacctcagctcactgcaacctccgcctcctggattcaagtcatttttctatctcaaccttccgagaagctgggattacaggcgcctgccaccacgcccagctaatttttgtattttaatagagatagagtttcactatgctggtcaagctggtctcgaactcttgggctcaagtgatccacccgccttggccttccaaagcgttgggattgcaggtgtgagccaccatgcccaaccacagtgttgggtccatttatctagaatgtgagaccctggcagagaaagcgaagatttgaaggtttttagttgggctttggagatataatatgcattgcggggaattggaggtgggagacctatctttgaatcctggctttactccttgctacctggtgacctggggcagatgccgtaagctttgctgccttttctttcctctctgtgaggtgggaatcatgctgtctcagcagtcatcttcatggggctgtgagagaatcatgtgagatcaggagtcgcacacacgacgaatcaacatggagagaccctgggttgatgttagtcggtggactgttacattgttcaccctttgactcaaagggtgaaaggtggaatcagctggactgaagtgggcaacttgcttcctctttccaagttctttgttgcctcctttttgtttttccttgaaaatttatactaaactcatatatctgggcttatgttagtcctgtccattgatgagaaaaagaatttgaccatgatttcctttgtagatcataagatgcccagtgtaagtttctgtccacattaatgatgatgatgttaccagtgcacatttgatggtttatggagctgagtgttttgtgagagattgcctttaatacttacaatcctgtgaggaagataatattgtccccatcttacagataaggcgactggagtacagggagatgataagttgctggaccaaggtctttttttttttttgagacggagtttcactcttgttgcccaggctggagtgcaatggcatgatcttggctcaccacaacctctgcctcctgggttcaagcgattctcctgctgcagtctcctgagtagctgggattataggcatgcaccaccacgcctggctaattttgtagttttagtagagatggggtttctccatgttggtcaggctggtctcgaactcccgacctcaggtgatccgcctgtctcagcctcccaaagtgctgggattacaggtgtgagccaccatgcccagcctggatcaaggtcttgtagctagtaggtggcagtgctgggatttacccccaggcagcctgatcccgggacttgtgcctttacctcctcccagttgaattcttattcatattcatcttcctggctgttagggagagaatgtggcatgactcaactcccatgataacggatgtctgctgaccccagtttcatgggaggttgttttttttttttttttggaagccaagtcttgctctgtcacccaggctggagtgcagtggcacgatctcggctccctgcaacctctgtgtggcaggtatttttatacctatttaagatcaacgtgtctcctcttctgtaatctgttgtctgcagctgtcttctcttattggtggtatgactgcccatcagcaagcactccagacttttccctttttttggacaggtccgaactccatactctttgcgattaacattgacaacaaggatttgaacgggcagagtaagtttgctcccaccgtttcagacctcttaaaggagtcaacgcagaatgtgaccttgctgaaggagtccacgcaaggagtgagcagcgtgttcagggagatcacagcctcctctgccatctccatcctcatcaaacctgaacaggagaccgaccccttgcccgtcgtgtccaggaatgtcagtgctggtgagtgggaactggtgctcgaggcggagcagagggaatcagaatgtggctgatggggtggacatacctcatcatctgaaagtcattccaaggggaatggagtccagtgcacttgcgttttccatttgtgtttctgtttctcatcctcattcactctgaaagggctctgatggccttacctagatgtgagaattgctgggtggaaaaatgaacagctcaaccagagcgaatggaaagtgagggtgtgagagacaccgggagccagatgacgttgatcctcattcattcattcctttatttgttccttcatcgtattctgtgtgttaggcggtgagccgaataggaaagacagattgccagcaggtagcctgcagtctcctttgggatgggtgtgggtgggtagttcatgacaaaatatataatttaggatccttaggataagagggatgaaagccaagcatagactgctatggggaacatctgccattgggcttgcctctgattggggatggcatttaaggcctcaggaaagagaggagttgtcaggtttgactctaggctctggggaggcaaaagagagttgattcaggctgggcatggtgtctcatgcctgtaatcctagcactttgggaggccgaggcaggaggatcacttgagttcaagggttctagaccagcctgggcaatgtagtgagaccctgtctcaattttttaactttttttttttttttttttgagacagagtctcgctctattgcccgggttggagtgcagtggcatgatctcagctcactgcaacctccacctcctgggttcaagcaattctcctgcctcaacctcccgagtagatgggactataggcatgtgccaacatgcctggtttctttttgtatttttagcagagacagggtttccccatgttggccaggctggtcttgaactcctgacctcaggtgatctgcctgccctggcctcttaaagtgctaggattacaggcgtgagccactgtgtccagcctgtttttaaaaaattttaattaaaaaattaaatataaaaaaagaaagttgattcagttaagattaatttggtgagaagttttcaataccctttgattcctttgggacattaagatgttactacagcaaaattggaaattttgttgtagtatgtatgtgtatatatgtagagacagggtcttgccatgttgcccaggctggtcttgaactcctggcctcaagtgatcctcctgccttggcctcccaaagtgctgggattacaggtgtgagccactgcatctggttgaaattggaaattttgggcttaagtacttagtattctcaaatctcttaaacaaggcagtaactgtggccatccctttggaattattgatggtgaccctgcatgaaccttgtaggagatagggctgttgacagctttgtgtaacagacactgaaatttctacacccacaggagtagcagtcccacccatttttggaactgcttttgaggtgatctcagagttgtgctataccagtgaggcctcaccacatcacacattggtttagacagattgggtttttggaattggctcaaagtgtcttacatccaagtgtgatgattaaaataggggcacaaagtgtcttctgtgagagctggtcactaaggcaagcttgatttctttttcagttagcatttgctatataacaagtgatttaaaaatgtagtggcttaaaaccaccgcagttcgttacttttttgtgtaggttggcatggtggctctgctgctgggctccttcggctcactcatgggagctcgtggttagattggaagatctaagatggccccatccacatgtctggaatcagtgctggggctgctcagattctactcatggactctcatcctccagtcggctgaactggcttctttatgtatggggtcagggccactgtccaggagagcaaaggcaaagctgagaccttttaacgcctagctactagaactcacacagtgttatttctgccacttttttttttttttttttttttttgagacagagtctcgctctgtcacccagactggagtgcaatggcgcagtctcagctcactgcaacctctgcctcccatgttcaagaaattctcctgcctcagcctcccaagtagctgggattacaggcacctgccaccacgcccaactaatttttttttttttttgtatttttaatagagacggggtttcaccgtgtttgccaggctggtcttgaactcctgacctcaggtgatccacccgccttgacctcccaaagtgctgggattataggcatgagccaccgcacccggccctttctgccacattcttttggtaaaagcagggcatggtggctcatgcctataatcccagcaatttaggaggctgaggtgggagtattgcttgaggccaggagttttgagactagcttgggaagcacagcaagacctcatctctacaaataataataaaattagctgggtgttgtggcatgcacctgtagtcccagctactcgggaggctgagggcagaggattgtttgatcccaggaatttgaggttacagtgagctatgattgcaccaatatactccagcctgggcaatagagcgagatgccccaactcttaaaaaaaaaaaaaaaaaaaaaaggcagagcactacgccagccagattcaagagggtgcagaaatagacatcacctctggctgggaggagccacaaagacccattgcaaaggggcattgcacaggaatggcaggaatttgaggctgctcaacacttgactacaccccccagctggttctcctggtctcatctaccagctatgagaatattttccaaagtgaagcattgaagatcattttggtaatggtagcatccttcacatcaaagtgactgcttggaaggaacagtttcaaggtgtgctctgtggtgtgtttatttaaatcagtgggagaggcctgcatccattctgctcaatcttctgtacacagattttcactgaggattttaaaaagtctgaattcatgttacagtgtatttctcactagaatagtattttccacaacctggaagtgagttggtttcatcatccttttgtcttgcctactttttcttatactgtatcttttcttttttttcttttttttttttttgccagatgccaaatgcaaaaaggagcggaagaagaaaaagcaagtgaccaacattatctcatttgatgatgaggaagatgagcagaactctggggacatgtttaaaaagacacctggggcaggggagagctcagaggacaactccgaccactcctctgtcaatatcatgtccgcctttgaaagccccttcgggccaaactccaatggaagtcagagcagcaactcgtggaaaattgattccctgtctttgaacagggagtttgggtaccagaagcttgatgtgaaaagcatcgatgatgaagatgtggatgaaaacgaagatgacgtgtatggaaactcatcaggacggaagcacaggggccactcagagtcgcccgagaagtaagttcccctcacgcttctgtgtgtgtgtgtgtgtgtgtgtgtgtgtgtgtgtgtttgtatgtaagatggagtctcaccgtcccccaggctggagtgccgtggcgtgatctcagctcactgcaacctccacctcccgggttcaagcgattctcctgcctcagcctcccgagtagctgggattgcaggcacctgacaccacacccagctaatttttgtatttttagtagagatggggtttcaccatattggccaggctggtctcaaactcctgacctcaagtgatccgcctgccttggcctcccaaagtgctaggtttacaggcatgagccaccaagcccagcctccccttgtgcttttaatgagggggttaagttcaccgttttctctttctatggtattgggtgaaataggtctgcaagttttatatttgcccagggtatcattcattcttcaggtgttgatttaggagtgttatttggaaggagtgttatttgctcttcccttgagaactgaaagaggggaagagagtacatttgagggcacttaatacaaagttaatgtcagaatgtgtgccttgaaattcttgctttatacatacatctgtaattttcatttcacagggttcacagggtttcacagtctgatgagactgtgcctgttattgttttttatttttactctggattttccttgcatctgacttgccactagcacaggaagctcaggacgaaggcagcgttaggagaatagttgtggtatggtgacttctgtgtttatctgcaggggtgtgaatagctgtaatatccactgcacctgctgccttaacagtggagttggccaggcgcagtggctcacacctgtaatcccagcactttgggacaccaagttgggtgggtcatctgaggtcaggagtttgagaccagcctgaccaatatggtgaaaccccttctctactaaaaaaatacaaaattagccaggcatggtggtgcatgcctgtaactccagatacttgggatgctgaggcaggagaatcgcttgaatatgggaggcagagccaagatgacaccattgcactccagcctgggcaacaagagagaaggtccttctcaaaaaaaaaaaaaaaaaaattcccaaaataccccaaataagctagttacctcttaggctttgtggtgcacagtgccctcctaatcatgactactgcaaaatccagtccattaaagtgtaaaatgaggccaggtgcagtggttcatgcctgtaatcccagcactttgggaggctgagttgggaggattgcttaaggccaggagtttgataccagcctgggcaacatagcaagaactccgtctctacaaaaaaataaaaagtgtaaaatgaatatacagaaatgtatctctctatttgacctaaatcttatggatcgcaccattgcactccagcctgggcaacaagagtgaaactccgtctcaaaaataaaaaataaaaaaaacattaaacttcaagtccgggtgcagtggctcacacccgtaatcccagcacttcaggaagctgaggggggtagatcacttgaggtcaggagtttgagaccagcctggccaacatggtgaaaccccatctctactaaaactacaaaattagtcaggcatagtggcaggcacctgtaatcccagctactggggaggctgaagcaggagaatcacttgaacccaggaggtggaggttgcagtgagccgagatcacaccattgcattccagcctgggtgatagagcaaagctccatctcaaaaaattaaaataaataaaataaaataataaaataaattaaacttcagaaggaaagagagttgtagccttgattccttttttcccaagacactccttgaggcctatgcaaattttcccaactcctcagcagtcacagctaagtgggccaaagcaagggctagtggaaggagtgatcgcagaccccatgacacccttcacacagagccatagatgactactcaacttacggtcacgtcaccatgggagagtcaccaaacagcatctctctctgaaatgtcaacatctatacacccatctagtgtctggtttagggtggaaatgtgggtgtaagaaaagtaatttagaggtaattactggcagctgaggggaggagactgttcctcacccagccttgggttagtggagatttggtgcaatggacaaaaacagaggttttgatttggaggcgaagaaagggggcaatggctccagaggccaagagcagagaaggacagccaggaagtgggctgagcatggtggactcaggagatggggagccccatcttgggatgcctcagagacattgtggagggggcctggttttcctttttgaacattttttattgttattattaattaatttatttatttattttttatttttattattattttttgagatggagtctcactctgtcatccaggctggagtgcagtggcatgatcttggctcactgcaacctccgactcctacgttcaagcaattcttctgcctcagcctcccgagtagctgggactacaggtgcacgtcaccacacccagctaatttttgtatttttagtagagacggggtttcaccatattggccaggctggtcttgaactcctgacctcgtgatccacctgcctcggcctctcaaagtgctgggattacaggcatgaactaccgcacccggcccttttctttttttctttgagacagagtttcactcttgttgcccaggttggagtgcaatggcacaatctcagctcaccgcaacctccacctcttgggttcaagcgattctcctgcctcagcctcttgagtagctggaattacaggcatgtgccaccatgcccggctaattttgtatttttgtagtagagacgggtttctccatgtttgtcaggctggtctcaaactcctgacctcaggtgatctgcccgcctcagcctcccaaagtgcttggattacaggggtgagccactgtgcctggcctacaaactggtctatcagcaaggtctttatgacctgtatcttgtgccaacctcctgtctcatcctgtgacttagaatgccttaacctcctgggaatgcagccaagcaggtcttagccttattttacccagcccctattcaagatagagtcgctcaggttcaaatgcctctgacactcctgcctcagcctttgagacagctgggactataggcacacaccaccaggcctggctaatgtcttcatttctattttgtagggacagggtcttgctatgttgcccagactagtctcaaactcctggcctcaagccatcctcccactacagccttgtagagtgctgggattacaggcatgagccaccacgccaggccttggtttttcttagtatgtgggctaaagtcattcaatgttgatggtaaaggaaaatggggccgggcaccgtggctcacacctataatcctagcactttgggaggcccaggggggcggatcacctgaggtcaggaattcaagaccagcctggccaacatgtcaaaaccccatctctgctaaaaatacaaaaattagctgaacacgttggctcattcctgtcatcccagcactttgggaggccgagctgggtggatcacttgaggtcaggggtttgagaccagcctggctaacatgtactaaaactacaaacattagccgggcacaatggtggctgcctgtaatcccagctactcaggaggctgagacaggaaaatcacttgaacccgggaggcggaggttgtagtgagccaagatcgcaccactgcactccagcctgggcgacaatataataataataattatttttttttgacagagacaaaaaataataatgatactttttttaaaaaaaggaaaatgggaggtgattgtagaaggtagaggatttggagtgatagttcattacaattgtaataaggaccacaagatgctaagagtaatgagatgtagcggacgtctgctatttttgcctgttcagcatccactcgttctgctttgtgtgatagcaccccaagcttcctttgaaccagtccttccttcagcggaggccgaccccaccccttcgctctgtggggtggccacatgacccaggtctagccaatcagcacattccatcccggagcagcagctgtgtgcccctagcccaagctaggctgctcctggctttgtgtacctattaggggaaaatgtgttctcttttcactgcagttgctaagcatgtgggatgtaagcctggacttgctggtggctgcctttgccaccgcttagggagattctggccaggcatgaagccggcacagagtaaatgaagcagggccaggagatgaggagagatggattctgattgcattatatgagtactaggatctgtgtctgaaatccaaatggctttttcttttcttttcttttctttctttttagaaacggagcacactctgtcacccaggctggagtgcaatggcacgatctcagctcactacaacctctgcctcccgggttcaagtgattctactgcctcagcctcccgtgtagctgggattacaggcgcgcaccaacacacccgactaatttttgtatttttagtaaagacagggtttcaccatgttggccaggctggtcttgcactcctgacctcacgtgatctgccccaccttggcctcccaaagtgctgggattacaggtgtgaaccactgcgcccagccccaagtggctttttcaattacatgagccaacatattctcacaagtccattcgagtttggtgtctgttacttgcaaataagggagttctgattggttcccagtgaaacctcatctgtaagacctctgagccaccagtatccacggggcttgtcctataacagctcctgtgcaatccagtaaccttgaacactggaagccactgagcccttctgtgagtagatgcacacctctgaggctaagattactggtgtactcattgggaccagtttggtctcagtgactgaaaactcaacccaaacttgttcatttggaaaggaaaagtcaaccaggcacagtggctcatgcctgtagttccagcactttgggaggctgaggtggacagatcgcttgagcccaggggttcaagaccaacctgggcaacatagcaaaaccctgcctctacaaaaaaaaaaaaaaattctttttttttcgagacagagtctcgcactgtcgcccaggctggagtgcagtggtgcaatcttggctcactgcaatctctgcctcccgggctcaagcgattctcctgcctcagcctcccgagtagttggactacaggcgtgcaccaacagggccagccaatttttgtatttttagtagagacagggtttcacaatgttggccaggatggtctcgatttcttgacctcgtgatctgcctgcctcggcttcccaaagtgccgggattacaggcgtgagccaccggtgcctggcctctacaaaaaatattttaaattagcaggcatgatggtgcatgcctgtagtcccaaatgggcaaagttgttctctgattggctgaggtctttgtcacctgctccacccctgagctggagccccacccaaagtaattgactgaaagggggtgttctccagtgggaaattaggtaaggtttacattatttggccctaactcttcacccttccccctacccatgcccttggccatgtaattttgcagtgccctcctgtcacaggcaggatgacctgatgcctcttttttcttttttgagatggagtctcactctgtcgcccaggctggagtgcaatggtgcaatctcagctctctgcaacctccacttcctgggttcaagagattctcctgcctcagcctcctaagtagctgggattacaggcgcctgccaccacacccagctaatttttgcatttttagtagagaaagggtttcgccatgttggccaggctggtcttgaactcctgacttcaggtgatcctcctcgcctgccttgcctcccaaagtgctgggattacaggcataagccaccacgcccggccctgcctcttgagctggggagttcaagaccagcctgggcaacataatgagatttcagctctattaaaaataataataattaaaaaaaaaaagaatggccctacctttcactggcagggaagggtggagggccctcctgtcatctccaaatcatagtactgtccccaccagccatagctgatcattttaggagtggttccaaggagtcccaagctgggcccattacagcctctcctggagggttacaattggatgagaagccaatcgatatcctctataattaaaaatataagaacttaggagtcatggggcagctgtgtttagttgaaagcctagagaagcagagagagtccatgtgtttgttacttacggtaatgctggctgctggaacagataagccccgaaatctctgtggcttaacatcacagaagtttattacctgctcagataacagtctaaggcagatgtgccacatggcgattcagggactgctaccttgtggttctgctgtctctcggggcctcggctggtagatagcaaacaatgcagacaggagaagacagatccatgatcttaaccatctcagccccagacaggggaccgcgtcatttccacccaccttccatcagcaagaaccagtcacatgagcacatctaacagcaatgaaggctgggaaatacatgcccaggaagggaggaatcagtttctttgcagaggagagagggaacagaagagagggaaagggggaaaatagagagacggagggagagaaagagagaagaactaatgagcacagaactaagaaagcccaggcacagtggctcacatcagtaattctagggccttgggaggcaagacaagagaatcacttgaggccatgagttcaagggcagcctaggcaacatagtgggaccctatctccacaaaaataataatattattattattaaataaaataaaaggaagagacagccatgaagataactagctgaggccaggtacagtggctcatgcctataatcccaacactttgggaggttgaggtggacagattgcttgaggtcagaagttccagaccagactgaacaacatagcaaaaccccatccctactaaaaatacaaaaattagctgggcgtggtggcaggcacctgtagtcccagctactcgggaggctgaggcaggagaatcacctgaacctgggaggcggaggatgcagtgcgctgagatcatgccactgcactccagcctgggtgacagagcgagaccctgtctcaaaaaaaaaaaaaatcacctggcttgttaaaacagattcctggaccccaccccagaatttgattcaggttgggagtgaggcctgtgaatttgcatttctagcaaattcccaggtgatgctcatgccgctggtcccaaaccacactgtgaagtgccagttccagactaggagactccaaagagacactggagccaaccacaatgtgcaaacctgattgggtcctgatttggaaattaaacatctttaaaatgcattcagggaataattgggttcatttgaacgtggactcaatattagaaaatttctattgattttcttgggtagggtggtgacatgtggctggctataagggaagatgtctttatttttaggagattcacattgaagtcattataggggtcaagtgacatgatatctacagctaacttttatttcacttatttattattattattattttagagacagggtcttgctctgtcacccaggctggagtgcagtggcatgatcgtagctcactgcagcctcaaactcctgagatcaagcgatcctcctgcctcagcctctccaatagctgggactacaggcccacaccaccatgcctggcttacaactaacttttaaatgttggccaggcgcagtggctcacgcctgaaatccaagcactttgggaggccgaggcaggcggatcacttgaggtcaggagttcaagaccagcctcgccaacatgatgaaacctcgtctctacaaaaaatacaaaaaattagctgggcatggtggcaggtgcctataattccagctactcaagaggctgaggcaggaggatcacttgaacccaggaggcggaggttgcagtgggccaagatcatgccactgcactccagcctgagcattagagcgagactccatctcaaataaataaattaattaacatttcagcaaaatacacacatgcacacagacaaagaaaatatgacaaaatggtaattattgaatttcaggataggtgtatgagtgacaattataccactttttcaactcttctatgtttagatgctttaaatatttaaagctaggggctgggtgcagtagctcatgcttgtaatcatcatattttgaggggctgaggtgggagcatagcttgagcccagcagttcgaggctgcagtgagctatgatcacaccactgccctccgggctgggcagcagagcaagaccctgtctcaaaaaaatataaaataaaatgaaataaatctggggagcacgtgggggagggactagtgcatcacagcctaattgaacgagcaggagactgccatgggatgaggccaggcccaactgtgtcagtccctctgggtcattctaaggacttcggattctatcctgaatgcatgaggaaacccttgaaggccttaagcagagagtgacatggtctgattttcttttaagctgtagctttgtttttgagatggggtcttgctaaattgcccaggctagtctcgaactcctgggctcaagtgattctcctgccccagcctcccaagtagctgagattacagataagtgccaccacgcccagctaatttttgtatttttagtagagacggggtttcaccatgttggccagactggtctcaaactcctgacctcaagtgattcgcttgcctcagcttcccaaagtgctgggatgacaggtgagagccactgtgcccagccaattgtacatttttaaataactcaaagagtgtaattgaattgtttgtaacacaaaggataaatgcttgatgtaatggatccccatttaccctgatgtgattattatgcattgcatgcctgtattaaaacatctcatgcaccccatacatatatatgcctactatctacccacaaaaattaaaaaatgaaaacattatccttttgatgcttggccacatggaggacacagcaaacggttcatggccaagcacaagagagccactaatgtctgcaccaggaagggataattatccaattataacccagaggcagcctctggtgtcaatagctgattgttctgaacaagtccagattctatgcttccccaaagctgtgtgaaatttaaaaattcataatcattggcaaatgataatcgtaatacacatgccaaggcactacccagaccaaggaaatccaattcccttggcaccaggatcaaatccaagatccccaggggattctttctttctttattttgagacggattctgctctgtcacccaggctagagtgcagtgacgcaatctcagctcactgcaacctccacttccgggttcaagcacttctcctgcctcagcctcctgagtagctgggattacaggcacccgccaccacgcctggctaattctgtatttctagtagagacggagttttagcacgttggctaggctagtctcgaactcctggtctcaggtgatctgcccacctaagcctcccgaagtgctgggatcacaggcgtgagccaccacacctggcctcaggggattcttgattgcagccaggcagagcctgcagtcccagggtggggagttccagcagacctatgaaggactggctccagggtccctgagcacaaggttgcaaggccatgttgtcacactctggacctcttgtttgtttgtttgttttttgagacggagtctcgctctttcgcccaggacggactgcagtggcacgatctcggctcactgcaagctccgcctcctgggttcatgccattctcatgcctcagcctcctgagtagctgggactacaggcgcccgccaccgcgcccagctaaattttttgtatttttagtagagacggggtttcaccatgttagccaggatggtctcgatctcctgacctcgtgatccacttgtctaagcctcccgaagtgctgggattacagacgtgagccactgcgcccagccaacagataggtacagtctttatctgttcgtgtggctataagaaagtaccagagactgggttatttataaaaaatggaaattttggccaggcacagtggctcacgcctttaatcccagcatgctgggaggccagggcaggtggatcgtgtgaccttaggagttcgagatcagcctgggcaacatgacgaaaccctatctgtacaacgctaagaaaaaaaaaaaaaagcagggtgtggtggtgcatacctgtaatcccagctactcgggaggctgaggtgggagaatcacttgaacccaggaggcagaggttgcagtgagctgagatcgtgccactgcactccagccgaggtgacagagaccctgtctcatacaaacaaacaaacaaaacccagaaatttctttctcacagttctggaggctaggaaggccaagattaagttaccagcaggttggtatctggtgagggcatggtggccatttccaatatggcaccttgctgctatgtcctcccggggggaccagtgctgtgtcttcaagtgacagagggatgtaagggcaatgaaagggcctagctcgttcctgccaacctttttatgaggttactaatcccatgccctcatgacttaatgatgccccacctcttaatactaccagactggtggttaagttttaacatatgaatcttggggaacacattcagaccacagcagatatattgtagaaaagaatagtccgtaaattcccagcagtaacacttcgcatattttgcctcttattacttggagtatactgtgtttcatatggctttttaaactttgtaaaaactgcagcaagtgcctgattacttagggcttctttatctagtgacagactatttagtccattaattttgtgctgtacaacaggaaagagaaagaaaatgacttctgcagagactgaatcatctttatgtcctctatggtagttggcacttagtagatattaaataaaaaacaggctgggcaagatggctcatgcctgtaatcccagtacttcgggaggctgaagcaggtggatcacttgagctcaggagttcaagaccagcctgggcaacatggtaaaatcctatctctacaaaaactataaaaagtagcgggatgtggtggcatgtgcccatagacccagctacttggaaggctgaagtgggaggattgcttgagcccggggggtggaagttggactgagccaaggtccagctccagcctgggccacagagggagaccctgtctcaaaacaaacaaacaaacaaatctctttaactcccaaaatggaaagttctccaagatatatgttaagtgattaaaaaaaaaaaaaaaaaaagggccagcctggcatgctggctcatgcctgtaatcccagcactttgggaggccgaggaaggcagatcacctgacgtcaggagttcgagactagcctgaccaacatggggaaaccccgtctctactaaaaatacaaaattagccaggtgcggtggcgcatgcctgtaatcccagctactcgggaggctgaggaggagaatcgcttgaacccaggaggcggaggctgtggtgaaccgagatagcaccactgcactccagcctaggcaacaagagcgaaactccatctcaaaaaaaaaaaaaaaaaaaaaaaaggaaaccgcatctctactaacaatacaaaaattagctgggcaaggagctaggtgattatagtaccagctactcaagaggctgatgcaggagaatcactaaaccgcatctctactaaaaatacaaaacttagccaggcaaggagctgggtgactatagtaccagctactcaagaggctgatgcaggagaaacacttgaacccgggaggcggagtttgcagtgagttgagattgcaccactgcattccaacctgggcaacagtgcgagaccctgtctcaaaagaaaaaaataatataaagtgaccaggtgtggtgactcacacctgttatcccaccactttgggtggaagcaggaggatcactggagcccaggagtttgaaaccagcctaggcaacatagtgagaccctgtctctatattaaacacacacacacatgcacacacacacacacacacacacaaaggcagccagactatgcactaggaactgccctgggaatccctttgcgttctcacaacaatcccatttcacagatgaagaaaccaaggcacagaaatattaagtaatgtgtccaggtgcggtggctcacgcctataatcccagtactttgggaggctgaggcaggcagatcacgaggtcaggagttcgagaccatcctggccaacatggtgaaaccctgtctctactaaaaatacaaaaattagctggatgtggtggcaggttcctgtaattccagctactcaggaagctgaggcaggagaattgcttgaacccgggaggcggaggttgcagtgagccgagatcacaccactgcactccagcctgggtgacagagcaaaactccgtctgaaaaaaaaaaaaaaaaagaagaagaagaaatactaagtaacttgtctgaggccacttagttaccaagacgtgggagctgggacttgaacccaggcagtctgcagtctgactggattcatgcctgcagcctctgcactcctgctacttactgtgtgagaagcgcctgttctgtggaaggttgtgggctgagatctttccatgagttccactcatttacccccaaggctgttcttaaaggcaggcatgacagttatgcccattttacagatgcggccctgaggctcacaagggcacgccactcgcccatttccacaaagctatagctcgttagcggagggcagaattcggccgcctctcccctagctcgaaggctgtgattgacacagaggtttttgttgttgttgctgttgtttgttcttttttctttttttttttttttgagacagggtcttgctctgtcatcccggctggagtgcagtggtgcgatctcagctcactgcaaactgcctccaagatgcaaatgattctcatgcctcagcctcccaagtagctggaattacaggtgtgcactaccacgcccagctgttttttgtagagatggggttagtagagatttgtttaatagagatggggtttcaccatggtctctactaaaccctgtctctactaaaaatacaaaaattacccagacgtggtggcacatgcctgtagtcccagctactcaagaggctgaggcaggagaatcacttgaacctgggaggtggaggttgcagtgacccaaaatcatgcactctagcctggggtctcgcttttgcccaggttagagtgcagtggcacaatcacagtggctcactgcagcctcaaactcctgggctgaagggaatcctcccacctcagcctcccaagtagttaggactataggcatgtgccatcctggcgagttaattttttgtgtgtttttattctctcgagacagagtcttgctctgttgctcaggctggactgcaatggcgtgatcttggctcaccgcaacctccacctccggggttcaagcaattctcctacctcagcctcccgagtagctgggattacaggtgcgtgccaccatgcctggctaattttgtatgtttagtagagacagggtttcgccgtgttggtcaggctgctctcgaactcctgacctcgtgatccacctgcctcggcctctcaaagtgttgggattacaggcatgagccactgagcctggcctggtgagctaatttttaaatttgttatagagacaagagagacaagagtctctcttatgttgcccaggctggtctcgatcccctggcctcaagtgatcctcccacctcagcctcccaaagtgctgggattacagatgggtgtcaccgcacctggcctccgaggaggatttcattataaacctgccctgaagggagggaatccaattttacgagagggtgtagcctggtgaggcctggatgacctccggaggcaggggcttgtgcctgggctgaggcctaagggacaatgggcagacatgaagttgccccaggcagagggtacagtgtgggcaaagtcaggaagtggcagggcttggatcactccaggaagagagaggagtcatgtgtcacaggagctcgagacccagagagtgaggcaggcaggcagggaccaagcttgggcacagccaggaaggcaggacagggcatggtggggccaatggaatcattacccaagacgggcattttcagggaaacagcttagataaggccaggcatacagtagctcccacctgtaatcccagcatttggggaggctgaggtaggaggactgcttgagcctgggagttcaagaccagcctaggcaacatagaccccatatccacaaaaaatttaaaaaaggagtttgtgttcctgtagtagcatacttgggaagttgaggtggcagtatcacttgagcccgggagttcaaggctaaagtgagctgattgagccattgcaccccagcctgagcgacagagagatatgctgtctcaaaggaaatacaaattaaaaaaccagccgggcatgctggcgtgtgcctgtagtctcagctacttgggacactgaagtggaaggatcgcttgagcccaggagttcaaggctgccgtgagctatgattgtgcctctgcagtccagcctgggcgactgcagactgcaggacttttttaaagaccctgtctcttaaaaaaaaaaaaatcttagataagaggatgctgtgcctccctgggggtcttcagtcacccatggtcctggcaagagaggagggccaggagagagcttcacccacctgctgtcctgcccatgtgacatccgcaggtgctgccatggccacgactgttgttacactcgagctgaggaggccggctgcagccccaagacagagcgctactcctggcagtgcgtcaatcagagcgtcctgtgcgatgagtccccagcagcaccatgccacccaccccgagtatcccctgggcaccctggcatagccagatgacttccgtgcccctgttgcaataaccactgcttccaagtctctgtagaccaccccttgggtatatctcatgtaagtgatatttattttatttatattttttgagtcagagtctcactctgtcacccaggctagagtgtgctgacgtgatcttggctcactacaacctctgtctcctgggttcaagcgattctcatgcctcagcctcccaagtggctaggactacagacatgcaccatcacgcccagctaatttttgtatgtttttcagtagaggtggggtttcaccaagttggccgggctggtctcaaactccccacctcaagtggtctgcccgcctcggcctcccaaagtgctgggattacaggcatgagccatggtgtctggccctaatgtgagtgatctttaacactgagcacttgaaaaagaaaaccctgaagaaacctaattattcgatgtctggacgacaaggaagaagatagaaatggcatcagataataaacagtgtaaatgtttgtttatcagaaaggggctggtggtcgggacaagtaggaggatcgcttgagtccaggagtgcatctctacaaaaaagttaaaggattttttaacattggccaggcgtggtggcacacatctgtgatcccagctacttgggaggctgaggcaggaggattgcttgaagcccaggaggttgaggctgcagtgagctgtgatcgagccactgcactccagcctgggtgacacagcaaaatccagtctcaaaaaaaataataataatattttacataaccaaccacttctaaagattaaaaaaaaacccctatgattaaaaacctcaggtccctcaggcaatcataccagatatcgaaacaaagcaataacataaggactgcagtatttattttatttttatattatttatttattctttgttagtttttggagtgtgggttttgttttgttttttgaattttttattttgttctactcggttttattcttattgctcaggcttgagtgcactggcctcttctcagctcaacctccgcctcttgggttcgggtgatgatggttccacgtcagcggccctccgcctcttgggtttgcgtgacggttccacatcaccgaccctccgcctcttgggttcgggtgatgatggttccacgtcagcggccctccgcctcttgggtttgcgtgacggttccacgtcaccgaccctccgcctcttgggttcgggaggtggttccatctcagccgccctctgcctcttgggtttgcgtggtttttctgcctcagcctcctgagtagctaagggaggtgtcttgagattatcatcggctgagggtggaagcggcccccgcagacgctcggcaggtgtcttgatattatcatctgctgaggttggagctgagggtggaaggggagtgagctgacgctcggaaggtgtcttgagattatcatccgctgagggtggaagcggcccccgcagacgctcggcaggtgtcttgatattatcatctgctgagggtggagctgagggtggaaggggagtgagctgacgctcggaaggtgtcttgagattatcatcggctgagggtggaagcggcccccgcagacgctcggcaggtgtcttgatattatcatctgctgagggtggagctgagggtggaaggggagtgagctgacgtttggaaggtgtcttgagattatcatcggctgagggtggaagcggcccccgcagacgctcggcaggtgtcttgatattatcatctgctgagggtggagctgagggtggaaggggagtgagctgacgtttggaaggtgtcttgagattatcatccgctgagggtggaagcggaacccacagacgctccccgcagacgctcggcaggtgtcttgatattatcatctgctgagggtggagctgagggtggaaggggagtgagctgacgctcggaaggtgtcttgagattatcatcggctgagggtggaagcggcccccgcagacgctcggcaggtgtcttgatattatcatctgctgagggtggagctgagggtggaaggggagtgagctgacgctcggaaggtgtcttgagattatcatcggctgagggtggaagcggcccccgcagacgctcggcaggtgtcttgatattatcatctgctgagggtggagctgagggtggaaggggagtgagctgacgctcggaaggtgtcttgagattatcatcggctgagggtggaagcggcccccgcagacgctcggcaggtgtcttgatattatcatctgctgagggtggagctgagggtggaaggggagtgagctgacgctcggaaggtgtcttgagattatcatcggctgagggtggaagcggcccccgcagacgctcggcaggtgtcttgatattatcatctgctgagggtggagctgagggtggaaggggagtgagctgacgctcggaaggtgtcttgagattatcatcggctgagggtggaagcggcccccgcagacgctcggcaggtgtcttgatattatcatctgctgagggtggagctgagggtggaaggggagtgagctgacgctcggaaggtgtcttgagattatcatccgctgacggtggaagcggaacccgcagatgctcagcaggtatcttgatattatcatctgctgagggtggagctgagggtggaaggggagtgagctgacgctcggaaggtctcttgagattatcatccgctgagggtggaagcggaactgcagatgctcggcaggtgtcttgatattatcatctgctgagggtggagctgagggtggaaggggagtgagctgacgctcggaaggtgtcttgagattatcatccgctgagggtggaagcggcccccgcagatgctcggcagttgtcttgatattatcatctgctgagggtggagctgagggtggaaggggagtgagctgacgctcagaaggtgtcttgagattatcatccgctgagggtggaagcggcccccgcagatgctcggcaggtgtcttgatattatcatctgctgagggtggagctgagggtggaaggggagtgagctgacgctcagaaggtgtcttgagattatcatcggctgagggtggaagcggcccccgcagacgctcggcaggtgtcttgatattatcatctgctgagggtggagctgagggtggaaggggagtgagctgacgctcagaaggtgtcttgagattatcatccgctgagggtggaagcggcccccgcagatgctcggcaggtgtcttgatattatcatctgctgagggtggagctgagggtggaaggggagtgagctgacgctcagaaggtgtcttgagattatcatccgctgagggtggaagcggcccccgcagacgctcggcagttgtcttgatattatcatctgctgagggtggagctgagggtggaaggggagtgagctgacgctcggaaggtgtcttgagattatcatccgctgagggtggaaggggatggagcagacactcggcacgtgtcttgagattatcatccgctgagggtggagctgagggtggagctgagggtggaaggggagtgagcagacactcgggaggtgtcttgagattatcatccgctgagggtggaaggggagtgagcagacactcgggaggtgtcttgagattatcatccgctgagggtggaaggggagtgagcagacactcgagaggtgtcttgaggctcagggagttatcagttatacaatgttgttgagttggaggaggtggctggtggcccatcctgttttttaaagtttcagctgtgaggtagggccagtagggcaatcctgaagaatgacgatgctccgctgccgccattctgacctgtagggccaaaggagggaatgttttcacacatattcatttgatggacaaaattaccgccaccaacacagtctgcaccttctgttgctggtgatagatttttgcacctttccatcctccaggtttcaaaatagcagtatcagtgtcataatatcacccttccactgagtactgccgacagctggagggtaaaggaaagtcattgggacacactgttgtctccacatgccactgtgtctgtctgcaaatgtaggcaggctggggtcctgccccagggaagacagagtcataacagagtaataaagaagcatgtttgagacacaggagtgtctatgtctatcctcattcctccctcacagccatcaccagagcatgtttcttgcaccaggtcaacagacagtaagagacagtaagagaggcatgaaaagcccactgtccacacatgttgcagcttctttttggagaatgttttccaggccttttatgttctgtctctgattctcagaactctgcaaggtcagtgtgaccaccctgctccaaatctaagaaaacagaggtttccagaggaaggagaaattgtgcccagggtcacacagcttgcaagaggcagagtggaagttgattccagctctgcctgcaggaccctctcatttcccctctgtttcccttcttgacaaaggatcttcttcactctggaggtgccacccatgagaacaaagagctctggagagatgtggattcctgaagagctgcaggggaactgggagagggttttctgacagaacaatctcacctcaagaagtcacttaggcatggctgtaatatttcttttcactcccaggtaataccaaattgtaagtgcactaggacataaagaatacttttgtccatggaaaaatgaggtgggaattctaaacaaagcaagttttaaaactgtgtttcacttcaagtgtacaagtcccatcacgtgtaatcataggactcggcagcttttgaaggtacagaggccacacaagaaccagcttagctgagcatcatttaaggccttcatttggaattgtccctgtgggtaataagttacattcactcttcactagtttacagtcagggcccatctgctattacaaatacggaacctctgacacttagaatattagatcaggggccccactgggtggggatgaaggtgtttttgcgcaacacggttaccaacagggatgggactgtgatgcttgtaggcagcctttctctctgccatctccctctgcagggcttgagcacagagctgtagggagaaaaatgtatccatgtcctgacctggcagactatgtccaaaagcaaggaaaacaagcaaacttacccagttgcaaagagcctttcttgcagaaggggggatctgaaaaagccaacacatgagaaattgaatgttgagagagtctaagggccgtggcatcatctgcatcagcactgaactatcctgcaactgcagggaggaagctccttactttgcatttgtggtagtcctctgcccgccgccgcaactcttgcgcacgttgaaacattttcctatggattacaatcactttcatcagataaagcaccactttcaggatgattttaaataatctgccatgtttctgttatcctcacaactgtacccttacacaatctatctctacctagaaaacgtatttcagatggctataagagtacagtctgagccggtcacggtggctgacgcctgtaatcccagcactctgggagggcggggcagatggatcacgaggtcaggagattgagaccattgtggctaatatggtgaaaccccttctctactaaaaatacaaaaaattagccaggcgtggtggcaggcacctgtaatcccagctactcgggaggctgaggcaggggaatcacttgaacctgggaggcggaggttgcagtgagccaagatcacgtcattgcactccagcctgggtgacacagcgagactccatctcagaaaaacaaaaacaaaaacaaaaaaactgtacagtctgatccaaactgttgctgtattgattcctcctcttgcttactgcctgctgacttctgagatgatagtttccttccccattctcagtacatccctaattcatccttcattgagcatcttttatcataaagctgtattctctttgtattaatatccttaccgtgtttcacagggcagaaacagctgggcttataaacaggcatagtccttttgaaggatgtggttgatcctacaacaacacactttcctaaggatgacaacaactcaccccacccctagaatggctggtatgaaccgagtttccacatagtctagctggcaatggggtcaggagacgttttgctacttcacatcttttggtcactggtaaatattaaggtactttgttttctgttttgtgaactctctctcgctctctctcacgatatgtcttctgaccgtttgtttctatttctgcatttactgggtctaaatactgtacaaaggttaaaaacaacactccaatgggcgtttcccaggagggtggggttcagtttctgaactcacttgtaggtgtgtatttctttcatatccaatttcccattttcctctgcctctgatacctgcctctccttttctgcatgctcacattctttcacgcttagtttcctcagattagaagggagagaaatgcacacacatgatccaccagcccgtgtgggattccctctgcccttctggcatctgaaggctgtgattcaaagatcccccctgcaaccttcccacaaatgaaccaactgattctcacaaccgaagggagaattgacacctcccattgagggacaaaaaaaagtcacactctggcctgctggcaagtcacctgtcatttccagctcatcttcatagttccatagttagtcctattctttagtaaatataaagactattaaaagcttctatgaggtgcactatgtgtgtctctggggtcagtcttgtgcttgacacagcgaaagctcattttagttcagtgtgaaaaaccagacctcaccaattcatcacaactaactccatcggaagcagaggattgctcctcatctgactcctcctgtgtgagacctgattctcagtcagaggctgatgccagaactgagaccatcagccatagagagatccttccagaataaccccgcagttcactactgcactttgccatgattcaggactggaactcttgtcatcgactttaaagatcctggttgagagaaaaggcaatctgaatgctgggcgcatctattgaattagaaatgatcggaatggctcctaagtcagggtgttatgtcctgaaaataggtgacaacggcaaaccatccaccctggtgttgactgactttaacaaggttcagttcacagagattgagggcagaaaaaggaaacggcctaaaaagggtaagtttgctgtgttgccctcacaccacttgattcatggtcctgatcctaaggatctcacctgatacttggttttataggaaggatgtgtaaaattcccagaacgctaggaaacaggggcgaaaacacttcaaagagaaagttaatgaacttgtttctgaccacaaggcatccttcagcacatgctgtctggagtggcctcaaacaaggagtgtgtggtgtggtgctgagaatgcaatgggagcagggtcctgtccccacgctaaagaagctcacagcttaatgcaaatgagaagccagtgaggacatcactactcctgctgtgcacttgggaactagaaacacaaaacctgactctggagggaagctaaggaagcattctactcttgagttgacataagtgcatctgaagcttctgatctccgatgagaacaatgggggacaccaaacagaatataaaacccatgattgaatacatcaaattgctaacatggcagtaaacagacatgaggtgaagatggagaagaaggaaacccaggacgaaagtcagcctcgcatttggaacccatttccctgagtttcattgctgaattccagaaggaactactgagatgcaaagaagcacagcagcttttgcacacatgcgtgggattagatggaaaacaagtggattgagggtctgccaatgaaagcgacccatactgaagtccactggctctggttgagacccagaagagtcatgcatcagaataaaggtggacaggaaataccctggcctttgtagggactgagcctgcaccgacgacctcaattgcagcctgtatggaggacccctgaccatcccccagaagtagactcccatctcttctgcagcaagataacatgctactaggcctcaattcattgctaaacattttttaacaagtatctcacatttaacaaaaaaagatcagtcatatggcagcaaaatacaatgtcatatgaccaaaacatgaaagactgtgaaaatgaatctggaggtgacccaagcattgaattcaacaatccaggctgggtgcggtggctcacactgggaggctgaggtaggcagatcacctgaggtcaggagttcaagactagcctggccaacatggtgaacccgtctctactaaaaatacaaaaattgggccgggcacggtggctcacgcctgtaatcccagcacattgggaggccgaggtgtgcggatcatgatgtcaggagttctagaccagcttggccaatatggtgaaaccccgcctctactaaaaatacaaaaattatccgggcatggtggcatatgtctgtagtcccagctactcaagaggctgagagataagaatcgcttgaacctgggaggtggaggttgcagtgagccaagatcatgccactgcactctagcctgggtgacagagtgagactctgtctcaaaaaaaaaaaaaaaaaaaaattggtcaaatgtggtggcacacagctgtaatccaagctactcgggaggctgaggcagaattgcttcaaactgggaggcagaggttgcagtgagccaagactgcaccatagcactccagcctgggcgacagagcgtgactctatctcaaaattaaaaaaaaaaaaaaaaaaaaaaaaggctggctgtggtggctcacgcctctaatcccagcactttgggaggctgaggcaggtggattacctgaggtcagaagttcgagaccagcctggacaacatggtgaaaccccatctctagtaaaaatacaaaaattagctgggcgtgatggtgggcacctgtaatcccagctacttgggaggctgaggcaggagaattgcttgaacccaaaaggcagtgagctgagattgtgccattgcactacagcctgggcaacaacagcaaagctccatctcaggaaaaaaaaaaaaaaaaaaaaaaaaaaaaaagagaaaggaaaaccaatgccagtactagcaactcctcttcccccgaaaaaattacaaacaagaatgtaggaagggaaaggaattatacagcttaaactaatgaagcagaaaggacaaactcaattttgaacctactgaatttgccacaaatattgtagaaaatattctcaaggactttacagttgtctactttgattggcacatggttcctacaacagtatttgtgtcaaggcacatcttactgttttctggcggtcttcctctttccattgattttgtcatgacggttgattttcgttgtcaccttcctcttacggattttagctctaacttttgtttccacatgcctccgtagagtaatgacgtctttcaggccaattttatttcctcgaaaggaagaaactcttttctttgtgtgcatacaaatggacctcagcccttggtgagagtgaggagaggagaaggtgagaaacctgagggcaagaagctgttctttccctttccagggcaaactcatttccacactatgcggattccaacagagccataccttcctgtctacggcggttggacctccaggctctctgctgtacatccgtggatccatcatgtccatttcgagaccagaagatagtcttcaggagagacacctaggaaataataatataagaatgacggctgggcacggtggctcatgcgtataatcccagtacttcgggaagctgaggcaggtggatcacggggtcaggagcaagaccagcctggccaagatggtgaaaccccatctctactaaaaatacaaaaattagccgggcatggcagcgggcgcctgtaatccaagctactcgggaggctgaggcagagaaccgtttgaagctgggaggcggaggttgcagtgagccgagatcacaccactgcactccagcctgagcgacagaatgagactctgtcacatacacacacacacacacaagaatgacatgaggctggcacagtggctcactcctgtaatcccagcactttgggaggctgaggcaggcggatcacctgaggtcgggagtttgagaccagcctcaccaacatggagaaacactgtctctgctaaaaatacaaaattagccaggcatggtggtgcatgcctgtaatcccagctagtcgggaggttgaggcaggataatcacttgaacccagcaggaaaaggttgtggtgagctgagattgtgccattgcactccaacctgggcaacaaaattgaaactgtctcaaaaaaaaaaaaaaaaaaaaaaataggccacctgcggtagctcatgcctgtaatcccaacactttgggaggccgacgcgggtgaatcacaaggtcaagagatggagaccatcctgggcaacatggtgaaaccccgtctctactaaaaatacaaaaattagctgagcatggtgatgcacgcctgtagtcccagctactcgggaggctgaggcaggagaactgcttgaacccaggaggcagaggttgcagtgagccaagatcccaccactgcactccagcctggtgacagagtgagactccgtctcaaaaaaaaaaaaaaaaatgacatgaatatacttcacacaactgaactgtacacttcaacacggttagatggtaattatcatcttataagtattttaccacaggttaacatgtttcacaacttgaaaaggaagtaattaccttcagctctctgagttctagaatttgtaacatttcaccccctgctccttcctgatctgcactggagcatcttccttctgtccctgctctactcagagttcactttcccttccctcacatcagcttcattgaggctggtttgaacttaacgcaaaacattctcactaatgactgaattcccaccaagatttccatattatcacagtatgcttttaatcttctaagacattaaatatttcttctcatcatagcgaaaatgcaatgcaaatcccatctcagatgtcggtcagatacctatgaatctcctgaggtagtcattgaaatgacttttttcttgagatggagtgtcactctcaaccatgctgaagtgcagtggcgctaccttggctcacggcagcctccacctcccagattcaagcgattcttgtgcctcggcctcccaagtagctgggattacaggtgcctgctaccatgcctggctaatttttgtctttttagtagagatggggtttcaccatgttggcccatctggtcttgaactcctgacctcaagtcatccacctgcctcagcctcccaaagtgctgggattacaggcatgagccaccacacctggcctgaaataatctttcaaattctttgtagaatttgttttttcctgatttctgcacataggataaaaaaaaaatcatgtactaggatttcgagagaagcaatgggtaatctaaaaagatgaaaagagcaaccacgtcaatcccacagctactgctagatttcataggaaaggtagctggcccagtttggagctaggagaaatgtcaaacacatgaagaaatgacaagcaaggaaatgccatcatgcatgaatgcttcatggcacccatgatgtccctgcttaggaggtaatggtatagatgactagatgacaaggacaaagatgagaggtgcgaagttgtccaagtccaacagctcaactgaactttcctaagtggaattgttaaaaagtggtaaatttaaaaacttcccctggctcacgtggtggctcacgcttgtaatcccagcactttgggaggctgaggcgggtggatcatttgaggtcgggttttgagactagcctggccaacatggtaaaaccccgactctactaaaaatacaaaaatttgctgggcatggtggtgggcacctgtaatcccagctacttgagaggctgaggcaggggaatcgcttgaagccaggaggtggaggttgcagtgagccgaggtcacaccattatactccagcctgggcaacagaaggagactcgtcttcggggtgagaaaagaaaaaaaaaaaagaaaaaagcttcctccaatttataccgaaaattctctgttcaggactaagtggcatagagaatgttaaatgtgcctagatatcttcataactcatatattttctgttttctacatatcttgaaaggcagtgccaaatgacgtgtaattatctaggtggtaaaactgaaacatacttcctcttcccttgaatataaaaaagcattgtggtattagtacttttatcttggatcattgttcagaaggaggttcagcccccagacaaccacatttttactgtcatgaatggcaagacaaaatgtagagctcaacttacccaaaggaaaaaaggctcaaaagacaaattatggtacaacttagcagccaaattcttaccaagtacagacttttgacatactgatctctctccagttccaagtcggaacatgcactttgaatgatgtcattcaaaattaccctgcccagacacacttttcattgattctcttggagggcagttctaagagtctctggggctttctctgcatcatgagacgcagagcagttctgcccttcaccttccggcagtttgtcacctcgtccctatgacctcagaggaactttgtctcaggccaattgtttgttccttggcctctttcatttcccctaaaaatcatttgctgcccctctaaatggcctacatctccatctatctccctctcccctcagaagagggtgctctttaagcatcaaccacccggcagttctagcagtctcatttttcagctggttcccatgtttatgcctgttctatgtttttcttttcctgttaagctgtctgttgtcagctcatttctgcagtgaatcttcagagaggagattggaagctttccttccacccatacgatagaactataaagcagaagagtttagaaagaatttcctatttaagtgacgaaacctcatactccatttgtgataaatagcacaaaggttaaaaaaacttatttttgaccaaaagctctgttgacattctattaaacaaacagtgacctatttaattttcataacgcaaatggcagatattttcataattcttatgctaataaatcatttccctgattttttgggtaaaaccacatattcataatgaagtccagaaatgtgaattgttttatataatttattcttatttgtgattacaagtatacctctacagaaagttagtatactcacccaaaggtaaactatccagagggtaatgacaactttataacttgtcggaaacgcaataataatatgtaaccaaggacttccaccaaagtcagtcccacgatgatgatggtcagccagagtattgataacctggaataataatagttgaaataatgaaaaggtcaatgacactgacaatatttcactcagaaagaatcatccttagaaaccgtcaacctcctccaaaaggtaaccacatccctcagatatcaccgtgggattccactgctacaaaaaagaacagaagttagaagtcacatgtttttcagatggctggtagtgttttcaggcactgcaaatgtggggtgttgtctttcttggtataaagcagggatatccaatcttttgacttccctgcctatattaaaagaagcaaagttgtcttgagccacacataacatacacaaacactaacaatagctgatgatctaaaaaaaaacctcttttttttttttttttttgagacagagttccgctccactcagtcgcccaggctggagtgaagtggtgcaatcttggctcactacaacctccagctcctgggctcaagccattctcctgcctcagcctcccgagtagctgagattacaggtctctgccaccatgcccgactcatttttgtatttttagtagagatgaggtttcaccatgttggccagtctggccttgaactcctgacaggcgatctgcctgcctcagcctcccaaagtgctgggattacaggtgtgagccaccgtgcccagccatttttttgtttttgtttttgtttgtttttttgagatggggtctcactctgtcacccaggctggagtgcagtggtgtgctctcggctcactgcaacctctgcctctcaggttcaagtgattctcctgcctcagcctcctgagtagctgggagtacaggtgcctgacagtgcactcagcaaatttttgtattttttgtggagatggggttttgccatgttggtcagggtggtctcgaactcctgacctcaggtaatctgcccgcctcagcctcccaaagtgctgggattacaggcatgagccactgtacctggccaaaatctcctaatgttttaagaaagtttacaaatttgtgttgaactgcattcaaaactgtcctgggccacatgcagcccgtcactcatggctaagacaagctaagtataaagtaattatcttttctttttgtttggagacaaagtcttgctctgtcacccaggctagattgcagtggcatgatctcagctcactgcaacctccgcctcccgggttcaagcgattctcctgcctcagctactgagtaactgggattacaggcgcctgccaccgcactcggctaatttttgtattttgagtagaaacagggtttcaccatcttggccaggctggtctccaactcgtgacctcttgatccacctgcctcggcctcccaaagtgctgggaatacaggtgtgagccactgcacctggccagtagttatcttttctttaaagttatttacttgttttttaaattgatgtataacattggatgcatttattatatatcacatggtaaaagaatccctctaaataatacttctctcttggattatatgaatctttgtcatttaaagctcagcataagtaaaaaaaaaaaaaaatacaatgaagagattacttcattcacaaataagtatcaaattttagtgcttaaaaattaacaaggtgggccgggcgtggtggctcacgcctgcaatcccagcactttgggaagccgaggtgggtggaccacgagatcaggagattgagaccatcctagctaacacggtgaaacccatctctactaaaaatacaaaaaattagcagggcatggtggcacgcgcctatagttccagctacttgggaggctgaggcagaagaatcacttgaacccgggaggcagaggttgcagtgagccgagattgcaccactgcacttcagcctgggtgacagagcgagactctgtctcaaaaaaaaaaaaaaaattaccaaggtggagatcatgaaaatggcatgaatagtgtgggatttctctaagattgttgatattaattccattagactcttatgtgagtgaagacgaagacttcccctgagtaagttcagacagcttgtgataacatttctacgtcgattcctcaggatttaactatatattcttgaaaacatctcaattttaaatgtttctttcaagatggtgaattaaacagagatagcccttcaacaggtggaactcagcatatgctgagtctgaaatggaaatgatgaagttagagaaccatacaacaatggtaatgatttcagaaacatggtgttgagcagaacaaagcagacacaaaagagtacctatggcatggcatgcatctgtatacgcgaaattccagaataagcaagctaacctatgataagaaagagactggctgggaagactgagagttcactttctggggtgacataatagtgtagatcttggctgggcacggtggttcacgcctgtaatcccaacgctttgggaggccgaggcgggcggatcacctgaggtcaggagttcaaaaccagcctgaccaacatggagaaaccctatctctactaaaaatacaaaattagctgggagtggtggcacatgtctgtaatcccagccacccgggaggctgaggcaggagaatcgctcaaacctgggaagcagaggttgcggtgagctgatattgccccattgcactccagcctgggcaacaagggagaaactgtctcaaaaaaataaataaataaataaaataatgtagatcttgaaagggggtcggtttatgctggtgtatgtactttccaaagttagtaaacttacacttaaggttatatattttggccaggcgcggtggctcacgcctgtaatcccagcactgggaggctgaggcaggcggatcacgaggtcaagagatggagactatcctggcgaacatggtgaaaccccgtctctactaaaaacacaaaaattagccaggcgtggtggtctactaaaaatacaaaaattagccaggcgttgtaatctgagctactcaggaggctgaggcaggacaattgcttgaaccccggaagcggaggttgcagtgagccgagatcttgccactgcactccagcctgggcgacagagtgagactctgtctaaaaaaaaaaaaaagtcatcaaaccagatgacacaaatcaaatgacatttcactttgttttggtccactttgtttgttagagacaagagtgcagcggggccatctcggctcactgcaacgtccagctcctgggcccaagcgatcctcccacctcagcctctccagtaactgggataacaggtacgcaccaccaggcccgactaatcttttttggaattttttgtagagatggggtttcgccatgatgccctggctagtcttcaacgcctggactcaagtgatctgcccacctcggccccctaaagtgctgggattacaggcctgagctgtgtaatttcatgccgcgtgacacagcccagtaaaaaggaagaaaccccgagggtccagcgtctactcacacggatgcactgatggctgataaattccagcaggagcccaaagaggagccaaaagagcatccaccgcccccgcatgtcctggtcctttcagggcgccctgaggcgtccaggacagaggtggaggtggcttagggcaggggggagggaaggggacggggaccgggcccggatctgagttggggagggggaggggagggggagggggaagggaaggggaggggaaggggggaagtaagggaagggaaaggaggagaagggggctgttgggcacctggaggaggagaagaagaaaggggtctgggaaaggatccggttcaaattaagttctcaagcgctggtggaaggtttagctacaggtcacggagaagatcagggaagcaacaggacacgcggggcaagggagcgtgaggcttaggagcaattagagggagacaaaaaggttctgctatccgccaaaccttcttcggtctgggccctcccttagcaaacctggggctttatactccctctccaccaatccctgatgaccccggtggtgcctcacaatggacaatgccaagtagcgcccgcatcattccaatgacccctcccccatctcagtctcccacactcctcgcaaggacaggtcctctctggaaccttcacaaacctgatttctggtcctccccaaccagctccctgtccctgcttctgggcgctccttccttcctgagctcccagggttcctcaaggtcacttttggcgacaaaacataaaaaacaaatgatggcaggatggcaggaagaacctcatacccaagcagagtgccaggttttacagcctccgctcagccattcatatcctaagcaacaaaacatcagcagggtgcggaaggtcccgatagtaaaccatctccatcacatccatgtagccatccgtccatcaacctgtatctcaggaacaaatgtagatacattcattttaagcatgcatggtacatttacaaaaattaacctgacttattttgttccagcaaatctcaatatatttgagagcaatcaaatcacacagcatgtttctgatcatgtaactgtgctagaagtcaatgattaaaagctaattcaaaattattatttgcttggaaattcaaagtgcccttataagacataaacataagaaagaatccaaaatgaaacaagattgcctttcaactcaatgataagatcataacatggcaataaaatgtctccctctggcctgggaattcctctttgtggcacaaggttgtgtgatctcaaatcccccctaacccacctagacattttaacatccgaaaccgagtgatgatgtccttatctataatcatcttactgcctgtgtgtgtggactttaaattctgaacccaaatgagggggagaaaaccaagttgaccttcatgattgacctctcagggatgtccaaggaatctgtgcatttcaagaaacaaagttcatcagcttctctcctaaggtatttgcccacaatacccagagggcttggcagcatcatgtgtgatgggtggggagctccaagcaggtgggcaggacccaggggtctggtgaccaggacagacccccactgtccatcacctttcctggccctgtcctcagttaaacttcccacagggcttctgcccgatcacacagagtgtgcccaaactcactcaggcctctggcagctgaaaaccactgctttaaatccctttaccatttactatgacataaggttattgtaaacaggaaatattctattgatgctacaaatggaaagccaatgcctttaccataaatagaaaaacaaccctaagaaacaagcaaaacaaaaacaaaacaggggctgggtgtggtggctcacgcctgtaatcccagcactttgggaggccgaggtgggtggatcacaaggtcaggagttccagaccagcctggccaatatggtgaaaccctgtctctaataaaatacaaaaattagccgggtgtggtggtgggcgccttagtcccacctacttgggaggctgaggcaggagaatagtttgaacccaggaggcagagtctgcagtgagccgagattgcaccactgcactccagcctaggagacagagcgagactctgtctcaaaaacagcaacaactacaaacaaacaaaaaacagggttaacaaaactatggaattcaattctatttatatgctgcagccatgttccagccctagatttggctgggcatggtggctcacgcctgtaatcccagcactttgggaggctgaggcaggcgcatcacgaggttaggagttcgagaccagcctgaccaacatggtgaaaccccgtctctactaaaaatacaaaaattagccaggcacggtggcacccgcctgtaatcccagctactcaggagactgaggcaggacaatcccttgaacccaggaggtggaggttgcagtgagccgagatcgtgccattccactccagcctgggtgacagaatggaatgagactctgtctcaaaaaaaaagaagccctcggatttcggttgtgttggttgtaaaaggagagaccaagtaagtgggggttgaagtcagattagaccaaaagtgaatggcagagagtactataatgtccatgaagggttgctagagtcaccgtgatcatagcccaagcagagacagggaaaggaagatgtgagcagagtttggggtctcgaacaatggaggttattcgtgcagcccaggaaaggctccccaaagccaggatcaacctcccttgcagggggtccctcatggaggcatggccaggcaccttagatttgagaccagctatgttgctgctgaccagctgtgtgaccctgggctggtttccttccatacaatgggagtgccaatggctgcatgcatgcaaagaccgtctgaggataggaggaagcaatctgttgagcacccgtgtacctgagtgtcatcacctcccaagggcatctttcgttccagagctggcaccttggaaggcccttggtcactgaaggcagtgatgatggtaacagcagtaaatcatcatttacggctgatgagggaaggccaggggtagggctcctaggtcctggataagaatgagggtctgggcactcctggggacagctgagtggtaggactcctgggtccccagggggcaggtccatcttcagtggcattgggcctaggctgggatgctgagttatccactggagcatcagcagtacaggcaggcacagaggcagtggttccatcggaggtggcaggtgtaggatcatctggtgagcaagtagagtcaccaagtctggctgaccactacccccactacccccactatccccacagacgattccctgtcccttgcctcatgctccggcagggtacaggctcgcacctggggcctcatggagcatctctctaagacctctgtgtcctggtcattgaatgggcacttgagtcacccagggccattggaacaaagaggaagaatcaggccccacgatgttttgggagagtgtttagcacaatacatgcacgacacgggggcactgtcagtgtgggagcaatagtttacaacctccagccctaatctgagcactcttgaacctgtgcaatctgaaaggaacaggagacttgcaggaaaaatagtgcctggatttaacttaaaggaactaaaatgttggaatttttactcttgatatccttccagatcaactctctcaatgttcccatcctcaaaactatcatctggggtaactgaggcagtcagagatttactgactcaatgtcactcagttgattctgagttcactgctgattacatctgaccaaactgctttttctgaagtctactctgtttcatcatgctggtgatgattttgtgcagctctgggacaaactccacctggctgaggataaagcaaatctgcggtgacttagtcctcctgtcatttcccatcagttccccactctcctcctctgcccctccacagtctcccatgtaggctgacaccatatgacagccttaatggagtccaccgagtatttcaggttctctcctgggccacttgaaagtggatgtacccatgggatttgctttgacccaagagatgtgagtggaagtgaagtgtgtcacctcgaggcaagagttgggagccattgagactggccaccctctccttcatctcttagagcagctgacagctcccatatggaggctgctcctttattctcgtggcaggatgagggcatgtggggcacagggcacaggagagccatggaggatgtgcagcatgggcaagaaaagagccttcagtggtgtacatttccaccgtttggggctgtttcttacctacagtgatacctagcccatcctagcaggcatgcaccatctaccccacactctgtgatgcagactagcctgccgtcagaacatgaactggtggtcagacacacgtaggtttcagttccagctctgcctcttattgactgtaacctcaggcttaactttcagtctctgggcctcagtttcaactctgtaaaatgaggtggctataccatctcaggttgcagagagaattaaatgaaatataagtgcatgtagagcattgaacccagggcctggcacacacagtgagtactcaatgttagccatgtagcttcataatgcatactgattgtcaatattcagacaatccagtaaagtattaccaaaaataaaagtaaacttatttgcatatgtattctttcaatctttatttttaaacagggtaaaactatgcatattctttcatagccagtgtttttctcttcatagtatattgttaaaataattttatcttggaccgggtgcagtggctcacacctatagtcccagcactttgggaggccacggtgggcagattacgaggtcaggagttgacacgagcctggccaatatggtgaaaccccatctctactaagaatacaaaaattagctgggcatgatggtgcacacacctgtagtcccagctactcagaggctgaggcagaggaattgcttgaacccgggagacggaggttgcagtgagccaagattgtgccactgcactccagcctgggcgacagagtgaaactctgtctctctctctctctctctctctctctgtgtgtgtgtgtgtgtgtgtgtgtgtgtgtgtgtgtgtgtatctctatataaatctcaaaaataaaagatcatttttgagattatcattttaaaagacaagataatgttcaacttaatgactaatttaattattactattggactttttgtagactaaacagagcattcaaaacaaatgaaggagaataaaaaatatgtattacatgttgtaaaataaatgtgatgtggttaattcttttattcaaaattatagaacatatatatgtactatagaatgtatttattatgagtcatgttaaaaagtagtttagaagctgttgatttgaatttccttttcaaattttgcaggataattttttttttttttttttgacagagtctcgctctgtcgcacagtctggagtgcaatggcgtgatctcggcccactaaaacctccacctcctgaatctaagcaattctcctgtctcagcctcctgagtagctgggactacaggctcacaccaccatgcccggctaatttttgtatttttagtagggacgaggttttgccatattggtcaggctggtcttgaagtcctggcctcaggtgatccaccagcctcagcctcccaaaatgctgggattacaggcatgagtcaccatgcccagcctaaacttggcaagataataaataacctttttaagtgtcgttgggcacttgtctggttgtttttctttaggttaccatgccagcaatgattccttttgagtttctgacagaagatagtggttttcatccaaataagtcaactactctaccccatccctaagccacttgtatggaaagaaaaagaggaagaagccagtactgtgactgcgtaagcttcccccagcatcacccgctatgagatgtgtggcagctgagacccgggaactgctcaagggcaccaggccccatctgtctgcactcactcaccttcctcaggtactcgcatgggcatgtcactgactttacgtgctgctgcagctccttggtgagctggccctggtcatgggacaggaactgtggggtcaggacaatagagagcttcaccatttgcagaatgagaacaggggctcatgatgagtgccaacctattagataatttaaaaaaaaagtgttgaatgagtggaaaaacaaggtgatgtttgagtctatagtggtcaagggcttcagaaaaggacagaaccaagttcaaattcctgtactttgaatttctacttcatgccatgcaaaattactttaccccttttaacctcagttttcttctgtgtgaaacaggaacaatagtttcattcgtcattcagtttctctcaaggtttcacgagatcatacctataaaacatccaagtcatttaaatgtatcatcatttctgtcataattagtgggatccatttcactattattggatatacagttctgtgcctgaaacctacaaaaaaagaaaatgttaagtctaaaaagcattagtgatttctcatttttatattactaattataaccctatttaatcacacaaggccttgtccgtggcaggtgctcaataaacacttgtcgaatcaatgcatgtgggctccggagccacactgtttagattctattctgcctccaccacttatcagctgtgtgatctgggtaagataattcacctctttatgtctgcacttccctctccataaactatatataatgagaatccttagctcattcggttgtggtgaggggtgaatgatttggcacacaggaggggcttgttaaacattagctgtgatgatctccttccaaatcttcattttcagagccacagatgaggccacagtgcaaccaggtgaccttagagtgtaagtacacatgatcgccagctatgctctgtctccaccataggtccaagactgggtagttccggcctggaggtttctgctgcatctgccttctcagtgctcacctaagggcttttgtattttcctcctcgcatccccacagatggggttcaggctgccggacacagctgggtgatgccagggcagtggtcacctgtgccagccctgtgaggtagctggaggatcattgttccttccttctcgggctctgggcagatgccagggctggggtgacccatgccctcaagtttcttgctttggtgggccacattttcccttggcaaagagggtaaaggtcacaggatgccagagagctgtgacttctctgtgccctgggcccaaactatgaagacctgacacactatgctaaaagtccaaggctgggtgctccccagagcttcttgcctcaccgcttctgctgagggaggaatgaatactatgtcctcccagagctttgggagcttgtagcaagcagcctccccagcacaaaatctcttggaaacctctaactgtgtctgaaacattagtgcaaatgttgcatcatatttcccatatgtccgcatgttttaggaaaaaaccctcaatttcctaaatatgcaagaaaaatcgatattgtaggacaatgtgactttttaaaaaatgttatttaaaaatcttccccacctccttttctgccctccaagactgccaaatacttgttgaacaaatattattaaaagcctactacgtgccagccatgattcatggtcttggggacacagcagagaacaaactgacaggattcctctcttatgcaactcacattcttatacgataatgataagggttaacattaattaagccgtcaccacgtgttagtcacggtgcagtcattcccacacattattacacttaaacctgctagcaagcttgcaaggtagttagttgtttttcctttaaaaactgagtctcggaatgatgaagcactctgtccaatgtcacacggctagtaagtgtggagaccttgcatccaatcaatgcccgtctcattctaaaggccatgttatgtgttctccagcccatggagaataattttaacacagtcaatgaaatttctacacaacaatgttcttgtttcaagtccaagaatgcctcctacacctcctataatactggctttctggtgagtaaagatggcattctcatgtgtaatcaggtggcaaatggagatatgaccaaagtaaccatctgcctacactcataaccctgtacacactcttcctgtgtcgattcaattcaagtaccccttttgatcacttagcaaatctgacctttaaaagggttaaggtttttatatccatgtaagtttctgtattgctttggaagtctctggttaaattaatactcttttaatagtgacctgtgattctgttttgatcaagtgttttcaaacttgacgtctttgatgggtttctccagtgtcaaaatcctaaatcaagtctttttggcttaaaactaactttgggattttttcagctgcatcccttggggagtctaaagaatgtatctctcatcttgtagaggtattaagtgattcgatttatttggtagattaaatgggcaggcattgtcaaatgtggcgatactgcatgggagggcactgtcaagtgaggtgacattagatctcatctcagttatatttatgggtatgttgttgatatacgtgttccaaaaattgcatacatttatacaaatttaatatgatttgtaattttgatagttatgctaaatgtttgctaaagttatatttgtataaacacgtcatgaatggctgggcaccgtcactcatgcctgtaatcccagcactttgggagacaaaggcaggtggatcacctgaggtcgggagttccagaccagcctaatagagtgaaaccctgtctccactaaaaatacaaaaattagccatgcctggtggcacatgcctgtagtctcagctactcgggaggctgagacaggagaattgcttgaacccaggaggcggaggttgcagtgagccgagatcatgccactgcactcccgcctgggtgacagaggtagaatctaactaaaaaaaaaaaaaaaagttattaattatttctgaagattgtatgaaatttataaaagtctggtggccctgatatgatgctgccagtcatgattctgattactgtcttaaaatgctgcacgtaagtaattaaatttccttgtgaactgggaagtttcatcagacttctatcataactattgtttccatcatccacagttactattttgaattcttctctaaaaatatttgtaattggcaatagtccaaattttcttttgttttctttcctgtttttgagacacagtctggctctgttgcctaagctggagtgcagtggtgggatctcggctcactgcaagctccgcctcccgggttcacaccattctcctgcctcagcctcccaagtagctgggactacaggtgcctgccaccacgtccagccaattttttgtatttttagtagagacagggtttcactgtgttagccaggatggtctcaatctcctgatctcgtgatctctgcgcctcggcctcccaaagtgctgggattacaggtgtgagccaccgtgcccagcctaatttttgcatttttagtagagaggaggtttcaccatgttggccaggattgtctccatctcctgaccttgtaatccacctgcctcggcctcccaaagtgctgggattacaggcgtgagccactgcaactgactttttttcttttccttttttttttgttttttgagacagagactcactctgtcacccaggctggagtgcagtggcatgatttcggctcattgcaacctccacctcctgagttcaaacaattatcctgcctcatccttcagagtacctgggattacaggtgtgtgccaccgtgcccggctcatttttgtattcttagtagagacggcatttcgccatgttggccaggctggtctcaaactcctggcctcaactgatccactctcattggccttccaaggtgctgggattataggcgtgagccactacaactggctcagtaaatacattttttattatcaaaaaagagcagtgtatggttggcatattctgtgtagaatgtattttattgatgtctcctatttttataatttgcgagttaagtactttttaattaatgctttttagttttgggcagattcagttgactaaagcacctcatttccccgatacatgaaataaaatatttggcttcttttccaatttcacactgatgttattttgtgaaaatcagtgctttaagataaatctttatacgttaaggtaaacatgagaaacttgatctaatatttaatatttattcagttctacactttattaacttgtacaccagcagatttaaacattatgtaactatctcaagaagtttcacttggatgtaatgcttcacgcttgtaatcccagcactttaggaggctgaggtgggaggactgcttaaggcaaggagtctgagaccagtctgggcaatacagcaagatcccatctctattttaaagaaaagtttcactttgggaggccaaggcgggtggatcacaaggtcaggagatcgagaccatcctggctaacatagtaaaaccccatctctactaaaaatataaaaaattagccaggcgtggtggtgggcgcctgtagtcccaactactcgggaggctgaggcagaagaatggcgtgaacccaggaggcagagcttgcagtgagctgagattgcgccactgcactccagcctgggcgacagagtgacactccgtctcaaaaaaaaaaaaaaaaaagtttcagcaaattccatctaagaattccaccacagttctgttgtctccaatgtcatcttccacagatttcaagttgtgaagccctgaactgttaatttatcttgagaatgtatatttaagcttaatttaagactatatacctaaaaattgagcatataatttctataatttatttatgtaagtttctgtaagtcataagtatgtggtttccaagggtataatttatctgaatgtaataggcattaatatattttacattattgggaccatagtacagaaatttctaaatggtttgtaaaataacttgttatttgtgttgttgtaaaagcagttaatacaatggaaaaacttgtaagaagaagatacagtttaacatcaaaaagtttacccaaggtaattatgagtactacacctggcaaaacttcacagaagctgtggtatcacttttacgatggaagaatagtgtttgcattttgtgtaaaagtacttgcggctgggcgtggtggctcatgtcccagtgctttgggaggcgaaggccggtggatcatctgagcccaggagtttgagaccagcctaggcaatgtggcaagagcctgtctctccaaaacctacaacaattagccaagcatggtggtgtgagcctgtagtcccagctacttgggagactcacgctggaggatctctcgagcccaggaggcagaagatgaataaataaatggatgcaactgaatgggatgaggtctctcttgaaggagagagcaaaagagatttaaatagtaacaattataataaggctgggcgcggtagctcacgcttgtaatcccagaactttgggaggccaaggcaggtggatcggttgaggtcaggagttcaagaccagcatggccaacacggtgaaaccctgtctctattaaaaatacaaaattagccggacatggtagtgcgtgcctgtggtctcggctactcaggtggctgagacaggagaatcgcttgaacctgggaggcacaggttgtagtgagccgataaatataaaaagtattagagtactaacagaggaaagtttccactgatcaccttttagctttaaataatacagaagcatttgcccagtttacctgtaattaaaaatcatgcatcattcacgatttatatcttttttgtttgtacaaaaatgaatacaagttattctcttttatctgtattgtgattggtttggtgagagggaattaggccacttgagagtttgtgtgtgtttaaaattttctggccaggcgcggtggctcatgcctgtaatcccagcactttgggaggccaaggcaggcggatcacttgagctcaggagttcgagaccaaattgggcaacatggtgaaaccctatctctacaaaaaatacaagaattagctgagtgccatggcttgcgcctgtcctcccagttccttggggggctgaggcagtaggatcgctcaagcccaggaggtggaggttgcagtgagccgagatcatgccactgcactccaggaagggcaacagagcaagactctgtctaaaaaaaaaaaaaaagaaagaaaagaaaattaactttggtatttcaggttgtatttaaatggggacttaacatgaactatgttcataacagttgaccaaattaagtgtagatcgtctctttaataaagagatcatctggaactgcaatttctaactcatacatcattgctagaaaccttatttgtttactgtttctcttccaaggaccatcagtcatcctttaaaattcatttgaagctctgaaaagatattttttgttacatgggcaatttacttttagtacagtaaaatgttatgtgaatttctacagcatgtttgccaaaatgaattgtatctagaatacgcttaatatattctggaggcagctttcatttgaaattaggttcatcttctgagagtatgaaaaagttaatgggtttttgtgcctgaagattttgatgttgcatttggctacatttaatccactttcacccataagttttagcatctaaaaaaatgaaatcactgctaatgcaattaaaatgcattatgaaatgcatttctgtccaggctggagtgcagtggcacaatctcggctcactgcaagctccgcctccctggttcacaccattctcctgcctcagcctccctagtagctgagactacatgtgcccgccaccacgcccggctaatttttttttttttttttaatgaggcggagtctcgctctgttgaccaggctggagtgcaatggcatgatcctggctcactgcaacctctgcttcctgggttcaagtgattctcctgccttgctgggatgacagacgtgcaccacaatgtccggctaattttgtatgtttagtagagacatggcttcaccatactggccaggctggtcttgaacttctgacctcaggtgatcccaccttggcctcccaaagtgctgggattacaggcatgagccactgtgcccagcttaagatctctgttttaatgttaatgctggtcagttgtgtctggattccagagggaggaaggtagaatgaggcatgttgacacctccccttcccatcatgacctaagctggtcttttcagtttacttttgaatgtccttgctcaacaggaagggtccattcagtcggattgggtggcttagaattttatttttggtttacatctcaactgtcacagcagccgggcgcggtggcttcacacctgtaatcccagcacattgggaggctgaggcaggggtatcacctgaggtcaggagttctagaccagcctgaccaacatggagaaacccccgtctctactaaaaatacaaaattacccgggcgtggtggtacatgcctgtaatcccagctactcgggaggctgaggcaggagaatcgcttgaacctcggaggtggaggttgtggtgagctgagatcgtgccactgcactccagcctgggcaacaagagcgaaaatctgtctcaaataaataaataaataaataaactatcacagcataaagtaggaggaatatttcgttactgtctatttaaactggttaatgcagaaaggaagtctggaaattccagttttaaagtaaaattttggacattgtaggattgattatttggcatagttgtgatgtttgttcctgcattatggttttgttggcagggcagcctttaaggacctgtatattttcttctagactctatatattccctgtgagtattagttgtatggtcaaactggcaaattttaccataggtataaataatagagaatgtggaagaatagtgaatagtgtcagagatagttaaaagtccatacaatagtagagaaggtaataagtaatagtggcttggactaaatatttgttgaataaatgttttaaaaaacaggctacctacaatttgtgttgaagatatgaatgaatgaagtttccacacccttatgtggagtcctgataagtaagcaacaataaggaagggtccccaggttggggagagccccaagttgagaacaataatgaacaattactgtatgaacaattgttagagacagctaatcacaaacaacctgcgggcacaatgacctcattccacacgtagcacccttcagcaggaccctataaaactttcctccagcccctgcctctttgcaggtagccccttctctgctgagctgcccactgcaacatattttcataatttctctaataaatctgcccttctttacctacaactatcttggtaaatggctttaccacctgcaaaactgaccctaggttgttgctacccgatatggtttggctgcgtccccacccaaatttcatcttgaattgtagttcccataatccccatgtgtcgtgggagggacctggtaggaggtaatcaaatcatgggagcaggtttttcccatactgttctcgtgatagtgaatacatctcactaaatctgatggttttataaagggcagtttccctgcacgtgctctcttgcctgctgccatggaagacatacctttttgctccttctttgccttccaccatgattctgaggcctctccagccttgtggaactgtgagtacattaaacctctttttctttataaattacccagtttcgagtatttcttcatagcagtatgaaaagtaactaatacactacccgagacaccttaggagatttgtaatagctgtaatgccaggtccaccatatttttagcataaagcaaatgttcatgcatgatatgactgcacaggctttctttcagctggagccatagcaactcaagtagtaaccctatcttagtctgattaaaagtaaatattagtctgggcatggtgggacatgcctgtaatcccagtactttgggaggctgagacagaaggattgcttgagcccaggagtttgagaccagcctgggcaacatggaaaaacaccgtctctacaaaaaatacaaaaattagctgagcgtggtggcacacacctgtagtcccagcaccttgggagggtgaggcaggaggatctcttgaacccaggaggtggaagccgcagtgggcagtgatcatgtcagaggtgtgtgaaccagagcaactccatcttaaataggagccgggaaaagtgaggctgaaactactgggctgcattccctgatggttaaggcattctaagtcacaggatgacatagaaggtcagcacaaaataccagtcataaagaccttgctgataaaacaggttgcagtgaaggagctggccaaaacccaccaaaaccaaaatggagacaagactgacctcccatcatcctccctgctacactcctaccagcaccatgacagtttacaaatgccacggcaacatcaagaagttaccctatatggtctaaaaagaggaggcatgaaaaatccactccttgtttagcatatcatcaagaaataaccataaaaatgggcaaccagcagccctcacggctgctctgtctatggggtagccattcttttattcctttactttctctcttttttttttgagatggagtctccctctgtcacccaggctggagtgcagtggggcgatctcggcttactgcaagcttcgcctcccgggttcatcccattctcctgcctcagcctccagagtaggtgggactacaggcgcccgccaccacacttggctaatttttttgtatttttagtagagatgaggtttcaccgtgttaaccaggatggtcttgatctcctgacctcgtgatccacctgtctcagcctcccaaagtgctgggattacaggagtgagccaccgtgcccctcctcctttactttattaataaacttgctttcacttcacactgtggcatcaccctaaattctttcttgcacaagatccaagaaccctctcttggggtctagattgggacccctttcctgtaactatcatgctactgcactccagcctgggcaacagagcaaggccctgtctcaaaaaaaaaaaaaaaaaaaaaaaaaggaacatgacttaatacattcattttggagggtaagtctctcaaaataggcctttcactgggggaaaatggtaaaaatactccctggtaattcaagaattggagactcctgagatgctgctcatattagctgaacacttatcaatacttcacttttttccatatatactcaaggaacaagtgctatttaaagtgtttcactccactgtgctaggtgcaagactataaagaggtgaggatcaacacttttatgaaaaccagtgtcattctggatatagtttcagatgctagtgcaaaggaagctcttggtatacggaaaaagtattcaacaataaattaggcatggttgcttccattttctgcctcacatactttttttttcgtggttaaagtgatataatgtctatgatattttagattggcagttgcaaactagtggtcctcagcgtgctttttatgacacctacaaggtttgaagactttgatttcatattaaaaatctgggtttcaggctgggtgtggtgttgcatgcctgtaatcccagcactttgggaggctgaggcaggagaatcgcttgaaccagggaggtggaggttgcagtgagccaagatcgggccactgcactcaagcttaggcaatagagcaagactccatctcaaaaaatgaataaataagtaaataaaatctgggtttcaggccaggtgtggtggtgcattcctgcaatcccagcactttgggaggctgagatgggcagacagcttgacctcaggaattccagactagcctgggcaacatggcgaaaccccatgtctacaaataatacaaaaaaattagctgggtgtagtggagtgtgcctgtaatcccagcaacgtgggaggctgaagtgagaggattgcttgagcctgggaggttgatgttacagtgagctgagatcgccctcctacactccaacctgggcaacagagccagaccttgtcttaaaaaaaaaaaaaaaaaaaaaattctgggtttctggcatctcaaaaaaaaaaaaaaaaaaggaaaggtcagggcacatggctgctacagtcctctattagcaatgtgccacagcaggggtccctgacccctgggccatggacatgtactggtctgtggcctgttaggaactgggccacagagcaggaggtgaatggtgggtaacaattgaagcttcgtctgtatttctggctgctccccattgcttgcattgctgcctgagctctgcctcctgtcagatcagcagcatcattagattcttacaggagcatgaaccctgttgtgaattgcacacacgagggatccaggttgcatattccttatgagaatctaattcctgatgatttgtggtggaacagtttcatcccaagaccattaccatcctgcgccccatcccttgccgcctgtggaaaaattgtcttccacaaagccggtccctggtgccaaaaatgttggggactgctgtgctttagaatctgccatgaatctgcagcctctattatatagctccctatagactttgcttcctaccgtcttacgttctgccttataggcatttgagtttgcagcccttgtttttgttagtatgttatgctggtgacattgaccaaattgaccacacattaatgataagcttagttggtgatgacctcaacggaataacgtgacataagtattgtgacaatacttcttgcatgtatctgcaggtggaattgtaaacctggtggtccgagatggtctaattccatcttcctatgtatctccttatattaatagtggtaacatttgtgatggtgattcagcatttcaatgcctcttctcatggcaacaacaaacgttttccttctgaatcaacattaacctagatgttactgtggatcaaaattagactctacattttcaaccacagaaatactgggcagtaaaaatttttcttaatattgattgtctacataggttgtgtaattagcatgtgtttacagttctatgatttctgcgtggctgctacagagctggagggggtaaagcaacagtgttttctcagttgtgcgagcagcattacattataataaataggtaatattaaactgggctgatgagagttgcaaaagactactttaatgttcatatggaaccaaaaaagagcccacattgccaagacaatcctaagcccaatgaacaaagctggaggcatcatgctacctgacttcaaactatactacaaggctacagtaaccaaaacagcctggtactgctaccgaaacagacatatagaccaatggaacagaacagagccctcagaaataataccacacatctacaaccatctgatctttgacaaacctgacaaaaacaagaaatgcagaaaggattccctacttaataaatagtgctgggaaaactggctagccctatgtagaaagctgaaactggatcccttccttacaccttatacaaaaattaattcaagatggattaaagacttaaatgttagacctaaagccgtaaaaaccctagaagaaaacctaggcaatactattcaggacatagggatgggcaaggacttcatgtctaaaacaccaaaagcaatggcaacagaagccaaaactgacaaatgggttctaattaaactaaagagcttctgcacagcaaaagaaactaggatcagtgtgaacaggcaacctacagaatgggagaaaatttttgccatctacttgtctgacaaaaggctaatatccagaatctacaaagaccaccaacaaatttacaagaaaaaaaacaaaccccatcaaaaagtgggcaaagcatatgaacagacacttctcaaaagaagacatttatgcagccaacagacacatgaaaaaatgctcatcatcactggccatcagagaaatgcaaatcaaaaccacaatgagatatcatctcacaccagttagaatggcgatcattaaaaagtcaggaaacaacaggtgctggagaggatgtggagaaataggaacacttttacacggttggtgggactgtaaactggttcaaccattgtggaaaacagtgtggcgattcctcagggatctagaactagaaataccatttgacccagccatcccattactggatacatacccaaagcattataaatcatgctgctataaagacacatgcacacatatgtttatcgcggcaatattcacgatagcgaagacttggaaccaacacaaatgtccatcaatgatagactggattaagaaaatgtggcacagatacaccatggagtactatgcagccataaaaaaggatgagttcatgtcctttgtagagacatggatgaagctggaaacgatcactctcagcaaactatcacaaggacaaaaaaccaaacaccgcatgttctcactcacagatgggaactgaacaatgagaacacttggacacaggaaggggaacatcacacactggggcctcttgtgtggtgggggagggggaagggatagcagtaggagatacacctaatgtaaatgacgagttaatgggtgcagtacaccaacatggcacatgtatacatatgtaacaaacctgcacattgtgtacatgtaccctataacttaaagtataattttaaaaaataagtaaataaataaataaaaaaagaaacaattgctggctttgcaattctctttcctccaaaatcgccaaggcctcaatttactcattgctgaaaaaggacgactctgtatatttttaaatgaagagtgttgtttttacctaaatcactctggcctggtatatgacaacataaaaaaactcaaggatagagtccaaaaacttgccaaccaagcaaataattatgctgaacccccttgggcactctcttaattggatgtcctgggtcctcccaattcttagtcctttaatacctgtttttctccttctcttattcggaccgtgtgtcttctgtttagtttctcaattcatacaaaaccgtatccaggccatcaccaataattctatatgacaaatgctccttctaacaaccccacagtatcagcccttaccccaaaatctttcttcagttgaatctctcccactgtaggttcccaggccgcccctaatcccgctcgaagcagccctgagaaacatcgcccattatctctccacatcacccccaaaaattttcgccaccccaacactttaccactattttgttttatttttcttattaacataagaagacaggaatgtcaggcctctgagtccaagctaagccatcatatcccagtgacctgcacgtatacatccagatggcctgaagcaactgaagatccacagaagtgaaaacagccttaactgaagacattccaccattgtcatttgtttctgccccaccctaactgatcaatgtactttgtaatctgccccactcttaagaaggttctttatcatctcccccacccttaagaagtttctttgcaattctcctcacccttgacaatgtactttatgagatccacctcctgcccccaaaacactgctcttaactccaccgcctatcccaaaacctataagaaccagtgataatcacaccaccctttgctgactccttttttggactcagcccgcctgtacccaggtgaaataaacagccatgttgctcacacaaagcatgtttggtggtctcttcacacagacacgtgagacgggagttcgagaccggcctggccaatctggtgaaactctatgtctctactaaaaatacaaaaattagctgggcatggtggcgggcacctgtaatcccagctactcgggaagctgaggcacaaaaattgcttgaacccaggaggcagagtttgcagtgagccaagatcacactgtcaggcctctgagcccaagccaagccattgcatcccctgtgacttgcacgtatacatccagatggcctgaagtaactgaagatccacacaagaagtaaaaatagccttaactgatgacattccaccattgtgatttgtttctgccccaccctaactcttcaatgtactttgtaatctcccccacccttaagaaggtactttgtaatctccccaacccttaagaaggttctttgtaattctccccacccttgagaatgtactttgtgagatccacccctgcctgcaaacatggctcttcaccccctatcccaaaacctgtaagaactaatgataatccaccaccctttgctgactctcttttcggactcagcccgcctgcacccaggtgaaataaacagccatgttgctcacacaaagcctatttggtggtctcttcacacggacgcgcatgaaacacacgactgcacttcaggctgggcgacagagctagattccatctcaaaaaaaataaaataaaaaggagtcacctcccccgagaggcctctggaccaccccatctgagcaggccactcttccttctctatcttaccatcttgtttctgtcccagtagttagggctacctccagtaatcctatttgtccctttactgtttagtgtgtctcgcttgactagaagctccatgaaagcagagaccctacctgcctccttcgccactagacccccagggcctggtatgtggtgatcgctcagggcccattttcttcctttcctcctcctccaagggtggggaaagagcatcagaaggtctaggtggccccaggcccaaacaatgctcctttaaaaggaaaccagattgttacaaaggtcagaggctgaaaagttatttccgccttttatccctctaaattcttcacttcctgaaaaaacaaacaaacaaaaaaagccactgagggcccttggactaaatccaggcctgagttgctgggcagaggtcagtcttgtccagacatgggaaaaaaataactcgagtcagacaggtgggtcaccacagaacgaatccagcctgcaaatggcctgtgcaatcttcagctctgtccagacctgcctccctctggggatgcctttaaaggtgatgaatgatctggatgaatgggcttagaggataagagggaaaaacaaatatcacaggtcaaatcgttatttgtcttcaagtttaacaccgtctactggactaaaagatgtccaaagaatagttgttcaactatgtaaattccttttttttttttttttttttttgagacagagtctcgctctgttgcccaggctggagtgcaatggtatgatcttggctcactgtaagcaacctctgctcctgggctcaaaccattctcctgcctcagcttcccaagtagctgggactacaggcatgtgcctccacgctcagctaattttagtattgttaggagagacagggtttcaccatgttgaccaggctggtctcgaactcctcacctcaggtgatccacctgcctcagcatcccagagtgctgggattacaggcatgagccacagtgcccggccaactacataaattcctaacaacgtatctccagaaagtataggcacaacagcacatgcagtcattcctgtaattaagtgctccgggaggccaaggcaagaagatcccttgagcccaggagtttgagaccagcctggacaacatagcaagactgtgtctctacaaaatatacaaaaattgggctggggatgatggctcacgcctgtaggcccagcactttgggagaccaaggcaggaagatcgattgaactcaggagctcgggaccagcctggacaacgtaacgagacccagtctctactaaaactcaagaaaattagccagacgtggttgcatgtgcctgtagtcccagcactttgggaggccaaggtgggtggatcacctgaggtcaggaggtcgagaccagcctggccaacatgatgaagtctcgtccctactaaaaatacaaaaattagccaggaacggtggcacacacctgtagtcccagctacttgggaggctgaggcaggagaatggattgaacccaggaggcagaggttgcagtgagccgagatggcaccattgcactccagcctgggcaacagaacaagactccatcaaaaaaaaaaaaaaagaaaagaaagaaagaagaaaattagccaggtgtggttgcatgcacctgtagtcccagcactttgggaggccaaggcaggaggatcaatcaaggctaggagtttgagactgcagaaggaaaccctgtctctaaaaacaaggtccagctaaaatcagggtccagctccaccacaagcgcagctccaggggctgttgagttttgcctctaccattccaagtagtctctgctccagaccaagtcccaccatctggcagtcatgtcagtccaaccacagtcatatcagggcacttccaggttctttcattgagtgccccttgaggaggctggaggagaggccaatgacatttgcacttgagactccagagtctagatttataaccactatgttacggctgccagagtggctgcaaggacacttctttcattcattcatttacaatacatgtagcatctgctgtgtgccagatgccattctaggttctagggaaacaaggcagagcccctgttttccagggcatccacattctaggaaagactgctaccagcctggcgtggtggctcatgcctgtaatcccagtactttgggaggccgaggtgggcggatcacttgatgtcaggagttcaagaccagccaacatagtgaaaccccgtttctactaaaagtacaaaaatcagctgggcatggtggcacgtgcctgtagtcccagctactcaggaagctaaggcaggagaatcgcttgaacctgggaggcagaggttgtggtgagccgagatcatgctactgcactccagcctgggcaacagagtgagactacatcaaaaaaaaaaaatagtaataaaataaagactgctactaaacaataaaataaccaaaccagatagatgacttcaggtggtggtaagagctttgaaagaataagcaaggtaactaactggtcagaggaagggagatgggtgcattccctcagatagaccgccccagaggtctgcctctctgacatgacatttgagcagagacccaacaggaaaaggaagagactgctctatggccaggcacggtggctcacacctgtaatcccagcactttgggaggcccaggcgggcggatcacgaggtcaggagatcgagaccatcctggctaagacggtgaaaccctgtctctactaaaaatacaaaaaaattagccgggcttggtggatgcctgtagtcccagctactcgggaggctgaggcaggagaatggcgtgaacctaggagacggagcttgcagtgagccgagatcacgccactgcacttcagcctgggcgacagagtgagactccatctcaaagaaaaaaaaaaaaaaagaacaaagaggagtccaggcgaagagaacagcagatgcaaaggccctgaggcagaaacaatcttggtatgctggaggaataggaaggcagccagtgcagctggagcaggataggttaagagaggatcaaagtgatgagggcctggaaagaggggctggggtcgaatcaacagatcctgttggttgcaatggaagagcctggagtttattctcagagcagtgagaagccactggaaagttgttttttgtttttctgtttttgagacagagtctagctctgtcacccaggcagactgcagtggtgcaatctcggctcactgtaacctctgcctcccaggttcaagcgattctcctgcctcaggctccccagtagctgggattacgggcacatgccaccacacccatctaatttttttttttttttttttttttgagacagagtctctgtcacccaggctggagtgcagtggcgcaatctcagctcactgcaacctccacctccctggttcaagcaattctcctgcctcagcctcccgagtagctgggactacaggtgcatgccatcatacctggctaattttttgtgtttttagtagagacaggatttcaccacgttagccaggatggtctcgatttcctgaccttgtgatctgcccaccacggcctcccaaagtgctgggattacaggcgtgagccaccgtgcctggccagccaccggaaagttttatgtaagcaggggagtgatctgttttatcatttagaaggatacacacctcttcttctttttttagagacagggtctagttctgtcacccaggctggagcccagtggcacaatcatagcttactgtaacctcaaactcctgggctcaagtgatcctcctgcctcagcatcccaaactgctggattacaggcatgagtcaaacacgcctggtcacacttctcatccagacctcatttgtccacctcccccatcccccgccccaccccacggtctgtcctataacgcccacacaacaggtcactgtttagaaagtgctacaaagttacaaacacagtcccttctgagcctcccaccaatgttggtgggtacaaggtcaaaaaaaaaaaatctcatttatgtaaggggcataggagactttttagttagagggcccaattatagtcctcctgaaaagatgccaaaagtccccttaaacacttagcagctaagattcaagaaagatgaatctcacattctttgtatgggaaatgaggaacttgacatcttcaatataatggattccactaaaataagatgatgatcaataggaaccaactaaaaaaatacttgactagctgttattgaaaggctgaaattcagctgacataagcagtaatattgagctagaaaataattcgcgttgaattcagcccaacttttgttttctgatttgggtctcttctaaattttttttttcttctggacattgggaacaatccaatttgaaggcctcaatgcccaaatctacactcttgttttattctatatccttggtttcttttttttttttgagatggagtctcactctgtcacccaggctggagtgcagtggcgtgatcttggctcaatgcaagatccgcctcccgggttcatgccattctcctgctgcagcctcccgagtagttgggactacagatgcccgcccccatgcccagctaatttttttgtatttttagtagagacggggtttctccgtgttatccaggatggtcttgatctcctgacctcgtgatccacccgcctcagcatctcaaagtgctgggattacaggcgttagccaccgtgcccggcccacacctaggtgatttttaaaattcttctagtagagacagggtctcactatgtcgggtcgccgtgtttgatgtcagttttccctgccagaatctacaatctccttgatcaccattatatcccaacgtagagctcagtacctggtacaaagcacatttgatcaatacttgctgaataaagaaataaaaatgaagaggcactccagcctgggcaacagagtgagatggtctcaaaaaaaaaaaaaaaaacgactggaaaggagatgagggtacttgtgaagccatattatatgacacgctctgtgctaggacttttatataccttgtctcatctcttcatctcatataatccttacaagtatctcaaaagtggggaaatccccatataactgaagacgaaggcagttcagaagttcactgatttgccctaaggttcctcaatttgcaaacgtcaggccaatgatccaaccccaggtatgtttggcagtgaaggaccagttgagtcatagctgcaagtaaccaccctgcagtggtccctatcttggccgttagcttacattgacatttaacactcaaatttactcagtaacaccagctatcatgttttccactaaaactccacagcattctggcaacttttctattttagagcaataaagtaaattgttagcatccctttgacatataaatatttctacaaatagtaattctctagccattcatttggagtatttaaaactcaacattcatagcacattttatgtgacaaagaacttatgttcagaacacaaaaataagtcttatgtcttcattaaaaacgggtgaagaatttgaacatttgcaaactaaaatacaaatggaatacactcaacatcattaatcatcaagaaaataaaattatgagataatcattaataatcactacatatgcaccacagtgattaaaatttttttaagttaagccacgtgacccaacaaggtgcattcactcaagagaaacgcaaatatatgtccactcaaagacttgcacatgaatgttgagagcaggtttatactgaatagtgcaatgtgaaaaaaccccaaaatctagcaaaggatgaagggagaaataaactgtggtatatatacatacaatagaacactactcaataataaaaaggattgtattcttgatacatgcaatatgggtgaaccttaaaaatatcatgctgagcaagagaagccaaacacaagagaacatgttgttatgatttcacgtacatgaaactttagtaaaaacaagtctaatccatagtgacagaaagcaaatcaataactgctgacaggggcaaatgagatgatcccaagggaaccttctggggtaagacgctgttctgtatcttgatcgtattggtggtcacacaagtgaagacatgttagaactcatcaaaccatacacttagaatgtgtaatataaacctcaataaagcaaaattaaaaaaaaaaaaaccacctttaattttctcttacaaaaaagaaaggaaaaccacttaactttaattttctccaacaactgattctggtacacagtataccttaatgcctgcatccatggcctcacgtcatgctgtttacatgaacataaagcttcaccgaagagtggaataagacagtcctgccagagaaaaaccaaaattactcaacgtaaaacaggctgttgatatgtttgcagatatatagcaagtcttaagtccaagactgcaatatagtttggctacttcagattgattgcaatagttttatctattacactatacccttacatcatttatcttctactcacaagaggcaagcacacagtaagagaaagccttttgttttgaagggaaatcttcttcagaatattaagtctaatttatcaatacattaataaagcacattacaaaaaaaaagtcacagcacatttactataaagcagactgcagaaaaacattacaactaatgctttattatgaagttctcgaagatcatcattcattcagaagcccccatctctggttgaactttaccccatttaggatgaagaagagagatctttgtttgcagcaaatctaaaatttacgtaatccgcctaaaggaactgtctttacatacaccacctcccaccccaaaaatagaagaaaaaacagagcaatttgccatccttgcgattatctcaggttcttccatctgccccatgtacttcccaaatgaaagactgcctgaaaacagcatgttagatttctggatttaccagcttgcccaactacaaatcctatttcaaaaaactcaaaaaataaggtctttgttctacagtaatgaccattaatagtcataagaatgtgcttgtaaaaatatacagacctctgttgaaagtctgttagaaactgtgttctccaaagcagatgagcaatacagctgcaaggtacttagaactggcaaagactgtgaaactgttaaagtagaaagtctcagaggtccaacagcgatgcgggatgtttgcttcaagtactttaccacatttctgaaacaaaatatttactgtcaattaataaaaattacaattcataaccactcaaagaataaagcaattgataagatgctgtcaaactgacatccaaagttagggggcagtaagaggagcagcctgctctataataaaatgatattagcaagtcaagacatttgcttttggggatttttacattttatttcatttcaacctcagtttttgttggcaaacagcattcatatatcatatgacttctacaactaaaatgaagctattagcactagtatttagtaatctagtaactctccttccagccctcttcaccccatgtatgtttatcacatgatatacacaatgtacatttacctccgtaagagtaaacttactcagttacagactgccacttctgatcttgttctatcgggtttaaagcagttgccaaacaaacagaacttcttaacaattgaacttcaatggatttctgaggttcccttggatctggacttaacatgttacgaagcagttttttcatgtctacagaagttaaatgaaatgtcattaagttaatgtgcttttattataaattttgatttatgtttggcattattaaaaactaatcaccaatgaacagctcctttaatatttaaggcagttaaacactataagcattactgagagctatataaaaatcatacttcatacaaaattactgtacctcagacccctaaaaagcagttgccttcaaaggctcaaaaatcagtaagtcgaggccaggcgtggtggctcacgcctgtaatcccagcactttgggaggccaaggtgggtggatcacaaagtcaggagttcaagaccagcctggccaagatgatgaaaccccgtctctactaaaaatactaaaaattagctgggcacggtgacagacacctgtaatcccagctactcaggaggctgaggcaggagaatcgcttgaactcagagggcggaggttgcagtgagccgaaatcgcgccactgcactccagcctgggcaacagagtgagactgtctcaacaaaaaagaaagtcggtaagtcaatctactatttaaggggacaaatctagacctgcattagcaaatcttgctcaatccagaatactcattaaactttttaataacattttataaagtgttccatttgtgacaaagaacttaattaatgagccacatcgatgaaaatcaagaaaaatatttagctgaaacactactttgtcctttatcaaacaaaatggctagataaatctcaaagtattaaagtggccattttttttatttgacttaattttaagtgcttttcatttcccaaatcaaacataaatagggcagccctaaatttgttgcttcacatgggattctgcccccccaaaaatgtaaaataacttccagattttccagtaaaatatactaagccaaacattttgagcaacttgtccactaaaataactttaaaactattttctcaaatacctacctattttttcttttgatcctccagcaagtagactgatattttctcctggtaacaattctaattgctcggtacattcaacaaattttccagactcaaagctgcttaatgatctgtaattaaaatattggttagcttgtattcctacgcagcctgtggaaccattaaaaaaaaacaaacaaacaaaaacagaacaaatcctaggaagacagcaaagtacacagcatttttctgacaaaattccttccacgaggatgccattattttggtttttatgttgaagatgtgactaccacttaattagtactcaaattggagtggcaaaccagaaagtcacagctacagactttcagtggagctgactcgcctgtgtctccttcctgttttcatgtgttgcagcctgttctcttcagagcctaacacactgacagtagacctctgcaggacaactttgacacccagttctctccaagctgccagtgagctccctgtgcagcctcactcctcacctacagcatgagcccttgcagctctcccagcatcacaatcttgtatctcagtcctggcttctttcactgctggcgtccctccgtctctccctttttcacctacttttcttttttcaaagaattcttctctttcatctgcttatatgaaaaataatgacacctctgaaattctttcctgtagtcctgcagcatcaatgccaggaagacagacctcatcctcccagcttctatgctgctcctttcagatcccttaccctgtccccattttcatgacacgggctctccagccaggaagaagacactgtttctcactctctctcttttccatctttgcctgtccctctcgctgtgtaacttcccttataactcagcctgaggccagtgctagaaaggcacatcacctgacttattctgtgcctgattctacctagatcagtgcaaccactggcttctcagggggacccttgagtactgggcactgatgaactgctgccaacacattcatcatttctgccattaaaaggtcctaagtcctctccagtggcaggttcctcaagtccccactatgctctataatgccctatgctttcagctaatgactcagtcctcagaaaaacaaacaaacaaaaaaaaacaggctttaatttcctctacccctacccccgatccaccatacactgctgaaattctgtctataccaactttgactgctttccttggggcagagaaaaggtgagggccagttaatctatcaatgttctttctcctgttccttcaacctctgctttctagtggctccttccccttggccaaaagaacataatctctccaacatttaaaataaacatctcatatttccctccagcaacagcttcctatcctcgacttcaagaaaaactcactgaccaaataacttacctcaagcttttcattttcaaatgtctctaccactcaatagtattcaatttagcttcttctgtctctctacaaaactctttttccttataatccctagagcatctgacaaggctgactactctcatctggatgtcctaatctaggacacttcccttctcaatgtccctgtatttttttgaatggcttcctcttctatcctttcacaaaaatgctaaactaggattctgacccaggccttccttcctcttcactcaatattctccagaggcttctctctggtttggttgcttacaaaggctctagagtatagacactgaaaaggaaagagggtcttttctgtgtactaatgatctgcaaatctctcaagcttagactttctccttagttcaaaatccaattcttaacagcttacccaacaatctcgtctgcacatttcattagaaatcttaaaacatggcttgttctctgtgtgctcctactccagttaatagcattgtttctcttccctctaccattgcccccacaaattaatggtctccatgcttccatacttgccccccacctccagtctcttcaccatagcagaatgaaccaccaagtcagatcacaacacatctctgttcaaatcccacctgaaattttcagtcttactagaataacagccaaagttcttttctcagttcccagctacttctctgcccttatatcctactgtttaaggcgctcctaaacacacaggcctcccagctatttccagaacactccaagcccatcattctcacatcaggtctaggcccaaagggcatcctgatgggcatgccttgaccttgtgtcttccctccaaagaaggtcagctttacctaactgctttccttatggcacagaaaaggtgagtgaggtccaattaatccttctatcaataatctttatctaatctttgctttaaaaggttggaatttgtgtctgttttatgtgctgcctgggtcatagcacatgctcagtgaagcaattacacattaacccatttagcagtagaagtatcagacaaagtctaatgacctttatcttcccagccaagtgtctgcaacagagtgagtgctcagttttgaattacagaattaataaaagcacagaggaatgagaagaaagtttaatttacagatgttcacaaactctgtcctcattagaataaatgtttttgatatattcagacctcatttagaaacaaagccatcaaatgtgattctttctaaagcagtacaaatttttctttatattcactctggcataatcttcaaactgtattaaggttttagaacaacaggttctgaaaattaataccaaatgactatctcagcagtgttttcccattatacaaataccttccctcatctctgatgtcagtttcctgttgtcattttcataatggcagtaagttagaaatataaccattttgtattactacatatgaccaattttaatatttttttgccataggaaaaacatcgtagttattggaaatttgttttataactggaaacagaaagccttactttatatagttgaagtcagctttcaggttgagggaagtgctactggtactctttttcaagtcatggatagcgttctgccattcctgcacagcagcccaatcggcaattgagatgtagcactcacatgctttatttcctaaataatttataacctcaggggaagagtcagtcggtttggacagcacagtttttctggattcacctgaaagtattttataaaataagaagagagagattcagatcaattagaaatatttcaaagagcacagaaacctaaaaacatgataagatcatcagtacgaaatatattactataacttttgctttatttaaaaatactgaacgctcaccattcagacaatgtttcgggctggcactgttacacccagcattggctaaggtgagcaccgatttgtcaaagctggagatgcagcaatgaacacctatcatggcacacaggtgttcctggtactccacagaggccttttcaaacctgaaaagcaaattgaagcagtcttatttctttatttatctacttacttactttttttttttttttgagatgaagttttgctcttcttgcccaggctggagtgcaatggcactgtctcagctcaatgcaacctctgcctcctgggtacaagcgattctcctgcctcagcctcctgagtagctgggattacaggcgctcgccaccatgcccggctaattttcttgtatttttagtagagacggggtttcaccatgttggccaggctggtcttgaactcctgacctcaggtgatccgcctgcctcggcctcccgaagtgctgggattacaggcatgagccaccgcacctggcctttacttacttacttatttgttttttgagacagtcttactgtcacccaggctggagggcagtggcatgatcatggctcgctgcagccttgccctcccaggctcatgcaatcctccaacctcagcctcccaagtagctgggactacaggcgcccaccaccacacctggctaaaacaaggttttgctctgttggccagggtggtctcaaactcctggactcaagcgatccgctcacctcagtctccccaagtactgggatttcaggcgtgagccaccgcgcccagccccaaaggaggctgttatgttaaacacacatatctcatttcccccctcccacaaaaaatggtgcaagaataaactgagctaaaacagtgagttgactatggtggggggaggtttgatgtcttcctcacaactatgaaactaaatttaaaagtggttaaatgttttttaaaaaatgtaagaggataaaagaactagtggaaaatattgataagtaactgatgtcagtgtgtggaaaggctttgtagaaggataaaatgcaagaaaagatgcacaagtaacagcatctagatgcataatgctgaaatacaacactaaacattaaaaacaaattataaatcaagaaattggatagcatcaacaatcttagtatttaatgaaatttcacagattaacacaggaaaaattgagaggccatgaagacatgatccatgttttaaaaaatcacaaatggtcactatatggggcaacttctactattagtcattaatacatatagaaatgtaaagtacaataactattttcgctgatggtggtggcagcattcttgtttctcagtgactctcagtatccacaaaggtgaagggaagggtgtactctattattaagggtatacattgcagccatcttttctgtagagtaacttagcaatagaatatatcataagacttatggtttggcagcctttcttctagtaaatcagtttatgagaatggattccaagaaagtaatcagaaatataagcaaagatattaagtgctatggtacatttagtaaaaaaaaaatcagaaacaaccttaatgcccaacagtaagaaatattaaattatggtacactcataaatacaaatctttattaaaaataacactgtagaatacttaacatggcaatttttttttttttttttttttgagacagagttttgcttttgttgcccaggctggagggcagtggcacaacctgggctcacagcaacctccgcctcccgggttcaaccgattctcctgcctcagcctcccaagtagctgggattacaggcatgtgccaccacaccccactaatattttttgtatttttagtagagacggggtttcaccatgttaggctagtctcaaactcctgacctcaggtgatccacctgcctcggcctcccaaagtgctgggaatacagatgtaagccaccgaacccagcctacctaacatggcaaatttttttttttaaatattgagtgggaaaaacagatcataaaaccatgtgcctatgtatgctgctgttttggtgaagaatggagaaaacgacatgaaagaaaaaagaattacaaagcatatggatatggaaatatgggactacaaaaggacacacaacagaagttactacaaagatatggaagaatgagcagttcttttattttcctaaattcgcaagatttcattaaactaacataaatggacacagaatattatggtacaagctcctctatctggaggaagcaatgagtctgaatgtagagttcacaggactaatgagcaaatactctgacaataaagggtaatttgtatcagactctgagggggaaggagctcaactagggatcaagttcaaaagcatttataaaacaactgacaggtcttgtttttcagtgtgatttgccactaattcttaaataagaaaggcactcaagtattactgctaactaaagaacaaactgaagatgcctcctggtgaagtgatttatagcaagcttcaatgctgaaagcaaacaaagctgttttaagatttggctacaatgtcagtgagtaatacaaagaatttaaacataaagtaattctatcacccatttccttccctccaacctacctcccttcagcctgttgagccactgagttaatccacagaagattttttccaacaatagatgatgaccagacagcaattccctgtatagcttcaggacaatgaagttcacatagtgcttctaccaccatcataatggttacttccaattcattcccctgaaaacgcattcagaaaagttagtcacccaataccattaaaacataaatccctataaaatttacaactgatcacagtctgtgcctgcttaaagccaaatgtatttaacaattattttcacaattttcacattatttagctcagaattctttaaaatgttacatataaaatagccacaaagggtgactaacagaaccttagcagcacatggatgtttgcacccccaccccaaagttacccaaacatttaacctgtgacctctgtaggaataacacatggagtaaaaagaaagcaaaaattaaatataaataaacaggaattaaagaatgattaacttcatgtgtttgaatactgcttgacattacctgaattgctaaacattttgttatttttggattccagttatttattgtgagcccactttcaagccaggaattactcaagcatttgtcatatgttataaaaacaatttctcctggccaggtgcagtggctcatgcctgtaatcccagcactttggaaggccaaggtgggcggatcacttgtggtcaggagttcgagaccagcctggccaacatggtgaaaccctgtctctactaaaaatacaaaacttagctgggtatggtggtgggtgcctgtaatcccagggactgaggcaagaagaggcttgaacccgagaggcggagcttacagtgagccgagatcacacaactgcactccagcctgggcgacagagtgctgtgtctcaaaaaaataaataaataaataaaaaatttcccccataaacaaattttcagaattacctttaaagttctaaactttgcacataagaaatatagttttaacatgttctaagatgaatattgttttaacatgaacaaaaacatgaacattattttaacttctaacactgttttaacacgaataaaataggtaactctggcagttgttgcttttacaaaatacaggatcaaaacctttgaaaatgaatccaagctttaacttattttatccatagattaaatcataccaaaggaattaaaccatgtttttcttattaacagacttaaaatgaatttcaaacacaccactttacctgagataggctggttgttttcatctctgtaagcaagtcaaagccatgtctcactgtcactgcaggctggcctgccaacaatcctaccctcatgatggagagtcgaatccgcgttagccagtcctgacaagtttggtgattggtatagaaaaaagttctaatgacctttacgataagagaaagaaaagctcaggactggttcaatttgtaggtaaggatgtctcacctatatataaaccaaatacacaagtctattgtgatttcagctctgcacatactgccagctgtgaccattaaactgctataaaacaacactatctcatggaaaccaaccttgggaggtgaagttaatgcattagcacatccctcgtatgcattatacattaatttctccagatattccagatactgcagaagaagaacaagtctaagttggttgttaccatggccttcatcactgtctgcagttgtccactgactaacatcctgatcagggtttaatgtgtgagctgcgagacttcgaatgatacctgaaagcaaagacaacattctgaatttttaaaaatcttaaaagttcctagaataagtgtgagttttttatgaccaattcacatttatcaagtatcctctgtctacccatcatttaaaaataaaaaatcccaacatgaaagatctttcattttaggggaaaaaaatatatattttttccacacaactcccataagttttgggaaaaaaacaaacatatttccaatgcaattattcaatgaaagcttattctaacaaacatacctgaaaattattgacttcttttcaaaaaaatcatatactctcaaatctttaacaaagatttaaaaatccattatttcttaataaggctttgaaagtattcacatcacaaagcttgagcgagttaccttcaattgtctggaaggtgtcttgagctctgcccagtggggttctcagcttagaaagaacagtgaattgtgcagcttcccatatggcccactgccaaaggatagcatctgtcttcaggagattgcgtggaattgttgactggtcatgcttatccagtctctggcagctatagaacagtctttccaaccaattgtccttcctgggaaaagtagtttcatatttaaaagacaatgacaacttcattttaataatgaaaaaaaaatgcaaggggaatgggaataaggaactgtaattttccctactccaaaaaaaggcaaaacctatgaaattgagaagcattatgtcccccccctcttattttgaggtcttttatagttaacaggatgaggtacagtgtggaaggatgattagggtaaacggctcatgccggtcaggaatgaaactcattcaatgcaactaagcatctctagaatatctccacccccaccccattccccaaagtgttaatgacatcacatcagttaactgttaaccacatttcattactcaatttcaaagcccatttttgtttctacagatgctatcttcaaagtaattttcctattgatgaaaactgaaataacccatatgagaagaatgttacttgatactctgccacccccaaacatattttctcttcaaaactgcatgtaaagtcaagggaatcttaaaattatctttcctagataaaatagtcaaagaaatgccttaccctgttctatgagagttcccatacaaaataaaactaataacatcagagaaatcttgggggtggaatgtattacttggtgctttactcatgtgacttcttaatgctaaagaaatttcttgaatttctgtgtgattgttattgctgtagacagaaaacaaagttgttgttacgcaaaatattttagcttaaaaggttagcacatactgtaagtggattatttacttattaactcactggaggtaaaaatatagaaaaattgagactttcaaatggatacggagatgtgattacaactttagatcctttttttattcacttcagatgggtcatgtgccgacatcataagaggatttgagggaggcatatcaaacatgtgaacataaaaacccaatcattatgcttatgtattacaaaaggatcaagtttaggctcttaaaagctcccaaatcaacttgatcaaaaacaataaaagattactgtttagtttttcaaatatctgagctactaagaaacatattttggcactacatgagttattctatactaattattgtgagcctataaagctcattaaaaatttttaattttcttgcagacctgcaaaatttgattatttgacatcacttcaatcactgacaagcagggccataaaagatgtgtcattaatgctctaataggtgatctgtcttctcctaaagtagacaaccagtagaggctgtaaatatcacagaatgtctttgctccaaaacaactgttataccttaggataacatctaaaggaattgatttcaacagttttccaaatgcttgtcgaatacgagttccacagtgcactagttgaacacggcaaacatcaacacatctatgaaagaacgaaatagacaaagcaggtgtgttaacatttcaaagttattagggttaatgtcaaaagacatgatcttaatttcatacctctgtaaaagatcatctggcaaggaagaggacagagcaggtagactgctgcatgcctgcagacagatattcacatcttcaacgagagctattaaacattaaaagacagttactttcagctggccaaaagaaattatatcccagtttgtcataattatctgaatccattcattcattcaacaaagagtgagtgcctactctagactaggcactgttcttgtccagaatcctcattgactgtcacgtttggaaaaatgacacattcaacaaaacccacgtaatgtaactgatgggtcatcacacaaaactttttctgagagaaaatgtaaaagtatatgcaaactataaacattcacgtaagcttaaaaatgtgacaatcacttcaaaacatttttctaatactaagaatgaaaaaaaatcaagactgtgtatctgtcattaaaatgaggattacacatctgcaggtcaggaaaagagctctattgatgaccatctcccattaccaaggattgataaacaaaatagaaaaaaaaaaacagagtcttactgttggctaaaaggcctttgcaaaatttatggaaagacggaagacagaataaaggtgcatatgtttcggacttcttcattaaaacagctacttccaaagcccaagtcattaacagtttcctgaaacacaaaatatacagttgactgtacattaaaaacaataacaaaaacaaaaaaacgttaaaagcctagtcttcttacattggttttctcttggtttttcaaacatctcaaacaataaaaaataaaaataaaaaatgaaactatagaaattactgtcaaaattgttgtgtgccttttaagaaaacctcccaacgcagcatgataatagcaaagaggccgggcgtggtggcttacctgaggtcaggagttcaagaccagcctggccaacaacatggtgaaacaccatctctactaaaaatacaaaaattagctgggtgtggtggcgggcacctgtaatcacggctacttgggaggctgaggcagaagaattgcttgaacctgggaggcagaggttgcagtgagcaaaactccgtctcaaaaacaaaaaaagcatagaatattaaaaatctatatatattcttctatgaaacactgggggtgggggattgaggtttttcatgtatttcttttcagaaagaataagaaagcctagattaaataataaaaccaaattataaggtgtttgacagtaaagaagctgctctacctcacctctataatccacattttttaaaattttttgtaattcacatttcttattctcaaattataaaggcaaattaacaaagttaggaatagttaatactatataaaatctgttacctcgtgtcctggttaaggttatctttcttaagtaatattcacagaagatttaatataattgagaaatgtttctttgtggccgtagttacagtgctaatcacagctccatcaaacaaagaaggagaggaagaactgaggctactagagataaagtgatcatgcctgaaagacaaagcatagattatcttttcatctttaatcaaagaaagcaagcaagtccaaagttaaatcaacatacatctttaaaatctatccattaaaaaaataaaatgttttgtggggttcttaagaaaaatttgtgaatacagtacctggtacaatgagaatacaatgtgtagagcacagcatactgaatggcagggaagtgaacagccaggtcactgtgcacaatcatcagattcttactcagaagtgcaaagacagttggagatagcgcccacatctgatcatgtacaaaacaaagtaagtttatggcttctccaaaataagcacaagcatacagagtttatccttcaaaacaggggtatttggactttttttatttggacatttttaaattaaaattacagattggaagggatctagtacactacaccttggacaaatacttttttgtgaagtcagtaaagcctttgcgtgcaatatagcatctctatgcaatgcagcaactccttgtctatcgctacagtaagaaaacagccacaggtcaggtgttgtggctcacacctgtaatcctagcactttgggaggctaaggtgggcagatcacttgagcccaggagtttgaaaccagcctgggcaacacagcgggaccccatctctactaaaattacaaaaattagctgggcatggtggcgcacacttgtaatcccagctactcgggaggctgaggcaggagaatcgcttgaacctgggaggcagaggttgcagtgacccgagatcataccaatgcactccagcctagatgacaaagttaagactctctctctcaaaacaaaacaccagccacatacgaaacacaggaatgagagtacctgtgttccaagaaaactttcttgagtcggagtctctcgctctgttgcccaggctggagtgcaatggggcgatctcagctcactgcaacctctacctccggggttcaagcaactctccctgcctcagtctcccaagtagctgggactacaggtgcccatcaccacgccctgctaacttttgtatttttttagtagagatagggtttcaccatgttggccaggctggtcttgaactcctgagctcgggtgatttgcccgtctcggtctcccgagggattacaggcgtgaaccactgcgcccagcccaacgagaactttctttacaaaaacaggcactagtgttgcgatggttgtacacttctgtgaatatactaaaaatcagtgaattatacacttaaaataacaaacaaaaaacaggtgctgggctgtatttggcccacggaccatagtttgctgatctctggtctaaacagagccctttgtatgtgccttttgcggaagtagactgtatttcttcaattttccatatactgcaaatggcaaggtgccctgttcaataaggaaacaaaggcacaccctgccactatacaccttttccatccatcttgttcctttacactgccaagacactccattccacctgactgccccagccccacccactttctccttatttctagagtacaggacataaacatctttgaatctgcaaataatgtgaataattttcctcaaaaatcaagctttcatgtttgaagaagagtttattgtgacttcaaacataagctgtaactggtaataagcgaagcagctatggaattatacaaggcaatccaatcaaacaacatggagcacactgaagcgcaaacatcaaattttacctttttcctcctaaaaactttattccctaattacatccattactttctttctttgtttctttctttttttttttttcttttgagacagagtctggttctgtagcccaggctggagtgcggtggtgtgatctcagctcactgcaacctccacttcctgggttcaagcaattctcctacctcagcctccaaagtagctaggattacaggtgtgcaccaccacccctggctaatttttctatttttagtagaggcgaactttcaccatgttggccaggctggtctcaaactcctgaccacaagtgatcagcccgacgtggcctcccagagtgctgggtttacaggtgtcagcaaccgtgcccagcctacacctattattttctattaaaaataatgtttttcaactctgtgtggtccaataggaagaagaaatacacaaaccataaacaataaatacaaatcaagagcagggccacgtcgaattacttaaaaaaaaaaacacacgggctgggcgcggtggctcgtgcctgtaattccagcactttgggaggctgaggcgggtggatcacctgaggtcaggagtttgagaccagcctggccaacatggtgaaaccaagtctctactaaaaatacaaaaattagcccgtcgtagtggcaggtgtctgtaatctcagctactcgggaggctgaggcaggagaattgctggaacccgggaggcagaggtggcagtgagccgagattgcaccactgcactccagcccaggtgacaacagcatgactctgtctccaaaaaaaaaaaaagctttttttttcccccctcctaaaagaaagactacaggttgagtatcccttattcaaaatgcttgggaccagaagtgtttcagactctgtatatgtttggatttgagaatacttgcacatatataaaatgagatatgtgggggacgcgacccaagtctaaacacgaaattcacttatatttcatagacgccttctattcatagcctgaaggtcattttatgcaatattttaaataattttgtgcatacaacagtttggactcatcacatgaggtcgggtgtgggattttccacttggggcatcatactggtgctcaaaaagtttcaaattttggagcattttagatttaggattttcagattaggggtgctcaccagtaagtgttatgaaaatattccaaaatccggctgggcatggtggtgcccacctgtaatcccggcattttgggaggccaaggcaggtggatcacctgaggtcaggagttcacaaccagcctggctaacatggtgaaaacccatctctactaaatacaaaaaaattagccaggcgtggtggcgcatgcctgtaatccgagctacttgggaggctgaaacaggagaatcgcttgtacccgggaggcggaggttgcagcgagccaagattgcgccattgcactccagcctgggcaacaagagtaaaacactatctccaaaaaaaaaaaagtattccaaactccaaaatcaaaaacacttccagtcccaagtatttcagataaggaatattcaacctgtatgaatgttcctagggaaaaaaagacagccaaaatataagaccatgtataagaactaacttcagtagacagaaagaaaaaagtaccaggggaagaagaaagagaccgcattttaaaacaactatacaaatttgagctgtaagaaacactgacattttctataagcatgctagagcaaatgggagaaattcataagacgttttctagaaaataaaactaatataaaaaaacttatcaagatttgtcaaggaaaaagaagaaacgttaaatataatggcaagaaaacattcctaccaattttatttatccaggcatgtcttaaatatggctgtttgttacatacagtgattctgcagacatgttgacatgacagtgaaatacataaatatgtaatgagaaaaggcttaactgtggataaaacaaagtcattacaattaaagactcgagtttttggcatttccaattgtagtcagggcactgaggtcaaatttaactacaaattttgcattgtctacattgaacacatgattcttaaaagcctcatgttttatttcagaacaggcctcaggaagttgcagactgtgcaggaggttgtttagggcacaagtcatttctcccaatattaacttataggcagtctccaaaacaggaatattcttcaagctgagcattgcttgataaacagcatgggctacagcaacaacctgaaaaacaaaaaattcaaggaagtgataaatggaaaataaatcttctaaaattatatggaaaataaatcactatctgtattagtgctgatgatacaaataaatttaagattgatcaattcactgtccgtagcacttaatattttaatttttaaaaaaccaatcagaaaactgacacagatcagtatgctatttcaaatctattaagttttatcacaaataaagagtactataaatgaaaactgtcaataggaaatttccaaaatggccgtttttttttaaataatcaacatcaaaagacatatgcaaacagcaatttaagactgggtttcttaaatctaccaggaaagtctgtggtggatttgactagggggtggttgaaaagccagtcatttttgtttacaaaatatacagtacttaatttataactttataaatgtgtcaacttgttttacccttatgaaaatttaataaatttaataacagcaagagatgcatagtctgaaaagagtatctggcacatcattcatgaaagtattcagtatgattatcaagaaatataaatttaaaagaacaaatacaatcactatattctaaatcaaacatttcacatttcactcaatttcacttatatagcctggtaagcaacattaggtccaactcttcagtgactcaagttgtcaaaattcattatcagtgtattacttacctctttttctttatgataacgcaagaatagtagtttagatgatggtataaacagtttttctacaaatgatgatggcagtttcgtatttatctgttcaacaatctaaaagaataaaatttttaaaaaatgagcttctcaaattacaaaaagacatggagaaaccttaaatgcacactggtaagtgaaagaagtcaattgaaaaggctacatactatatgactccaactacatggcattctggaaaaggcaaaacgatggagacagtaaaaagatcaggggttgccatgggcttaagatggagggagggaggagtgaggagagggaacgaggaaggagtgggtagaacatcaaagatttttagggaagtgaaactatcctgtatgatactggtaataggggatacatgtcattacacatgttaaagtccatagaatacataacacaaagtaaactataaaattagttaataataatatatcaatattcactcctttgtaataaatgtaccacactaacacaatatgttaatgagggggaaactgttgggatgaagaaggtatatgggaactcattgttttctgctcaattttctgtatatctaaaaaataaagtcttttaatttagaaaaatatatctaagctatattttaaggccttaatactgtgacattaaagtgtttagacacctaaataggacacacgtattttacagttatcatgggcattttttcacattagcaaagagaggtgtaattctggcagaaatgctcagcagaatgtcatctagaatttgctttaaaataatccagctggagatgaaaggatagcaaagaggcctagatgaaaccagatgggccatttgtttctaattatagaagctgagtgttaaatatgtacaaatttattatactatgctccctatttttatgtgcttcagaatgtccataataaaagtggggggaggatatttatggttaagaaattaaaggaggccggccgggcgtggtggctcacgcctgtaatcccagcactttgggaggccaaggcaggcagatcacgaggtcaggagatcgagaccatcctggctaacatggtgaaaccccgtctctactaaaaatacaattgtgccactgcactccagcctgggcaaaagagcgagactccgtctcaaaaaaaaaaaaaaaaaaaaaaaaagaaattaaaggaggccaggcatgattgctcacacctgtaatcccagcacttcgggagggcaaggcaggaggattacttgagaccaagaatttaaggccagtctagacaatgtagtgagaccccttctctccaaaaactacaaaggttagccaggcatggtggcatgcatctgtagtcccagatagtcgggaggctgagtgggagaatcacttgagcccaggagtttgaggctgcagtgagctctgattgtaccgctgcactccagccaggggaatacagcaagatcctgtgacaaaaaaaaaaaaaaaaagaaaaaagaaaaaaagaaagaaaagaaaagaaaagaaaagcaaaaaagaaagaatctggtgcgtagagcaatgtttcctcagaaaaaacgagtaaagctacactgagactagctatcaaccactaaaaatagaggcctggcagagtggctcatgcctataatcccagtactttgggaggccaaggcaggtggattgcttgagcccaagaattcaagaccagcctgggcaacatggcaaaactccatctctacaaaataatataaaaaattagccaggtgtggtggtgcacgcctgtagtcctagctacctggggggctgaggtgggagggtcacctgaacccaagaggtcaaggctacagtgagccaaaatcatgccactgcacttcatcctgtgcaacagagtgagaccctgtctcaaaaaaaaattgcattaaaaataaaagtaaatagacactaaaatgaaagcatagattataagactgatgaatgtactctaaaaaataatataataaagcaaagcccttattttttttcttttttggagacagggccttttttgtcaccttggctgagtgcagtggcacaatcagagctcacttcaacctcaagttcctgggcttaatcgatcttcctccctcagcctcccgagtagctaggactgcaggtgcacaccactacaccaagctaatttttgactttttgtacagatggggtctcactacattgcccaagctgtgccagaattcctggatgcaagcaatccttctgctttggcctcccaaagtgctgggattacaagcatgagccaccatacccagacaaagtccttaatttcttacatatcgatttaagggcctgaataaaccaacacattaaaaaggaaaagaataattcacataccagcgtgagtaaattcaagactgagatgatataatcggtaccacaagtctggcaattctccagttggtctaatccatatgtaatgaccatgtcacaatgtatagtcatgctaggatccaagctgccgagcaaaacaccaacacactcattagcagctgtcaacacagcctcagaaaaaaacacctggtttgcagccgtcacacatctcattactctgtacagaacctgtaaatggggaaaacaagcagctttttacaaaaattcacgtgcttccacaaagcaagaaaatactttttatttaatgcaatttcaactgaaaattaactgcttgccttgccagcagtctcttaatattctagttctcagtagctgaataataatgatccctttactacaatatgtaaacatgatcttggctaaaaaatcctaaagtgctactatgacaggaaatggaacctgccatcctctatttcccatatacccaacttcgtttctcccaatgtcactaaatggctgaagctcagaatctttatcatgaaatacaccacgacagtaatggtattgacagcatgggaatagcctgcccacacatactacaagctagctcttgggcttttgggaatcaatctttcaaaactgaacatacaagtcactttaagcttattaaagtttctatctactgatggtctcttttgaaagataagcactctcatgcttaccacataatatcttcaaaaatcatattatttccaatacacacacaaacaaaatcccccacttaactataatggccaataattgtgtactaaatttctaataaaatgggggagaaaacagagcaaatgtttaaaaatatttctataatatttaacaaccaatacatacaggattttatttagtctacccatagttttcattaaaagtatccttggaggttgggcatagtgactcacatctatcatcctagcactttgagaggattagctggaaggttctcttgagtccaggagtttgagaccagccatgtcaacataacaacacctcatctctaccaaatttgtttttaaattagttgggcgtggtggctcacaccagtagtcccaccaactacttgaggctgaggtgggaggatcacttaagcctgggaggtcaaggctgcagtgagccaagatcgtgccactgcactccagcctgggcaacagagaccatgtctccaaaaaaaaaaagagtgggggagagagggcggagggggaaccattcttggccatgcatgcacagtggctcatgtctataatcccaacactttgggaggctgaggtgggaagactgcttgaggccaaaagttcaagaccagcctgggaaacactgagaccccatctctacaaaaataaaaaattagcaggaactatggtgggaggatcacttgagcccaagatacagaggctgcactgagtcgtgatggcaccaccccactttaaaaagaaaaacaaaaaaagctgggtatggtgacacccgcttgtagggctgagtgaatgggaagttcacctgggcccaagagttcaagactacagtgagctatgattgcactactacactccagcctgggtgacagagtgaggctccagctccaaaaataaataaaaaaaataaaaaccccaccattctaccattctcaaaggcctaaaagatcctcataaatcaatatacacctatcctataaattatgtcccttttattttatgtctgaattaacggctttttatttcaactctgtacagtcttcaaccaccttttagacattaaaaatgaagcaaagatattaaaccattttgaaaccatattggtttaaaataccaatatgctggtttcatttatctttaagttctgacatttctgctcaagtacacaacttactatataatcaatatcctattttatttagcaacatgttcagcaaaagtatatgctcctaaaagcgagttttatcctaacagtaaaattttcatcagttagattaatttttttatgactgtatcacacatgcttctttctccttattcaaagcagagtacaatgcctggggttcatttcttgtgtcttttccactgaaccctcattggatgtgctatatacagtgcagctaatgtttgaggctgctgaagtgtggcaatctagctacctcatttttaatttgtttatgttctttgatatcaggctatcaaagaatataaagatatacaagttttcatatgagttccatcttatgctcagagaaggttactttctgaggcttctcctatagtgtgctattcgtaatatgttgaaaaactaaaaggaaacccaataatttaaaagtaaaattataagaaatattatttcttataataataccggcgcaggagggcagcaccagaggccagtggcactcccagctcggtgagagggctgggaagccagggaataaaactgggagggtggggtggggctggtgtttggggcacctcaaactcacaacattgggaatctttgtgggtccgggaatggtaatcctgaggcctcagaacacaggtttcagattgataggcctgcaggtctccaggcagcaaccagctgagcgactaaagggcccaaggccagggctctagggatggggctcagcagaggctggggtaaggggagccagggaggagctgggcctaatgcagcaccgggtccccaggatgccgtgtctcggctggaggaggagatgcggaagctccaggccacggtgcaggagctccagaagcgcttggacaggctggaggagacagtccaggccaagtagagccccgcagggcctccagcagggtcagccattcacacccatccactcacctcccattcccagccacatggcagagaaaaaaatcataataaaatggctttattttctggtacctcccagactctgatgactggtcccctagacacgcagtttgctgaaccaaccagccctagagcttcccctccaccgcgctgaggggactgacccatggcaggggatgtgggatgccccctgacttactacatcacaggaacagggccttcgtgggtagaaaccagccatgctgatgtgggccaggaggctgctctccgtttccgagctccttctcagagctgacacagctgaactatttaaggccctagcttagaacctcaataattcccaaatttaccaaaaatctgcctttcctagtcaaccaaaacatcacgttgcacgtgactctgctggcactgttgcttgtgaggaaatgaaccaaccatcacttacagggtaggcatcttttaaactgcaggtccaaagataaaaataacgagggaggctgggcatggggactcacgtctataatcccagcactgtgggaggctgaggcggcaggatcatttgagcccaggagtttgagacctgcctgagcaacacggcgagataccgtctctacgaaaaataaaataaaaaattagccaggcatggtggtgggcacctatagttccagctactcaggaggctgaggcaggaggatcccttgagcccaggaggtcgaggctgcaatgagccattgcaccactgcactgcagcctgggtgacagagcaagacactgtctctaaaaaatataaataggccgggtgtggcagctcacgcctgtaatcccagcactttaggaggccgaggtgggtgaatcacctgaggtcagaagttcgagaccagcctggccaacatggtgaaaccccatctctactaaaaatacaaaaattagctgggcatggtggcaggcgcctgtaatctcagctactcaggaggctgaggcaagagaattgcttgaatccgggaggcaaaggttgcagtgagccgagatcatgccattgtactccagcctgggggacaggagtgagacttcgtctcaaaaaaaaaaaaaaaaaaaatatatatatatatatatttttttttttttaaatgtataaatacatcatatatattttaatatataaatatattatatatattatatattttaatatataaatatattatatataatatattttaatatataaatattatatatattatattttaatatataaatattatatatattaattatatattttaatatataatatatattatattatataataataaattatatattatattatatagtaataagttatatattatactatataataatatagtataatatataatatatattataatatattatattatattatattatatattataatataaattatatatattttatatatatgttttatatattatatattttaatatatgaaacaggggaacttcttctaaggaaaagacagaattaaggcaacaggctgatcctagtttaccagagaagaaactgaggccgggagcaggagcccagctcactgaagggcagatcccaagtcagagtccaagtctccccacttttttatttatttaattttttctgagatggagtttcattcttgttgcccaaattgagtacaatggcacaatctcggctcaccgcaacctctgccttctgggttcaagccattctcgtgcctcagactcccaagtagctgggattacaggcatgtgccaccacgtccggctaacttttgtgttttcagtagaggtggggtctcaccatgttggccagactggtctcaaactcctggcctcaagtcatctgcctgcctcagcctcccaaagtgctgggattacaggcatgagccgctgtgcctggccttatgtctccccttttgaattcagagccttcccccgtgtagtgagtgcttctgcctctctagcccttcctgtgggttctgcctgggcctgacctctgtgagagacctggcaggaacaggtctgtcaggccttgtggggagtgggtgtgggaataggttttgatacccaacttagcaggtgatcctgagatgggaggacacagggctgtttgggatgggcgtcttagccatagtaaggtttggttcatatcaagcagggaccacccatggcgtcatttccaggccccacctcttcagtatgccatagaaaactacttgggcagtagaggtgtgggaagaaaacaaaaaagaaagctgggcataagtggcacacgcctgtaatcccagcacttttggaggccgaggcgggtggatcacctgaggtcgggagttcaagaccagcctgaacaacatggagaaaccctgtctctattaaaaatacaagattagccgggcgtggtagcacatacctgtaatcccagctacttgggaggctgagacaagagaatcgcttgaacccaggaggcggaggttgtggtgagccgagatcgtgccattgcactccagcctgggcaacaagagtgaaactctgtctcaaaaacagacaaacaaacaaacaataaaaaaaccccaaaaattagctgggcatggtggcgtgtgcctgtaatcccagctactagggaggctgaggcaggagaatcgcttgaacccgggagggggaagttgtagtgagccaagatcatgctactgcactccagcctgggcaacagagccaagactctgtctcaaaacaaacaaacaaacaaacaaaaaaacgcaggaaaagagtgtgtgatggctgaaacttgcaatttctcactctcaacgagccctggccccaactaggttatttgggctccctccctaggtctcagggacctctgttcaaagtcctagcaatctgggccaggtacaatggctcacgcctaaaattccagcactttaggagaccaaggcgggcagatcacttgaggccaggagtttgagactggcctggccaacatggtgaaaccctgtctctactaaaagtacaaaaattagccgggcatggtggtgcacccctgtaatcccagctactcaggaggctgaagcacaagaatcttttgaacctgggaggcagaggttgcaatgagctgagatggcgccacggcactccagcctgggcgacagagcaagaccctgtctcaaacaacaaaaaacaaataaaacaaacaaggtcctagcaaccctactaacctgttatgaagactgatacaggggcatcacctgccccaattttctgactcaggtcagccttatattcctactctaatctcacccctatccccgtcccacacccactattcttaaaacctccatggtcctccgggggcagctgtagacacattaagcccagggctatggggccactggaaccttctccagtgggtctgaaaacatcagcattccaggagttgatgagcccctacctgggcaccactccctcttgggcctgagaaggccggggggaacctgcaaggaatatgtggaattctatatggtgcctctgatactgcggtaatgtcagggagaggtttgttcaactggtcagggccctgaaaccccgatcactttctcatctctgcatcttgaaggctagcagagaggaggaaccctgagctctctaggaggtgggtaggtggtggcagtacagactcctagatgtctaaacggagttgcagagagaaggctttctcggtagaccctggaagggacttttacggtagaactttcattttacaagcagggatagaggcctagatggggacagagacgtgtccaaggtaaaacaatggacggaggcagggcagggagaggccaggtcctagactcggcctcagcacccctcccacacacacatcgacacagaagctggtccagatttataatttaatggctgtgcagatcccagtccctcatttctgtcgctcacgtgcccactggtctggggtcagggttttctgttcaaaggcatggatgtgcgggagctcttctgctaggcacgcgttcaccagcctggggcgagagatggggttaggaaaaggccagcggtgatcgcacaccccgaggctagggtgacccaagagactggtgtccccaaggttgtagtccccaggccgtgggaacacgtacttggagagagggtctacatcgaaatactcgaagcaggggtcacgaaggcgggatcctcaaggtccctgagccacgccagggggagtgcgggagtcaggttgcaggggtagggggagtggctggggttgtggtacaggagctaggcaaggtgctcccagggccttacctgtgtctctgaagcagcggtttcccctcgaacttggccgacaccaccaggactcggaagctacaggagcaacggttgagggtcgtgtcctccacctcctaccgagcggaagaatatgaatggtgccgaacccgccccccgagctcttttccccttgtccggcggctcaactcaccacatgctccgcctccaggtcccgctgcagcttctcgcggaggtattcggcgctgagttccatggcggcagtccagctggaacggcagcccagcagggacacaaccccagctcgggcgccggccacgctaccttgctgccttacaggagccacttccgctggaaaactcacttccgcccttactaaggcgtacgtcaacgcagtacttccgccctcaagcagccgggctttccagcggtccaggcttttcgcgcttgccatgtgtcagccaatcagagcctgaggaaggtgggactcgggcggagccgatgctgaatggtacgcgctcgccgactggacagcagtctggcttccgcggtcggacttctacacccgcctccagacaggagaggggcacgtaccggcgctacggcttcctgcaggctgcctccggatagtccccgagagcttgttccgaagcaagcaccctgcagccctagcgatccagccctcccctggaccctaggtcacggcaatcaaccccctgctgtggttcccgaaccccaaggcccgatgggtcccgcgggggtcgcggcgaggccagggcgctttttcggcgtctacctgctctactgcctgaacccccggtaccggggccgcgtctacgtggggttcactgtcaacactgctcgtcgggtccagcagcacaatgggggccgcaaaaaaggcggggcctggcggaccagcgggcgagggccctggtgagagggggaggccttctgtgccgggaggaaggcgtcccagaggaggcggaccccgcggggcacaggcctgttgagaaggaccggccaggactgtgacagaggcggggcgtctgtggtggggacggggcctgtcgcaggggaggagcgtgacggggaggcggtgcccggggcatctccgcggcggaactcagggaaggagctagctggggcgggggtgatgatccaggctgggttccagcatagggctcttggtgggcacgctggggtcgggtggaatgcaggagagagaggaggtgggacaggtgggtacctgggctggaggcagggcctgaggtgggcaggtgcagagggctgcacttctcggctgaagccgggaatgaggaccccgctctcgggtgggattggaggggacccgcggctgaggcgctgggctgcgacagggacatcacggttctcctcctcagggagatggtgctcgtcgtgcacggcttcccgtcctccgtggccgcccttcgggtaaggaaggagaccgggcagcggcggccgggtgagggcttgggttccgcccctcgctccgagccgccctgatgcccctgtacgccgcccgcagtttgagtgggcttggcagcacccgcacgcctcgcgccgcctggcgcacgtggggcctcgcctgcgaggagagacagccttcgctttccacctgcgcgtgctggcgcacatgctgcgcgcaccgccctgggctcgcctcccgctcacgctgcgctgggtgcgcccagacctccgccaggacctctgcctcccgccgccgccgcacgtgcctctggccttcgggcctccaccgccccaggccccggccccaaggcgccgcgcaggtccctttgatgacgcggagcctgagccagaccagggggatccaggggcctgctgctccctgtgcgcccagaccatccaggtgaggtccccccgaggaatggatggctctagagtccagacgacttcggatccagctctttcttgagggaaacccactgacacgctttggccaccctatccccatctctaagatgctgatgctataggacttacggccattcctgagcaaagcaggccctgctcagggccttcaccatttccccttcaaagaaaaggttcttccctaggccatcagtactccgctgcactccagtgtggtcgacagagcatgaccctcttttttttttttttttttttgagatggagtctagctctgtcgcccaggctagagtgcagtggcgcgatctctgctcactgcaagctccgcctcctgggttcacgccattctcctgcctcagcctcccgagtagctgggactacaggcgcccgccaccacgcctggttaattttttgtatttttagtagagacggggtttcaccgtgttagccaggatggtctcgatgtcctagcctcgtgatccgcccgcctcagcctcccaaagtgctgggattacaggcatgagccaccgcgcccggccctttttttttttttagacagagtcttgctctgttgcggaggctggagtgcagtgatctcagctcactggaagctccgcctcctgggttcaagcgattctcctatctcaacctcccaagtgtgccaccacacctgccgaatgtttgtgtttttagtagggatggggttcgccatgttgggcaggctggtctcaaactcctgacctcaagtgatctgcccgcctcggcctcccagagtgctgggattataggcgtgagccaccatgcctggacatgaccctgtctctaaaacaatgtaatgaactgcagctcattcttgtgtgcacttttctgcaccccctttcccttaacacttactattgtctggcatgctacgtgttttcttgatctcattagcctctcccaccccaactgccacactgcactatcagagggcagcacttatcactgctgtagaacaaagtcctgcactgagccgatggcccagaaattttctttttatttatttatttattttttttttgagacagagtcttactctgtcgctcaggctggagtgtagtggcgcgatctcagctcactgcaacctctgcctcctggtttcaagcaattctccttcctcagcctccagagtagctgggattacacgcgcctgccaccgcgcctggctaatttttgtatttttagtagagatggggtttcaaccatgttggccaggctggtctcaaactcctgacctcaggtgatcctgcccacctaagcctcccaaaatgctggtattacaggcatgagccaccgtgcccggcctaaatatttaataaaataatggacgatgggtgccttctactgagctcccggtaattgtgagtgagtagaggacttgccctggggacattcagtgacctgctgggtgttgctgagctgtgaggaagttcaggtctggctgcagtggtgaggctgtgactcaatcaatcactgctgatgctcccaggacctgcaccagcttagtcctaggggcaaggattttaactgtccacctcagtttcttcatttgtaagatgcaaataacagtcacccctgcctcatgggatggagctgtgtaatgcccgcaacagtgcctgctgcatagaggggttgctgccagctgcctctccctccttgtctcttacctgcctgctgcctgggtcaggatgaagaggggcccttgtgttgcccccaccctggctgcctgctaagggcccatgtgatctgcctggcagaggagtttcttcaggaagaaccagggcagcttctgcccctagagggccaatgcccttggtgagtgcagtcccctggccccagcctggtccacctctgggaagagggtgcccagttgtgcaatccaggcccaggcagctgagccctcatctcagcatccagggcggatactggagggggcttgtggcatctgactctgtatctcctacctgcccctctccttggtagctgtgagaagtcactgctttggggagacctgatctggctgtgccagatggacactgagaaagaagtagaagactcagaattagaagaggtgagtgggctttggtggcgggctccctaccccactccctgccctgggctgcctgtgaccacactgcttgcctctgcaggcacactggacagacctgctggagacctgatcctcagtgtccttaccccctcctacctcttttctgtgccacctgctgtgggtccagcaggtttttacttgagtacaataaaaagtctgagtcaagggtgccttatggtggatgctgaggggaggggcggagctagtagcccaaggtcctgccagtcacggggcttcctcaggggcacagaggaggcaggaggggcccctggccctagcacgtgaacagcttctactctgcctggaaaccccatgcctcagctttcccctacttgcctctgagctcatgcaattcttggaagcctgggagacttaccttgaaattgaatgcaaataggacaaagaccaaggaggatggggggatgccctccttccacggggccctgtggcttccaagtcttaatctcctctagtctcttgtctacggagcctccttcaaacccagggaaagaaaagcacctgccagggttgtttttcttctaggatcttctattgatgctctgtgaggtcccccaggagccatgaagctagggctggctcctagggcaatgggactacagtgtccttgtcctttcttattctttctgttctttctttctttctttttttttttttttttttttttttgagacagagtctcactctgttgcccaggctggagtgcagtggtgtgatcttggctcactgaaacctccgcctcctgggttcaagtgattctcttgcctcagcctcctgagtagctaggattacaggtgcccgccatcatgcccagctaatttttgtatttttagtagagacagggtttcaccatgttggccagcttggtctcgaactcctgacctcaggtgatcctgctgcatcgacctcccaaagtactgggattacaggcgtgagccaccacgctcagcctctttcttgttctatatgtccatgctctgctccacttctgccccttcactctgcccccacacatcactccagactggccttgtggtcagagcctggaatgcctgggctgctgggggcctgtggactgcactgggccagaacccctgccgccttcaagactggcctgtagccagcaggtaggtgacttttcccaggccggcctatcccacctttcccctccactcactcacctcccttgcctgggtcaattagagaaagcttgtcggccaggcatggtggctcatgcctgtaatctcagcactttgggaggccgaggcgggcggatcatctgagctcaggagtttgagaccagcctggccaacatggcaaaaccccgtctctactaaaaatacaaaaattaaccggatgtggtggtgtgcacctgtaatcccagctactcgggaggctgaggcagaagaatcgcttgaacccaggagggggaggttacagtgagcggagatcgtgctactgcattgcagcctgggcgagagagcgagtctccatctcatataaaaaaaagaaaaagaaagaaagaaagcttgtctgttggcctgccctgcagggtggagttcagagggaaggtcaggagcctagtgacagctcaaaaaaaaaaaaacccaaataccaatgttggccccttttgcctttcattcatgtgttttctatacactaaactcacatattgggtttgcagatcactccaagcttggctggagctgtggtggtaaggagggtaatagagaagcttccccaccctcaaccccaccccttccttcctggagttcccagccctgactttagatccctcccacactggaccttcaaaaccctcagggcagagagcagccctacactccctacaccacacccatactcagcccctgcaggcaaggagagaacaggtcaggttcccgagagctcaggtgagtgacacgttggaatggcccagggcaccttcaccctgctcagcttgtggctccaacattctagaagccgaggcctctgccatccctgccctttcccatggatattccatttcaattagacaacccagcctggccggaatccccctgcgttccttcttttcctttgtgtatttttgagacagggtgttgctccgtcacccaggctggagtgtagtgggatcctggcccactgcagcctcaaattcctaggctgaggcaatcctgccgcctcagcctcctgagtagctggggttacaagagcaagccaccacacccagctaattttgaaaaatattttttgtagaggagaggtcttgctttgttgtccaggttggtctcaaactccagggctcaagggatcctttcccgttggcctcccaaggctctgggattacaggcgggagtcaccctgcctgggcccctccttttgatgagtcatcagttttcattcccgcacgaggctctagcccctggtaccagcttagttgctcaatgggctgtgtttgttctggagcccagatggactgtggccaggcaagtggatcacagacctggccggcctgggaggtttccacatgtgaggggcatgaggggggctcaaggaggggagcatcggggagaggagcgcactgggtggaggctgggggtcccagcaggaaatggtgagacaaagggcgctggctggcagggagacagcacaggcaggccctagagcttcctcagcacagctggactctcctggagaccttcacacaccctgatatctgggccccgcgctacgagggtgctttcactggtctgcactatgccccaggccctgggattttgaacagctctgcaggtgactgaaaggtgcggccaggctggggaacgacctggtttcagccccagccccgccactgactgactttgtgagtgcgggcaagtcactcagcctccctaggcctcagtgacttccctgaaagcaaaaactctgcaaaggggcagctgggtgctggctcacacctgtaatcccagcactttgggaggctgaggtagacaaatcacttgaggccaggagttctagaccagcctggccaacatggtgaaaccccatctctactaaagaaaaaaaaaaattagctgagcatggttgtacatgcttgtaatcccagctacttgggatgccgaggcgggaggattgcttgaacccaagaggtggagtttgcagtgagctgagattgtgccacactgcactccagcttgggtgagagtgagactccatctcaaaaaaaaaaaaaaaaagagagaatcccactttcttgctgttgtgatggtggtaagggaacgggcctggctctggcccctgatgcaggaacatggagctgatccaggacacctcccgcccgccactggagtacgtgaagggggtcccgctcatcaagtactttgcagaggcactggggcccctgcagagcttccaagcccgacctgatgacctgctcatcaacacctaccccaagtctggtaagtgaggagggccacccaccctctcccaggcggcagtccccaccttggtcagcaaggtcgtgccctcagcctgctcacctcctatctccctccctctccaggcaccacctgggtgagccagatactggacatgatctaccagggcggcgacctagagaagtgtaaccgggctcccatctacgtacgggtgcccttccttgaggtcaatgatccaggggaaccctcaggtgcatggctgggtcctgggggtaagggaagtggaggaagacagggctggggcttcagctcaccagaccttccctgacccactactcagggctggagactctgaaagacacaccgcccccacggctcatcaagtcacacctgcccctggctctgctccctcagactctgttggatcagaaggtcaaggtgaggccgggctcaatggttcacacctgtcatcccagtttgagactgaggagggaggatcccttgaaggcgagagatggagaccagcctgggcaacattgctgtagagatgacatcccatctctacaaaaataaaattaacaacctggtatggtggcatagactgttcccagttacttaggaggctcagcggggaggactgtttatgcaaataggaagctgcaatgagccctgatgatcctgctgctgcactccagcctgggcaacacagcaaaaccatctctacgaaaaaaaagttcccactgactggcaaggaaagccaggaaggggggctcaggtgccctctcagccatgtacctgttcttctggaagggcctcctcgcttctgccaggctcatcacatcttttttttttttgagacagagtcttgctctgtcaccctggctggagtgcagtggcatgatctcagctcactgcaacctccgcctccccagttcaagtgattctcctgcctcagcctcctgagtagctgggattacaggcgtgtgctaccacacccggctaatttttgtattctttttagtagagacggggtttcaccatgttggtcaagtggatctcaaactcttgaccttgtgatcctcctgcctcgacctcacaaagtgctggaattacaggcgtgagccaccgcgcctggccctttttttttttgagacagtttcactcttgttgccgaggctagagcgcaatcgtgtgatctcggttcactgcaaccaccgcctcctgggttcaagcaattctcctgcttcagcctcccaaggagctgggattacaggtacctgccaccacgcccggctaattttgtatttttagtagagatggggtttcaccatgttggtcaggctggtcttgaactcctgacctcaggtgatctggccaccttggcctcccaaagtgccgggattagaggcatgagccaccacgcccagccttcatcacatcttgagagaggacactgtctgcctcttgctctgatgagggtctgatgcaaggatagtgagtctctacagtgcacacttaagaaaggcagcatgtgggtgctcacaggtcagcggaggagggggagctggtggggaccaggcatgccttgctccagatcaggatatgatggcattggtgcagattatattagtatagaatatggtctcaggaaccaggcaggactttggcttccgagcagggttcagatcccagcttggccctacctgtgcagtgagatctcaagcaagtcagcctctaagcctcaggttcctcctttgccagttcaacagatgagctggcctggggtgggctgtgtggtgatggtgctggggctgggtcctctgcccctgcaggtggtctatgttgcccgaaacccaaaggacgtggcggtctcctactaccatttccaccgtatggaaaaggcgcaccctgagcctgggacctgggacagcttcctggaaaagttcatggctggagaaggtgggcttgactggaggaaggagggtgtgaagccgaggggtggtggctataacgtacagcaaccctgtgtcggtgccccctgcccgcttctctagtgtcctacgggtcctggtaccagcacgtgcaggagtggtgggagctgagccgcacccaccctgttctctacctcttctatgaagacatgaaggaggtgagaccgactgtgatgcttccccccatgtgacacctgggggcaggcacctcacagggacccaccaaggccacccagccccgtccctgggcggctcccacagcaagcccggattccccatcctacctccctggcccaggcccccccactgcagccccacctggcagcaggctcggcacagctttcatcttctgcacctgagtcagctgcatgggtggccacggatcagatacttagtcctattgcttatcctcaccaaagggtgtgccacccagggccacagtcatggaagaagaccatcccggtcctcacccataggcgccaagccctgttcatgatgggatcacagggcagagatcaattcattttactccagagactagggccccaggggttgaggctctttggggtttctaggggaagtggccagatcccctctgaggttagagagggggacccgttttgttttgctccactgaggagccctctgctgctcagaaccccaaaagggagattcaaaagatcctggagtttgtggggcgctccctgccagaggagaccatggacttcatggttcagcacacgtcgttcaaggagatgaagaagaaccctatgaccaactacaccaccgtcccccaggagctcatggaccacagcatctcccccttcatgaggaaaggtgggtgctggccagcacgggggtttggggcgggtgggagcagcagctgcagcctccccataggcacttggggcctcccctgggatgagactccagctttgctccctgccttcctcccccaggcatggctggggactggaagaccaccttcaccgtggcgcagaatgagcgcttcgatgcggactatgcggagaagatggcaggctgcagcctcagcttccgctctgagctgtgagaggggctcctggagtcactgcagagggagtgtgcgaatctaccctgaccaatgggctcaagaataaagtatgatttttgagtcaggcacagtggctcatgtctgcaatcccagcgatttgggaggttgagctggtaggatcacaataggccacgaatttgagaccagcctggtaaaatagtgagacctcatctctacaaagatgtaaaaaaattagccacatgtgctggcacttacctgtagtcccagctacttgggaagcagaggctggaggatcatttcagcccaggaggttgtggatacagtgagttatgacatgcccattcactacagcctggatgacaagcaagaccctccctccaaagaaaataaagctcaaaataaaatatgatttgtgttcatgtagagcctgtattggaaaggaagagaaactctgagctgaaagagtgaatgcccggtggggccacatatggtcacctctcccccagccttcagctccccaggtcaccatatctggggaggggagaagggtttggagaagtaaaacccaggagatgtgtggaggggggatgtctgtttaatcccagcacatcctctgctgtcctgccccaagatggtggaggacgtcgagtccgccgggcagcgtcactttttcttgggctccttagaagctaccaggtacctctgggccacactgagatgaggggagtagccgtctgcataggaggtgtcttcaaacaggatagaatagtcctcctggggctgtggggcaggtggacaggaagggcagagagcagccccggggctggtgtcactcacttgttggtggcatggctgtaactgaccacctcggccaggatccactgctcatccccatccacggccttcacccgggcagccaccttgtctccaggtctggccacgtagtctcctgaggcagggatggccccacagaggggtgggggcctgtgagtggaacaaaggatcagtcccagcccctgggcaccagccccttcctcgcagctgctgccctcacttgtcaccaggcttcccaatccacaggggcagggtcatggccgactgctgcagcagggtcatcagcacccctctgcgcatggtcttccggggtggctccaagtcattgtagagacccgcgatcttggccactgtgggaagaaagggaggcctgaggccccagggacaggggctggccctgaccccccagcatgctgaactgagctgctggaggagcacctgggagcccccagctcccgagtgagcccgagggcacagcaggactgtgacctgatctgccaggtgtcctacaggggctgctgcgctcaactacatatgggtgagacggcagcacaccaggcacccaggggaaggaaccagggagggacaaagcgggttctgaggtgctggtgaggttctcttcttgatgtcggtgctgacacagaagtgtgtttcgttagtgaaaagttcctaaaattcgaagggtcccgcgggaatcggggcgaggccgggtgcctcttcagcgtccagctgctctactgcctgaatccctggtacccgggccctgtctacgtggggctcactgtcaaccctgttcgtccagcagcacaatggtggccgcaaaaaaggcggggcttggcggaccattggccgaggtccctgttaagagggggagggtctctgtgcccggaggaaggctccctggaggaggcggaaccggggggcacaagcctgctgagagggacccactaggtctgtgacgtgcgcgggacgtcccgggcgaggcctgttggtggggggaggctgtcgcaggggaggagcctaacggggaggcggtgccctgggaatctcggcgttagaactccggagagcagctggctgaggcgagggtgatgatccaggctggggtccagcgcaggggtcttggggggcacgctggggtcgggtggagcgcaggagggagaggaatgagaacaggtgggtacctgggctggaggcgggacctgaggtgggcaggtgcagggggcgtgccttcaggcagttgcggggccagggctcggctgaagctgggagtgaggaccccgttctccggtgggataggaggggacccgcgatgctgggctgcgctggcggtagggcgcggcggggctcacaggaacattcctgttgtcctccccatggagattgtgctcgtcgtgcacggcttcccatccgccgcggccgcccttcgggtaaagaagaagaccgggcggcggcctgtggcctggatttggggtccgacccccgcccggagccgccttgactccaaccccgccgcggttggagggggcctggcacccccgccctgggcgctcctcccggtcccgttgcgccccgacctccgtcagccgcacggcactggccactgaccgtcgggcctcctccgccccagggcgccgcgcaggtccctttgctgacgccgagcctgagcctgagccggtcccggggtccaagagggctgtgtgcaccctgcgcgtccgcgcgctccaggggaggtgcgctccaggggaggtccgccccaagcagagcggcacatcctccagacgacttcggatcctgctgttgaggagccaggaaacgccctgacactgttgcggccctgtccacatctctaagatggggatggatgatagtacttctggccattcctgagcacagcaggacctgccttttccctttgactggaaggttcttctctacatcttcagtcttgataacctgccacctccacagggaggtcttccctggctcccaatttaaaattgcagctctgagaagccgggcatggtggcatatgcctgtagtcccagctacgggggaggctgaggtgggaggatcgcttgagcccaggagttggaggctgaagtgagctatgatcactccattgcactccagcctgggggaaacagcaagaccctgtctctaaaaaaataaaatacaataaaattgcggctctttcttgtgcacttccctgcccgcccccctttcctgaacccttattattttctgccatactacaaattttatgcatctcattaaaccccttccgaacctgtgtactaaactgcctgggggcagctctcatcactgctgtagaacaaagtcccacatagagccaatggccaagaaacagttaataaaataacagacgatggtcctggcctctactgtgagtgagtaaagggcttgccctgcagagattcagtgatctggcgggggttgctgagctatgaggaagttcagatctggctgcaggggtgaggctgtgactcagtcaatcactgcccatgctcacaggacactggccagcttagtccctgggggcaaggattttacccccccccccccacctccatttcctcatctctaagatgtgaataatcgtcgcccctgcctcacaggattgagctgtgtaacccccctcccaccttttttctatgccatccactgcgggtctggggctttttactggaatgcaatacaaagtctgagtcaagggtgccttctgttggttgctgagggcggaggcagagctagttgcctgtggtcctgccagtcaaggggcttccagaggagggaggaggggcctgtggccctagcatgtgagcagcttctcctctgcctggaagccggacgcctcagcttctcccacactcccacctgcccgcttgcctctgaattcacacaattcttggaaggcttgggagactcacctttactcaaatggttacctgtctcgtgtctcgtgcccagcttgaccttttttttttttttttttttttttttgagttggagtcttgctgcgtcacccaggctagagtgcagtggcgtgatctcagctcactgcaatctccgcctcccgggttcaagcaattctcctgcctcagcctccccagtagctgggattacaggtgcccaccaccgtgcctggctaattttcgtatttttagtagagacagggtttcaccatgttggccaagctggtcttgaactcctgacctcgtgatctgcccaccttggcctcccaaagtgctgggattacaggcgtgagccaccatgcctggccccagcttgaccttgaactttaaatagtgaagacaaagaatgaggagggtggggggatgccctccttccacagggccctgtggcttccaagcctcaacctcctctggtctcttgtctgtggagcctccttcaaacccagggaaacaaaagcacctgccacgggctgctgtttttctaggatcttctagcgaagctctgtaacttcccctgagagccatgaaactgggctggctcccagggtgatgggactccagcgtctttgttctttcttgttctatgcatccatgctctgctccaccgctgccccttcaactctgcccacacatattactccagactggccctgtggtcagagcctggaatgcctgggctgctgggggcttgcatgcaggctgcactggactagaagcattggcgccttcaagactgccctgggaaacatgacctgccctgtttctgtctagtgagtacccatttttccccactcaccggctcacttcccttggctgggtcaattagaaaaagctcttctgttggcctgccctgcagggtggagttcagagggcagctcaagagcccggtgacagctcaaaaaataaaaaaagccgccaggagcagtggctaatgcctgtaatcccagcactttgggaggccgaggcaggcggatcacctgaggtcaggtgttcaagaccagcctgaccaacatggtgaaaccccgcctctactaaaaatacaaaaattagccgggtgtggtggcggatgcctgtaatcccagctactcaagaggctgaggcaggagaattgcttgaacccaggaggtggaggttacagtgagccgagatcctgccactgtactccagcctgggcgacagatcacgactccatctcaaaataaataaataaataaattatacattgggctcttttgccttttattcttgtgctttctaatcacaactaaacactaaactcacatcttggctttgcagatcactctaagcttggctgcagctgtggtgctgaggaggctaatagagaagctccctcgctctcaaccccaccccttccttccgggagcaaacccaagtctggtcccgactccggatccctcccacattagacctaccacaccctcagggcagacaacagctccacacaccccacactcagccaccagggcaagggagcaaaattccagaaagctcaggtgagtaccagagtggaatggcccagggcgccctcaccctgctcagcttttggagccaacattccagcagccaaggcctctgccatactggctgtttccccacggatatccagtttcactaggggaactccagcctggcttcccttctttcttttttatttttgtttttttgagacaaggcttggctctgacacccaggctggagtgcagtggccaaattgtagctcactgcagcctcaaaatcatgggctcacatgataatcacgcctcagcttccctggtagctgggtgtacaggagagagccaccatgcccagctaattttttaaacttatttttaatttattttttatttttttgagacggagttttgctcgtgttgcccaggctggagtgcaatggcatgatacagctcactgcaacctccgcctcctgggttcaagcgactctcctgccttagtctcccaaggagctgggattagaggcatgcgctatcacaccctgctaattttgtatttttcatagagaaggggtttctccatgttggtcaggctggtcttgaactcccgacctcaggtgatccgccccaccttggcctcccaaaatgctgcgattacaggtgtgagccaccacacctggctgcccagctcagttttaaatattttttttctagagatggggtcttgctgtattgcccaggttggtctcaaagtccaaggctcaagtgattcttccccactgggcctccaaagctctgggattacaggcatgagccatggtgtcccctcctcattctgcggaatcatcagagttttgttcattcccacaccaggctctggcccccagtaccagctcagttgctcaatggaccatgcttgtcctggagcccagatggactgtggctgggcaggtggatcacaggcctggccggcctgggaggtttccacatgtgaggggcctgaggggctcaaggaggggagcatcggggagaggagcccactgggtggaggctgggggtcacagcagaaaatggtgagacaaagggtgctggctggcagggagacagcacaggcaggccctagagcttcctctgtgggcggcaagccacccaggcaccgaggcaagagacagaggacacgatctgttccagtataataaaatataaaacaagaatagttataccagatatagatcttagatatgattatatatgaatatcattaatcattagtttgtagcaattactttttcttccaatattataataatccttgctctataatcatagcctaggaaaaaccaggccatacagagacaggagctgaagggacatagtgaggtgtgactgcaagacaggagtgcgagccttctgttatgcccggacagggccaccagagggctccttggtctagcggtgacgccagcgtctgggaagacgcccgttaccaggcggatcgtggtccagcggtagcaaaaggtgtcaagaaacaacacccgctactcagcagaccaggaaaggggggtctccctttccctgggggagtttagagaagactctgctcctccacctcttgtggagggcctgacattagtcaggctcgcccgcagttatccggaggcctaaccgtctccctgtgatgctgtgcttcagtggtcacactcctagtccaccttcatgttccatcctgtacacctggctctgccttctagatagcagtggtaaattagtgaaaatactaatagtccctgatatgcagaaataatggcataagctgtctttctctttgtctcctctccctctctgcctcggctgccaggcagggaagggccccctgtccggtggacacatgacccacgtgaccttacctatcattggaggtgactcacattctttaccctgccccttctgccttgtatccaataaataacagcgcagcccgacattcggggccactaccagtctctgcacattggtggtagtggtcccccgggcccagttgccttttctcttgtctctttgtcttgtgtctttatttctacactctctcattgccgcacttagggagagacccaccgaccctgtggggctggtccctacagagaatgacttgaacctgggaggcagagattgtagtgaggtgagattgcaccactgcactccagcttgggtgacagagcaagactctgtctcaaaaaaaagatgaggtgagttcagtttgggaaatgttgaatgccagatgcctttggcctattcagagggagattgccgaagcacagaggagagttcatgacagggtttaattatttttagtgctctcatgtcccagattcggccaattggagtccctccacgctggttcctgtgtcctgtgacatcacccatcttctttctccttttcttctttcataagccacttccttcctggcatgacagtgtgttccaggaccatcttgtaccttgcacctgccctgccctggccctagaatcagccaattctctgaggcatcctgattcctttttgtgggggaacggtttgagaacaaaatatactactacatgatactatattctgacaggaaaaaacacagccataagaaataaagccatggccgggcacagtggctcctgtaatcctaacactttgggaggctgaggcaggaggattgcttggggccaggagttcaagaccaacctggcccacatagtgagccctcatctctattaagaaaaaaaaaaaagaaagaaggaaagccatatttggatgagtttagtcttctgattatttttgctgaagttttaaattattattattattattttttgagacagagtctcgttctgttgcccgggttggggtgcaatggtgcagtctcagctcactgcaacctctgcctcccaggttcaagcaattctcctgcctcagcctcttgagtagctgggattacagattcctgccatcacgccctgctaatttttgtatttttgttagagatggggtttctcaatgttggtcaggctggtctcaaactcccgacttcaggtgatccggctgccttggcctcccaaagtgctgggattacaggggtatattttatatttaaagtatatttaaaaattaagggccaggctcagtgtctcacgcctgtaatcccagcactttgggaggccgaggtggctggatcccatgaactcgggaatttgaaaggcacaagagcgaaactccgtctcaaaaatatatgtaaaatatattttatggccaggcatggtggctcacaaccgtaatcccagcaccttgggaggccgaggtgggcagatcacctgaggtcaggagttcaagaccagcctggccaatatcgtgaaacgctgtctctactaaaaatacaaaaaattaactgggcgtggtcgtgtgcacctgtaatcccagctgctcagaggctgaggcaggacaatcccttgaacccgggaagtggaggttgcagtgagccgagatcgcaccattgcactccagcctgggcaacaagagcgaaactccacctcaaaaacaaaacaaaataaaacaaaacaaaacaaaacaaaatatatgtatatacacacacacattatatgtaatatctacttttaaatataaacataaatattataaagcttttattgcaattgttcattttagaaacttcagaaaatacaaattagtaaaaagaagaaaataagtctgtaataccacttttaagaactattttaaaaacctctagcttttttttgagatataatttacataccaagacttttttaaaaaaaaaaattcataatggtgacttttttatcggactgtatagaataaagcttgttaaaatgtctaagatattttgtaatatatgaaaatttcagctaaacttgtgctatagcatcccatggtttgaatatattattgaaaatcattccataaacaatggtttggtatatagttttaacaattcaaggctgggcacaatggctcacgcctgtaatcccaccactttgggaggaggaggcaggcaaatcacctgaggtcaggacttcaagaccagcctggccaacatggtgaaaccctgtctctaataaaaatacaaaaattagccgagcatggtggcaggtgcctgtgatcccagctactgaggaggctgaggcaggagaatcacttgaacctaggaggcagaggttgcagtgagccgagatcttgccactgcactccagcttaggcgacagaatgagactccatctcaaacaaaataaataaataaaataattcagcaggatgaggtggctcatgcctataaccccagcactttgggaggctgcggtgggactattgcttttgcctgggagttcaagaccagcctgggcaacatagagataccatgtctcagaaaatatatatataattaattttaaaaaagagaattcattgatgattctgtatttacaaatatattcctgcatcatttgttcatggtaaccaggaaattgcaatgcataaatacatgctgtcatttccaaagcggctctcttccagaattggtactgattctagtagacttttcattctgatgttaaaaatataattaatagaaatgtcttgtacctaatagcttttttccccacaactccccaaccccctcactctagaggccttagtagtctaatttaatcagcttagtctgaaatataatactaccttggcatcttgttggcctagtatttcttactcttttatggaatgaactgtgcaattgttttgtgtggctaaaaggtattctaggtcgagtatagtggctcacacctgtaatcccagcgctttgggatgccgaggtgggcggatcacctgaggtcgggagttcgagaccagcctggccaacatgttgaaaacccgtctctactaaaaatacaaaatttagccaggtgaggtggtgtgcatctgtcatcgcagatactcaggaggcagaggcacgacaattgcttgaacccaggaggcagaggttacggtgagctaagattgcatcactgcactccagtctgggcaacagagtgagaccctgtctcaaaaaataaaaaacaaaataaataaataaaaaataaaaggcattctaattaagttgttgcttttttttttttttttaattccagagcggactgatgtactggcccttagtacaggtgagttccgcctgctcagtaatatgaactcagggctttggtttccatgtggccctaatggactcactctccctgttccagctaaccaacttcagccttgttcctgttcaatggagaacagcttacgctggagtctgtggttttctctgggccaccttcatctgtttttcccagcagagcggtgacggcacattcaagtcagctttcaccattttatatacaaaggggaccagtgccacagaagggtccccggagaaatgagaagtcaaggactctcttaaagggaccacattttgacctaaaatgcacagaattgcctgcagacaaaatatttgatgtgccaattatgcacttcattttgaggaattactactatttatagacccacttttaaaaaaattatcaatgattattttttaattgtattcagacattttttcctgatctagtctgaaatattacttctctaatattttggttaatatgaataacagtggcaaaatggcattttagaattattaatatttctaatattttaatgcaagtttcaggaaacttggtttcttggttttgattgtttacatttctattctaaaatctcaggttatctcctgaacacttttggacagatgaagttttacaccaaaaaatagttcttagagtgaattttaatttacatagaactcaatcgaaatgaagatttaataaccagatttctttccccaaaacatacataatttgttattttgatactaaaatttagtaaatacctttttttttttttttttgagatggagtctggctctgtcacccaggctggagtgcagtggtgccatcttggctctctgcaacctctgcctcctgggttcaagcgattctcctgcctcagcctcccaagtagctaggactacagtcgcccagcaccacgcccagctaactggtggtggtagagacagggttttaccatgttggccaggctggtctccagctcctgacctcgtgatccgccctcctcagcctccgaaagtgctgggattacagcagtcagccactgcgtcctgcccccaaatttgctttgcatggagaaaactctaacaagtcctcttgaacacagttttctgataacccagatcaatgaactacccaggcttcaccactatgcgatataggcatgtgagaaactcgtacttataccccctcaatacattaaaactaaatatatatatatatatatttttaaatcaatgggccaggtgcagtggctcacgcctgtaatctcagcactttgggaggccaaggcgggtggatcacttgcggtcaggagttccagatcagcctggccagcccgcctctactaaaaatacaaaaattagccaggcgtggtggtgcatgtctcccaccacggctgggaggtgtgcccaacagctcattgagaacgggccatgatgacagtggcggttttgtggaatagaaaggggggaaaggtggggaaaagattgagaaatcggatggttgccgtgtctgtgtagaaggaagtagacatgggagacttttcattttgttctgtagtaagaaaaattcttctgccttgggatcctgttgatctgtgaccttaccctccctccactattgtcctatgaccctgccaaatccacctctgcgagaaacacccaagaatgatcaataaaaaaaaaaaagagttctggagatcagtaaaaaaaaaaaagaaacagggtttctccatgttggtcaggctggtctggaactcctgacttcaggtgatctgcccactttggcctcccaaagtgctgggattacaggcatgagccactgtgcctggccccaaatgtgttttacattttcttcctatttgattcatctttgtcctgcaacataaatatgctacttttctaccgataaaaagacaaaatggaatttaaatctggcctggacttctcaaaaaagtcagtgtgatgaaaacatgttctagataaaacagaaatgagactgggcatggtggctcatgcctggaatcccagcgccttcggaggccaaggcaggagaatcacttgaggccaggagtttgtgaacagcctgggcaacatagtgagaccccagatctactaaaaatttaaaaattagctgggcatggtggtgcatgcccatatgtctggaggctgaggcaggaggatcgcttgagcccaggatttggaggctgcagtgagctatgattgtgccactgcactccagtgtgggtgacagagtgagaccctgtctctaaaaaaaaaaaagagagacaagatgatcaggatgagcgcagtggctcacgcctataatcccagcactttgggaggccaaaccaggtggatcatatgaggtcaggagttcgagaccagcctggcctagatggtgaaaccccgtttctactaaaaatacaaaaatcagctgggtgtggtggcgcacacctgtgatcccagctactcgggaggctgaggcgggacaattgcttgaacctgggaggcagaagttgctgtgagcaagattacaccactgtgctccagcctgggcaacaggaatgagactctgtctcaaaaaaaaaaaaaggggggatgatcaaacacaatgcatcaacctcccggagccatataaaccctaaccctaacccaggaagcaggcaagcctgtgtgtgagtttccactctattgctggtaccactcggctctggcaacccggaaggccaccttcccctgttgttactgtgtaaggaggaaggagcactggtttgcaagtcagaagcctgggttgaagcctctgctcgggttcctgctggctgtgggaatgtggggttacctttcctggctggcctcgtttccttcatgtccaatgcaggggttccagtcacatgcattgggcaccattacatgtccaagctgtgccaggatctagaaaaatggctggactcaggccaaggggccttcctgtctggcagtgaaaataagaggagataccaagggccctgagtctggaggggaagtcatgagcacagggcagtgccagggcccgggagctgccacagaggagcccaccttggtgacagacacctgtaggcacatccgtgatgcccagtgcccaacacagggaactggacaaacgtttcatgcacgactcttttttcccttcttggctaccttgaggaccttgattataatagttatcctttttttctttttctttttttgagactcttgctctgtcgtccaggttggaatgcagtggcaaaatcttggctcactgcaatcttcacctctcaggttcaagtgactctccttcctcagcctccctagtagctgggattaccggtgtgcaccactaggctcagctaatttttgtatttttactacagatggggtttcaccatgttggccaggctgatcttgaactgctgacctcaggtgatctgcccacctgggcctcccaaagtcttgggattacaggtgtgagccactgagcccagccggattataatagccttttcatgcaccaggggctttatactcattatctcatttcattcatatgagttgaagtcagcttaccccccatttcacagatgaggaaaccaaggcccagagaggttaggaattcgtccaaggtcacacagctaggaagtaggattcaaacccagacagccaggctgtaacacctaggctcttctcaggctcatgcccttcccaggggtctgggaagccctgacctgcagcctgtcaccttcgtttaccccccagcctccaggatattatgtgtgcaccggcgtgggatcctggaactggcaggaattgtgggttgtgttagtccctagactcccatcgcctatatgaaatatggttccttttgtggcttgggaggccatggccagccctgcgatgccattgactggtgagtgcatgcctgggaccaggctacaaaatccctcacactctggggtagtcaaggcttatgaggaagtacccaaaactgaagctggggtttggtccagggagatcccagtgtgcagtactactttgcaggcaggcagaggcctcttggataacatggccagtgaagccagatcttggtaccagctgccccttaccctggccatgggctgaaaacgttgccttaaaaaattggccaggagcggtggctaactcctgtaatcccagcactttgggaggccgaggtgggcagatcacttgaggtcaggagttcaagaccagcctggccaatatggtgaaaccccatctctactaaaaatgcaaaaattagctgtgtgtggtggcaggcgtctgtaatctcagctactggggagactgaggcaggagaattgcttgaacccgggaggtggagtttgcagtgagttgagattgcaccgctgtattccaacctggacaacagtgccaaaccctgtctcaaaagaaaaaaataataataatataaagtggccaggtgtgttgactcatgcctgtaatcccaccactttgggtcgaggcaggaggatcactggagcccaggagtttgaaacgagcctaggcaacagagtgagaccctgtctctatattaaacacacacacacacacacacacacacacacacacacacacacacacacacacacacacacacacaaaggcagccagactatgcactaggaactgccctgggaatctctttgtgttctcacaacaatcccatttcacagatgaagaaacctaggcacagaaatattcagtaacgtgtccaggtgcggtggctcacgcctgtaatcccagtactttgggaggctgaggcaggcagatcatgaggtcaggagttcgagaccatcctggccaacatggtgaaaccccgtctctactaaaaatacaaaaattagctgtgtgtggtggcaggtgcctgtaattccagctactcaggaagctgaggcaggagaattgcttgaacccgggaggcagaggttgcaatgaaccgagatcacaccactgcactccagcctgggtgacagagcaaaactccgtctgaaaaaaaaaaaaaaaaaaaaagaaatattaagtaacttgtctgaggccacttagttaccaagacgtgggagctgggacttgaacccaggcagtctggctggattcatgcctgcagcctctgcactcctgctacttactgtgtgagaagcgcctgttctgtggaaggttgtgggctgagatctttccatgagttccactcatttacccccaaggctgttcttaaagacgggcatgacagttatgcccattttacagatggggccctgaggctcacaggggcatgccactcacccatttccacaaagctatagttagttagcagagggcagaattcggccgcctctcccctagcttgaaggctgtgattgacacagaggtttttttgttgttgctgttgtttgttcctttttcttttttttgagacagggtcttgctctgtcatcccagctggagtgcagtggtgcgatgtcagctcactgcaaactctgcctccaagatgcaaatgattctcgtgcctcagcctcccaagtagctggaattacaggtgtgcactaccacgcccagctgttttttgtagagatggggttagtagagatttgttttatagagacggggtttcaccatggtctctactaaaccctgtctctactaaaaatacaaaaattacccaggcgtggtggcacatgcctgtagtcccagctactcaagaggctgaggcaggagaatcacttgaacctgggaggtggaggttgcagtgacccaaaatcatgcactctagcctggggtctcgcttttgcccaggttagagtgcagtggcacaatcatagtggctcactgcagcctcaaactcctgggctgaagggaatcctcccacgtcagcctcccaagtagctaggactataggcatgtgccatcatggcgagttaattttttgtgtgtttttattgtcttgagacagagtcttgctctgttgctcaggctggactgcagtggcatgatcttggctcaccgcaacctccacctcctgggttcaagcaattctcctacctcagcctcccgagtagctgggattacatgtgtgtgccaccatgcctggctaattttgtatttttagtagagacagggtttcgccatgttggtcaggctgctctcgaactcctgacctcgtgatccacctgcctcggcctctcaaagtgttgggattacaggcatgagccactgagcctggcctggtgagctaatttttaaatttgttatagagacaagagtctctcttatgttgcccaggctggtctcgaccccctggcctcaagtgatcctcccacctcagcctcccaaagtgctgggattacagatgggtgtcaccgcacctggcctccgaggaggatttcattataaacctgccctgaagggagggaatccaattttacgagagggtgtagcctggtgaggcctggatgacctccggaggcaggggcttgtgcctgggctgaggcctaagggacaatgggcagacatgaagttgccccaggcagagggtacagtgtgggcaaagtcaggaagtggcagggcttggatcactccaggaagagagaggagtcatgtgtcacaggagctcgagacccagagagtgaggcaggcaggcagggaccaagcttgggcacagccaggaaggcaggacagggcatggtggggccaatggaatcattacccaagacgggcattttcagggaaacagcttagataaggccaggcgtacagtagctcccacctgtaatcccagcatttggggaggctgaggtaggaggactgcttgagcctgggagttcaagaccagcctaggcaacatagaccccatatccacaaaaaatttaaaaaaggagtttgtgttcctgtagtagcatacttgggaagttgaggtggcagtatcacttgagcccgggagttcaaggctaaagtgagctgattgagccattgcaccccagcctgagcgacagagagatatgctgtctcaaaggaaatacaaattaaaaaaccagccgggcatgctggcgtgtgcctgtagtctcagctacttgggacactgaagtgggaggatcgcttgagcccaggagttcaaggctgccgtgagctatgattgtgcctctgcagtccagcctgggcgactgcagactgcaggacttttttaaagaccctgtctcttaaaaaaaaaaaaatcttagataagaggatgctgtgcctccctgggggtcttcagtcacccatggtcctggcaagagaggagggccaggagagagcttcacccacctgctgtcctgcccgtgtgacatccgcaggtgctgccatggccacgactgttgttacactcgagctgaggaggccggctgcagccccaagacagagcgctactcctggcagtgcgtcaatcagagcgtcctgtgcgatgagtccccagcagcaccatgccacccaccccgagtatcccctgggcaccctggcatagccagatgacttccgtgcccctgttgcaataaccactgcttccaagtctctgtagaccaccccttgggtatatctaatgtaagtgatatttattttatttatattttttgagtcagagtctcactctgtcacccaggctagagtgtgctgacgtgatcttggctcactacaacctctgcctcctgggttcaagcgattctcatgcctcagcctcccaagtggctaggactacagacatgcaccatcacgcccagctaatttttgtatttttttcagtagaggtggggtttcaccaagttggccgggctggtctcaaactccccacctcaagtgctctgcccgcctcggcctcccaaagtgctgggattacaggcatgagccatggtgtctggccctaatgtgagtgatctttaacactgagcacttgaaaaagaaaaccctgaagaaacctaattattcgatgtctggacgacaaggaagaagatagaaatggcatcagataataaacagtgtaaatgtttgtttatcagaaaggggctggtggtcgggacaagtaggaggatcgcttgagtccaggagtgcatctctacaaaaaagttaaaggattttttaacattggccaggcgtggtggcacacatctgtgatcccagctacttgggaggctgaggcaggaggattgcttgaagcccaggaggttgaggctgcagtgagctgtgatcgagccactgcactccagcctgggtgacacagcaaaatccagtctcaaaaaaaataataataatattttacataaccaaccacttctaaagattaaaaaaaaacccctatgattaaaaacctcaggtccctcaggcaatcataccagatatcgaaacaaagcaataacataaggactgcagtatttattttatttttatattatttatttattctttgttagtttttggagtgtgggttttgttttgttttttgaattttttattttgttctactcggttttattcttattgctcaggcttgagtgcactggcctcttctcagctcaacctccgcctcttgggttcgggtaatgatggttccacgtcagcggccctccgcctcttgggtttgcgtgacggttccacgtcaccgaccctccgcctcttgggttcgggtgatgatggttccacgtcagcggccctccgcctcttgggtttgcgtgacggttccacatcaccgaccctccgcctcttgggttcgggtgatgatggttccacgtcagcggccctccgcctcttgggtttgcgtgacggttccacgtcaccgaccctccgcctcttgggttcgggaggtggttccatctcagccgccctctgcctcttgggtttgcgtggtttttctgcctcagcctcctgagtagctaagggaggtgtcttgagattatcatcggctgagggtggaagcggcccccgcagacgctcggcaggtgtcttgatattatcatctgctgagggtggagctgagggtggaaggggagtgagctgacgctcagaaggtgtcttgagattatcatccgctgagggtggaagcggcccccgcagacgctcggcaggtgtcttgatattatcatctgctgagggtggagctgagggtggaaggggagtgagctgacgctcggaaggtgtcttgagattatcatccgctgagggtggaagcggcccccgcagacgctcggcaggtgtcttgatattatcatctgctgagggtggagctgagggtggaaggggagtgagctgacgctcggaaggtgtcttgagattatcatccgctgagggtggaagcggcccccgcagacgctccccgcagacgctcggcaggtgtcttgatattatcatctgctgagggtggagctgagggtggaaggggagtgagctgacgctcggaaggtgtcttgagattatcatccgctgagggtggaagcggcccccgcagacgctcggcaggtgtcttgatattatcatctgctgagggtggagctgagggtggaaggggagtgagctgacgctcggaaggtgtcttgagattatcatccgctgagggtggaagcggcccccgcagacgctcggcaggtgtcttgatattatcatctgctgagggtggagctgagggtggaaggggagtgagctgacgctcggaaggtgtcttgagattatcatccgctgagggtggaagcggcccccgcagacgctcggcaggtgtcttgatattatcatctgctgagggtggagctgagggtggaaggggagtgagctgacgctcggaaggtgtcttgagattatcatcggctgatggtggaagcggaatccgcagacgctcagcaggtatcttgatattatcatctgctgagagtggagctgagggtggaaggggagtgagctgacgctcggaaggtgtcttgagattatcatccgctgagggtggaaggcaggtgtcttgatattatcatctgctgagggtggagctgagggtggaaggggagtgagctgacgctcggaaggtgtcttgagattatcatccgctgagggtggaagcggcccccgcagacgctcggcaggtgtcttgatattatcatctgctgagggtggagctgagggtggaaggggagtgagctgacgctcggaaggtgtcttgagattatcatccgctgagggtggaaggggatggagcagacactcggcacgtgtcttgagattatcatccgctgagggtggagctgagggtggagctgagggtggaaggggagtgagcagacactcgggaggtgtcttgagattatcatccgctgagggtggaaggggagtgagcagacactcgggaggtgtcttgagattatcatccgctgagggtggaaggggagtgagcagacactcaggaggtgtcttgagattatcatccgctgagggtggaaggggagtgagcacacactcgggaggtgtcttgagattatcatccgctgagggtggaaggggagtgagcacacactcgggaggtgtcttgaggctcagggagttatcagttatagaatgttgttgagttggaggaggtggctggtggcccatcctgttttttaaagtttcagctgtgaggtagggccagtagggcaatcctgaagaatgacgatgctccgctgccgccattctgacctgtagggccaaaggagggaatgttttcacacatattcatttgatggacaaaattaccgccaccaacacagtctgcaccttctgttgctggtgatagatttttgcacctttccatcctccaggtttcaaaatagcagtatcagtgtcataatatcacccttccactgagtactgccgacagctggagggtaaaggaaagtcattgggacacactgttgtctccacatgccactgtgtctgtctgcaaatgtaggcaggctggggtcctgccccagggaagacagagtcataacagagtaataaagaagcatgtttgagacacaggagtgtctatgtctatcctcattcctccctcacagccatcaccagagcatgtttcttgcaccaggtcaacagacagtaagagacagtaagagaggcatgaaaagcccactgtccacacatgttgcagcttctttttggagaatgttttccaggccttttatgttctgtctctgactctcagaactctgcaaggtcagtgtgaccaccctgctccaaatctaagaaaacagaggtttccagaggaaggagaaattgtgcccagggtcacacagcttgcaagaggcagagtggaagttgattccagctctgcctgcaggaccctctcatttcccctctgtttcccttcttgacaaaggatcttcttcactctggaggtgccacccatgagaacaaagagctctggagagatgtggattcctgaagagctgcaggggaactgggagagggttttctgacagaacaatctcacctcaagaagtcacttaggcatggctgtaatatttcttttcactcccaggtaataccaaattgtaagtgcactaggacataaagaatacttttgtccatggaaaaatgaggtgggaattctaaacaaagcaagttttaaaactgtgtttcacttcaagtgtacaagtcccatcacgtgtaatcataggactcggcagcttttgaaggtacagaggccacacaagaaccagcttagctgagcatcatttaaggccttcatttggaattgtccctgtgggtaataagttacattcactcttcactagtttacagtcagggcccatctgctattacaaatacggaacctctgacacttagaatattagatcaggggccccactgggtggggatgaaggtgtttttgcacaacacggttaccaacagggatgggactgtgatgcttgtaggcagcctttctctctgccatctccctctgcagggcttgagcacagagctgtagggagaaaaatgtatccatgtcctgacctggcagactatgtccaaaagcaaggaaaacaagcaaacttacccagttgcaaagagcctttcttgcagaaggggggatctgaaaaagccaacacatgagaaattgaatgttgagagagtctaagggccgtggcatcatctgcatcagcactgaactatcctgcaactgcagggaggaagctccttactttgcatttgtggtagtcctctgcccgccgccgcaactcttgcgcacgttgaaacattttcctatggattacaatcactttcatcagataaagcaccactttcaggatgattttaaataatctgccatgtttctgttatcctcacaactgtacccttacacaatctatctctacctagaaaacgtatttcagatggctataagagtacagtctgagccggtcacggtggctgacgcctgtaatcccagcactctgggagggcggggcagatggatcacgaggtcaggagattgagaccattgtggctaatatggtgaaaccccttctctactaaaaatacaaaaaattagccaggcgtggtggcaggcacctgtaatcccagctactcgggaggctgaggcaggggaatcacttgaacctgggaggcggaggttgcagtgagccaagatcacgtcattgcactccagcctgggtgacacagcgagactccatctcagaaaaacaaaaacaaaaaaactgtacagtctgatccaaactgttgctgtattgattcctcctcttgcttactgcctgctgacttctgagatgatagtttccttccccattctcagtacatccctaattcatccttcattgagcatcttttatcataaagctgtattctctttgtattaatatccttaccgtgtttcacagggcagaaacagctgggcttataaacaggcatagtccttttgaaggatgtggttgatcctacaacaacacactttcctaaggatgacaacaactcaccccacccctagaatggctggtatgaaccgagtttccacacagtctagctggcaatggggtcaggagacgttttgctacttcacatcttttggtcactggtaaatattaaggtactttgttttctgttttgtgaactctctctcgctctctctcacgatatgtcttctgaccgtttgtttctatttctgcatttactgggtctaaatactgtacaaaggttaaaaacaacactccaatgggcgtttcccaggagggtggggttcagtttctgaactcacttgtaggtgtgtatttctttcatatccaatttcccattttcctctgcctctgatacctgcctctccttttctgcatgctcacattctttcacgcttagtttcctcagattagaagggagagaaatgcacacacatgatccaccagcccgtgtgggattccctctgcccttctggcatctgaaggctgtgattcaaagatcccccctgcaaccttcccacaaatgaaccaactgattctcacaaccgaagggagaattgacacctcccattgagggacaaaaaaaagtcacactctggcctgctggcaagtcacctgtcatttccagctcatcttcatagttccatagttagtcctattctttagtaaatataaagactattaaaagcttctatgaggtgcactatgtgtgtctctggggtcagtcttgtgcttgacacagcgaaagctcattttagttcagtgtgaaaaaccagacctcaccaattcatcacaactaactccatcggaagcagaggattgctcctcatctgactcctcctgtgtgagacctgattctcagtcagaggctgatgccggaactgagaccatcagccatagagagatccttccagaataaccccgcagttcactactgcactttgccatgattcaggactggaactcttgtcatcgactttaaagatcctggttgagagaaaaggcaatctgaatgctgggcgcatctattgaattagaaatgatcggaatggctcctaagtcagggtgttatgtcctgaaaataggtgacaacggcaaaccatccaccctggtgttgactgactttaacaaggttcagttcacagagattgagggcagaaaaaggaaacggcctaaaaagggtaagtttgctgtgttgccctcactccacttgattcatggtcctgatcctaaggatctcacctgatacttggttttataggaaggatgtgtaaaattcccagaacgctaggaaacaggggcgaaaacacttcaaagagaaagttaatgaacttgtttctgaccacaaggcatccttcagcacatgctgtctggagtggcctcaaacaaggagtgtgtggtgtggtgctgagaatgcaatgggagcagggtcctgtccccacgctaaagaagctcacagcttaatgcaaatgagaagccagtgaggacatcactactcctgctgtgcacttgggaactagaaacacaaaacctgactctggagggaagctaaggaagcattctactcttgagttgacataagtgcatctgaagcttctgatctccgatgagaacaatgggggacaccaaacagaatataaaacccatgattgaatacatcaaattgctaacatggcagtaaacagacatgaggtgaagatggagaagaaggaaacccaggacgaaagtcagcctcgcatttggaacccatttccctgagtttcattgctgaattccagaaggaactactgagatgcaaagaagcacagcagcttttgcacacatgcgtgggattagatggaaaacaagtggattgagggtctgccaatgaaagcgacccgtactgaagtccactggctctggttgagacccagaagagtcatgcatcagaataaaggtggacaggaaataccctggcctttgtagggactgagcctgcaccgacgacttcaattgcagcctgtatggaggacccctgaccatcccccagaagtagactcccatctcttctgcagcaagataacatgctactaggcctcaattcattgctaaacattttttaacaagtatctcacatttaacaaaaaaagatcagtcatatggcagcaaaatacaatgtcatatgaccaaaacatgaaagactgtgaaaatgaatctggaggtgacccaagcattgaattcaacaatccaggctgggtgcggtggctcacactgggaggctgaggtaggcagatcacctgaggtcaggagttcaagactagcctggccaacatggtgaacccgtctctactaaaaatacaaaaattgggccgggcacggtggctcacgcctgtaatcccagcacattgggaggccgaggtgtgcggatcatgtcaggagttctagaccagcttggccaatatggtgaaaccccgcctctactaaaaatacaaaaattatccgggcatggtggcatatgcctgtagtcccagctactcaagaggctgagggataagaatcgcttgaacctgggaggtggaggttgcagtgagccaagatcatgccactgcactctagcctgggtgacagagtgagactctgtctcaaaaaaaaaaaaaaaaaaaaaaattggtcaaatgtggtggcacacacctgtaatccaagctactcgggaagctgaggcagaattgcttcaaactgggaggcagaggttgcagtgagccaagattgcaccatagcactccagcctgggcgacagagcgagactctatctcaaaattaaaaaaaaaaaaaaaaaaaaaaaaggctggctgtggtggctcacgcctctaataccagcactttgggaggctgaggcaggtggattacctgaggtcagaagttcgagaccagcctggacaacatggtgaaaccccatctctagtaaaaatacaaaaattagctgggcgtggtggtgggcacctgtaatcccagctacttgggaggctgacgcaggagaattgcttgaacccaaaaggcagtgagctgagattgtgccattgcactacagcctgggcaacaacagcaaagctccatctcaggaaaaaaaaaaaaaaaaaaaagagaaaggaaaaccaatgccagtactagcaactcctcttcctccgaaaaaatgaaaacaagaatgtaggaagggaaaggaattatacagcttaaactaatgaagcagaaaggacaaactcaattttgaacccactgaatttgccacaaatattgtagaaaatattctcaaggactttacagttgtctactttgattggcacatggttcatacaacagtatttgtgtcaaggcacatcttactgttttctggcggtcttcctctttccattgattttgtcatgatggttgattttcgttgtcaccttcctcttacggattttagctctaacttttgtttccacatgtctccgtagagtaatgacgtctttcaggccaattttatttcctcgaaaggaagaaactcttttctttgtgtgcatacaaatggacctcagcccttggtgagagtgaggagaggagaaggtgagaaacctgagggcaagaagctgttctttccctttccagggcaaactcatttccacactatgcggattccaacagagccataccttcctgtctacggcggttggacctccaggctctctgctgtacatccgtggatccatcatgtccatttcgagaccagaagatagtcttcaggagagacacctaggaaataataatataagaatgacggctgggcacggtggctcatgcgtataatcccagtacttcgggaggccgaggcaggtggatcacggggtcaggagttcaagaccagcctggccaagatggtgaaaccccgtctctactaaaaatacaaaaattagccgggcatggcagcgggcgcctgtaatccaagctactcgggaggctgaggcagagaaccgtttgaagctgggaggcggaggttgcactgagccgagatcacaccactgcactccagcctgagcgacagaatgagactctgtcacatacacacacacacacacaagaatgacatgaggctggcacggtggctcactcctgtaatcccagcactttgggaggccgaggcaggcggatcacctgaggtcgggagtttgagaccagcctcaccaacatggagaaacgctgtctctgctaaaaatacaaaattagccaggcatggtggtgcatgcctgtaatcccagctagtcgggaggctgaggcaggagaatcacttgaacccagcaggaaaagcttgtggtgagctgagattgtgccattgcactccaacctgggcaacaaaattgaaactcttgtctcaaaaaaaaaaaaaaaaaaaaaggccagatgcggtagctcacgcctgtaatcccagcactttgggaggccgaggcgggtgaatcacaaggtcaagagatggagaccatcctgggcaacatggtgaaaccccgtctctactaaaaatacaaaaattagctgagcatggtgatgcacgcctgtagtcccagctactcgggaggctgaggcaggagaactgcttgaacccaggaggcagaggttgcagtgagccaagatcccaccactgcactccagcctggtgacagagtgagactccgtctcaaaaaaaaaaaaaaaaaaaatgacatgaatatacttcacacaactgaactgtacacttcaacacggttagatggtaattatcatcttataagtattttaccacaggttaacatgtttcacaacttgaaaaggaagtaattaccttcagctctctgagttctagaatttgtaacatttcatcccctgctccttcctgatctgcactggagcatcttccttctgtccctgctctactcagagttcactttcccttccctcacatcagcttcattgaggctggtttgaacttaacgcaaaacattctcactaatgactgaattcccaccaagatttccatattatcacagtatgcttttaatcttctaagatattaaatatttcttctcatcatagctaaaatgcaatgcaaatcccatctcagatgtgggtcagatacctatgaatctcctgaggtggtcattgaaatgactttttcttgagacagagtgtcactctcaaccatgctgaagtgcagtggcgctaccttggctcacggcaacctccacctcccagattcaagcgattcttgtgcctcagcctcccaagtagctgggattacaggtgcctgctaccatgcctggctaatttttgtctttttagtagagatggggtttcaccatgttggcccatctggtcttgaactcctgacctcaaatgatccatctgcttcagcctcccaaagtgctgggattacaggcatgagccaccacacctggcctgaaataatatctttcaaattctttgtagaatttgttttttcctgatttctgcacataggataaaaaaaaaatcatgtactaggatttcgagagaagcaatgggtaatctaaaaagatgaaaagagcaaccacgtcaatcccacagctactgctagatttcataggaaaggtagctggcccagtttggagctaggggaaatgtcaaacacatgaagaaatgagaagccaagaaatgccatcacgcatgaatgcttcatggcacccatgatgtccctgcttaggaggtaatggtatagatgactagatgacaaggacaaagatgagaggtgcgaagttgtccaagtccaacagctcaactgaactttcctaagtggaattgttaaaaagtggtaaatttaaaaacttcccctggctcacgtggtggctcacgcttgtaatcccagcactttgggaggctgaggcgggtggatcatttgaggtcgggttttgagactagcctggccaacatggtaaaaccccgactctactaaaaatacaaaaattagctgggcatggtggtgggcacctgtaatcccagctacttgagaggctgaggcaggggaatcacttgaagccaggaggtggaggttgcagtgagccgaggtcacaccattatactccagcctgggcaacagaaggagactcgtcttcggggtgagaaaagaaaaaaaaaaaagaaaaaagcttcctccaatttataccgaaaattctctgttcaggactaagtggcatagagaatgttaaatgtgcctagatatcttcataactcatatattttctgttttctacatatcttgaaaggcagtgccaaatgacgtgtaattatctaggtggtaaaactgaaacatacttcctcttcccttgaatataaaaaagcattgtggtattagtacttttatcttggatcattgttcagaaggaggttcagcccccagacaaccacatttttactgtcatgaatggcaagacaaaatgtagagctcaacttacccaaaggaaaaaaggctcaaaagacaaattatggcacaacttagcagccaaattcttaccaagtacagacttttgacatactgatctctctccagttccaagtcggaacatgcactttgaatgatgtcattcaaaattaccctgcccagacacacttttcattgattctcttggagggcagttctaagagtctctggggctttctctgcatcatgagacgcagtgcagttctgcccttcaccttccggcagtttgtcacctcgtccctatgacctcacaggaactttgtctcaggccaattgtttgttccttggcctctttcatttcccctaaaaatcatttgctgcccctctaaatggcctacatctccatctatctccctctcccctcagaagagggtgctctttaagcatcagccatccggcccttctagcagtctcatttttcagctggttcccatgtttatgcctgttctatgtttttcttttcctgttaagctgtctgttgtcagctcatttctgcagtgaatcttcagagaagagattggaagctttccttccacccatacgatagaactacaaagcagaagagtttagaaagaatttcctatttaagtgacgaaacctcatactccatttgtgataaatagcacaaaggttaaaaaaacttatttttgaccaaaagctctgttgacattctattaaacaaacaccgacctatttaattttcataatgcaaatggcagatgttttcataattcttatactaataaatcatttccctgattttttgggtaaaaccacatattcataatgaagtccagaaatgtgaattgttttatataatttattcttatttgtgattacaagtatacctctacagaaagttagtatactcacccaaaggtaaactatccagagggtaatgacaactttataacttgtcggaaacgcaataatgacatgtaaccaaggacttccaccaaagtcagtcccacgatgatgatggtcagccagagtattgataacctggaataataatagttgaaataatgaaaaggtcaatgacactgacaatatttcactcagaaagaatcatccttagaaaccgtcaacctcctccaaaaggtaaccacatccctcagatatcaccgtgggattccactgctacaaaaaagaacagaagttagaagtcacatgtttttcagatggctggtagtgttttcaggcattgcaaatgtggggtgttgtctttcttggtataaagcagggatatccaatcttttgacttccctgcctatattaaaagaagcaaagttgtcttgagccacacataacatacactaacactaacaatagctgatgatctaaaaaaaacctcttttttttttttgagacagagttccgctccactcagtcgcccaggctggagtgcagtggtgcaatctcggctcactgcaacctccagctcctgggctcaagccattctcctgcctcagcctcccgagtagctgagattacaggtctctgccaccatgcccgactcatttttgtatttttagtagagatgaggtttcaccatgttggccagtctggccttgaactcctgacaggcgatctgcctgcctcggcctcccaaagtgctgggattacaggtgtgagccaccgtgcccagccatttttttgtttttgtttttgtttgttatttttgagatggggtctcactctgtcacccaggctggagtgcagtggtgtgctcccggctcactgcaacctctgcctctcaggttcaagtgattctcctgcctcagcctcctgagtagctgggagtacaggtgcctgacagtgcactcagcaaatttttgtagtttttgtggagatggggttttgccatgttggtcagggtggtctcgaactcctgacctcaggtaatctgcccgcctcagcctcccaaagtgctgggattacacgcatgagccactgtacctggccaaaatctcctaatgttttaagaaagtttacaaatttgtgttgaactgcattcaaaactgtcctgggccacatgcagcccgtcactcatgggtaagacaagctaagtataaagtaattatcttatcttttcttttctttttgttttgagacaaagttttgctctgtcacccaggctagattgcagtggcatgatctcaactcactgcaacctccgcctcccgggttcaagcgattctcctgcctcagctactgagtaactgggattacaggcgcctgccaccacgctcggctaatttttgtatttttagtagaaacagggtttcaccatcttggccaggctggtctccaactcctgacctcatgatccacctgccttggcctcccaaagtgctgggaatacaggtgtgagccactgcacctggccagtagttatcttttctttaaagttatttacttgttttttaaattgatgtataacattggatgcatttattatatatcacatggtaaaagaatccctctaaataatacttctctcttggattatatgaatctttgtcatttaaatctcagcataagtaaaaaaaaaaaaaaaatacaatgaagagattacttcattcacaaataagtatcaaattttagtgcttaaaaattaacaaggtgggctgggcgtggtggctcacgcctgcaatcccagcactttgggaagccgaggtgggtggaccacgagatcaggagattgagaccatcctagctaacacggtgaaacccgtctctactaaaaatacaaaaaattagcagggcatggtggcacgtgcctatagttccagctacttgggaggctgaggcagaagaatcacttgaacccgggaggcagaggttgcagtgagccgagatcgcaccactgcacttcagcctgggtgacagagcgagactctgtctcaaaaaaaaaaaaaaaaaaattaccaaggtggagatcatgaaaatggcatgaatagtgtgggatttctctaagattgttgatattaattccattagactcttatgtgagtgaagacgaagacttcccctgagtaagttcagacagcttctgataacatttctacgtcgattcctcaggatttaactatatattcttgaaaacatctcaattttaaatgtttctttcaagatggtgaattaaacagagatagcccttcaacaggttgaactcagcatatgctgagtctgaaatggaaatgatgaagttagagaaccatacaacaatggtaatgatttcagaaacatggtgttgagcagaacaaagcagacacaaaagagtacctatggcatggcatgcatctgtatacgcgaaattccagaataagcaagctaacctatgataagaaagagactggctgggaagactgagagttcactttctggggtgacataatagtgtagatcttggctgggcacggtggttcacgcctgtaatcccaacgctttgggaggccgaggcgggcggatcacctgaggtcgggagttcaaaaccagcctgaccaacatggagaaaccctatctctactaaaaatacaaaattagctgggagtggtgccacatgtctgtaatcccagccactcgggaggctgaggcaggagaatcgctcgaacctgggaagcagaggttgcggtgagctgatattgccccattgcactccagcctgggcaacaagggagaaactgtctcaaaataaataaataaataaataaataaataaataaataaaataatgtagatcttgaaagggggttggtttatgctggtgtatgtactttccaaagttagtaaacttacacttaaggttatatattttggccaggcgcggtggctcacgcctgtaatcccagcactgggaggctgaggcaggcagatcacgaggtcaagagatggagactatcctggcgaacatggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgaggtcccgccactgcactccagcctgggcgacagagcgagactccgtctcaaaaaaaaaaaaaaaaaaaaaaaaaaaaaaaaaaaaaaattagccaggcgtggtggtctactaaaaatacaaaaattagccaggcgttgtaatctgagctactcaggaggctgaggcaggacaattgcttgaaccccagaagcggaggttgcagtgagccgagatcttgccactgcactccagcctgggcgacagagtgagactctgtctaaaaaaaaaaaaaaaaaaaaaaaaagtcatcaaaccagatgacacaaatcaaatgacatttcactttgttttggtccattttctttgttaaaaacaagagtgcagcggggccatctcggctcactgcaacgtccagctcctgggcccaagcgatcctcccacctcagcctctccagtaactgggataacaggtacgcaccaccaggcccgactaatctttattggaattttttgtagagatggggtttcgctatgatgccctggctagtcttcaactcctggactcaagtgatctgcccacctcggccctctaaagtgctgggattacaggcctgagctgtgtaatttcatgccacgtgatacagcccagtaaaaaggaagaaaccccacgggtccagcgtctactcacagagatgcactgatggctgataaattccagtaggagcccaaagaggagccaaaagagcatccaccgcacccgcatgtcctggtcctttcagggcgccctgaggcggccaggacagaggtggaggtggcttagggcaggggggagggaaggggacgggaccggggccggatctgagttggggagggggaggggagggggaggggaaggggaggggaaggggggaagtaagggaagggaaaggaggagaagggggctgttgggcacctggaggaggtggaggaggaggaggagaagaagaaaggggtctgggaaaggatccggttcaaattaagttctcaagcgctggtggaaggtttagctacaggtcacggagaagatcagggaagcaacaggacacgcggggcaagggagcgtgaggcttaggagcaatcagagggagacaaaaaggttctgctatccaccaaaccttcttcggtctgggccctcccttaccaaccctggggctttatactccctctccaccaatccctgatgaccccggtggtgcctcacaatggacagtgcctcacaatggacaatgccaagtagcgcccgcatcattccaatgacccctcccccatctcagtctcccacactcctcccaaagacaggtcctctctggaaccttcacaaacctgatttctggtcctccccaaccagctccctgtccctgcttctgggcgctccttccttcctgagctcccagggttcctcaaggtcacttatggcgacaaaacataaaaaacaaatgatggcaggatggcaggaagaacctcatacccaagcagagtgccaggttttacagcctccgctcagccattcatatcctaagcaacaaaacatcagcagggtgcggaaggtcccgatagtaaaccatctccatcacatccatgtagccatccgtccatcaacctgtatctcaggaacaaatgtagatacattcattttaagcatgcctggtacatttacaaaaattaacctgacttattttgttccagcaaatctcaatatatttgagagcaatcaaatcacacagcatgtttctgatcatataactgtgctagaagtcaatgattaaaagctaattcaaaattattatttgcttggaaattcaaagtgcccttataagacataaacataagaaagaatccaaaatgaaacaagattgcctttcaactcaatgatgagatcataacatggcaataaaatgtctccctctggcctgggaattcctctttgtggcacaaggttgtgtgatctcaaatcaccgctaacccacctagacattttaacatccgaaaccgagtgatgacgtccttatctatatcatcttactgcctgtgtgtgtggactttaaattctgaacccaaatgagggggagaaaaccaagttgactttcatgactgagctctcagggacgtccaaggaatctgtgcatttcaagaaacaaagttcatcagcttctctcctaaggtatttgcccacaatacccagagggcttggcagcatcatgtgtgatgggtggggagctccaagcaggtgggcaggacccaggggcctggtgaccaggacagacccccactgtccatcaactttcctggccctgtcctctgctaaacttcccacaggccttctgcccgatcacacagagtatgcccaaactctctcaggcctctggcagctgaaaaccactgctttaaatccctttaccatttactatgacataaggttattgtaaacaggaaatattctattgatgctacaaatggaaagccaatgcctttaccataaatagaaaaacaaccctaagaagcaagcaaaacaaaaacaaaacgggctgggtgtggtggctcacgcctgtaatcccagcactttgggaggccgaggtgggcggatcacaaggtcaggagttccagaccagcctggccaatatggtgaaaccctgtctctaataaaatacaaaaattagccgggtgtggtggtgggcgcctgtagtcccacctacttgggaggctgaggcaggagaatagtttgaacccgggaggcagagtctgcagtgagccgagattgcaccactgcactccagcctaggcgacagagcgagactctgtctcaaaaacagcaacaactacaaacaaacaaaaaacagggttaacaaaagtatggaattcaattctttttatatgctgcagccatgttcctgccctagatttggctgggcatggtggctcacgcctgtaatcccagcactttgggaggctgaggcaggcggatcacgaggttaggagttggagaccagcctgaccaacatggtgaaaccccatctctactaaaaatacaaaaattagccaggcatggtggcacacgcctgtaatcccagctactcaggaggctgaggcaggacaatcccttggacccgggaggcggaggttgcagtgagccgagattgtaccattgcactccagcctgggtgacagaatggaatgagactctgtctcaaaaaaaaaaaaaaaaaaaaagcagccctagatttcggttgtggtggttgtaaaaggagagaccaagtaagtgggggttgaagtcagattagagcaaaagtgaatggcagagagtactataatgtccatgaagggctgctagagtcaccgtgatcatagcccaagcagagatagggaaaggaagatgtgagcagagtttggggtctcgaacaatggaggttattcgtgcagcccaggaaaggctccccaaagccaggatcaacctcccttggaggcggtccctcatggaggcatggtcaggcaccttagatttgagaacagctatgttgctgctgaccagctgtgtgaccctgggctggtttccttccacacaatgggagtgccaatggctgcatgcatgcaaagaccgtctgaggataggaggaagcaatctgttgagcacccgtgtacctgagtgtcatcacctcccaagggcatccttcgttccagagctggcgccttggaaggcccttggtcactgaaggcagtgatgatggtaacagcagtaaatcatcatttacggctgatgagggaaggccaggggtagggctcctaggtcctggataagaatgagggtctgggcactcctggggacagctgagtggtaggactcctgggtccccagggggaaggtccatcttcagtggcattgggcctaggctgggatgctgagttatccactggagcatcagcagtacaggcaggcacagaggcagtggatccatcggaggtggcaggtgtaggatcgtctggtgagcaagtagagtcaccaaatctggctgaccactacccccactacccccactatccccacagacgatgccctgtcccttgcctcatgctccggcagggtacaggctcgcacctggggcctcaaggagcatctctctaagacctctgtgtcctggtcattgaatgggcacttgagtcacccagggccattggaacaaagaggaagaatcaggccccacgatgttttgggagagtgtttagcacaggaaaatgcgcagaatacatgcacgacacgggggcactgtcagtgtgggagcaatggtttacaacctccagccctaatctgagcactctcacctgtgcaatctgaaaggaacaggagacttgcaggaaagacagtgcctggatttaacttaaaggaactaaaaatgttggaatttttactcttgatatccttccaaatcaactctctcaatgttcccatcctcaaaactatcatatggggtaactgaggcagtcagagatttactgactcaatgtcactcaattgattctgagttcactgctgattacatccgaccaaactgctttttctgaagtctactccgtttaatcatgctggtgatgattttgtgcggctctgggacaaactccacctggctgaagataaagcaaatctgcggtgacttagtcctcctgtcatttcccatcagttccccactctcctcctctgcccctccacagtctcccatgcaggctgacaccatatgacggccttaatggagtccaccgagtatttcaggttctctcctgggccacttgaaagtggatgtacccatgggatttgctttgacccaggagatgtgagtggaagtgaagcgtgtcacctcgaggcaaaagagttgggagccattgagacgggccactctctccttcatctcttagagcagctgacagctcccatatggaggctgctcctttattctcgtggcaggatgagggcatgtggggcacagggcacaggagagccatggaggatgtgcagcatgggcaggaaaagagccttcagtggtgtacatttccatagtttggggctgtttcttacctacagtgatacctagcccatcctagcaggcatgcaccatctactccacactctgtgatgcagactagcctgccgtcagaacacgaactggtggtcagacacaggtaggtttcagttccagctctgcctcttattgactgcaacctcaggcttaactttcagtctctgagcctcagtttcaactctgtaaaatgaggtggctataccatctcaggttgcagagagaattaaatgaaatataagtgcatgtagagcattgaacccagggcctggcacacacagtgagtacacaatgttagccaggtagcttcataatgcatactgattgttaatattcagacaatgcagtaaagtgttaccaaaaataaaagtaaacttatttgcatatgtattctttcaatctttatttttaaacagggtaaaactatgcatattctttcatagccagtgtttttctcttcatagtatattgttaaaataattttacttggaccgggtgcagcggctcacacctaaagtcccagcactttgggaggccgcggtgggcagatcacgaggtcaggagttgacacgagcctggccaatatggtgaaaccccatctctactaagaatacaaaaattagctgggcatggtggcacacacctgtagtcccagctactcagaggctgaggcagaggaattgcttgaacccgggagacggaggttgcagtgagccaagattgtgccattgcactccagcctgggggacagagtgaaactctgtctcaaaaaatatatgtgtgtgtgtgtgtgtgtgtgtgtgtgtgtgtgtgtgtgtgtatctatataaatctcaaaaataaaagatcatttttgagattatcattttaaaagacaagataatgttcaacttaatgactaatttaattattactattggactttttgtagactaaacagagcattcaaaacaaatgaaggagaataaaaaatatgtattacatgttgtaaaataaatgtgatgtggttaactcttttattcaaagttatagaacatatatatgtactatagaatgtatttcttattatgagtcatgttaaaaagtagtttagaagctgttgatttgaatttccttttcaaattttgcaggataatttttttttttttttgacagagtctcgctctgtcgcacagtctggagtgcaatggcgtgatctcggcccactaaaacccccacctcctgaatctaagcaattctcctgtctcagcctcctgagtagctgggactacaggctcacaccaccatgcccggctaatttttgtatttttagtagggacgaggttttgccatattggtcaggctggtctcgaagtcctggcctcaggtgatccaccagcctcagcctcccaaaatgctgggattacaggcatgagtcaccatgcccagcctaaacttggcaagataataaataacctttttaagtgtcgttgggcacttgtctggttgtttttctttaggttaccatgccagcaatgattccttttgagtttctgacagaagatagtggttttcatccaaataagtcaactactctaccccatccctaagccacttgtatggaaagaaaaagaggaagaagccagtactgtgactgcgtaagcttcccccagcatcacccgctatgagatgtgtggcagctgagacccgggaactgctcaagggcaccaggccccatctgtctgcactcactcaccttcctcaggtactcgcatgggcatgtcactgactttacatgctgctgcagctccttggtgagctggccctggtcatgggacaggaactgtggggtcaggacaatagagagcttcaccatttgcagaatgagaacaggggctcatgatgagtgccaacctattagataattttaaaaaaaaagtgttgaatgagtggaaaaacaaggtgatgtttgagtctatagtggtcaagggcttcagaaaaggacagaaccaagttcaaattcctgtactttgaatttctacttcatgccatgcaaaattactttaccccttttaacctcagttttcttctgtgtgaaacaggaacaatagtttcattcgtcattcagtttctctcaaggtttcacgagatcatacctataaaacatccaagtcatttaaatgtatcatcatttctgtcataattagtgggatccatttcactattattggatatacagttctgtgcctgaaacctacaaaaaaagaaaatgttaagtctaaaaagcattagtgatttctcatttttatattactaattataaccctatttaatcacacaaggccttgtccgtggcaggtgctcaataaacacttgtcgaatcaatgcatgtgggctccggagccacactgtttagattctattctgcctccaccacttatcagctgtgtgatctgggtaagataattcacctctttatgtctgcacttccctctccataaactatatataatgagaatccttagctcattcggttgtggtgaggggtgaatgatttggcacacaggaggggcttgttaacattagctgtgatgatctccttccaaatcttcattttcagagccacagatgaggccacagtgcaaccaggtgaccttagagtgtaagtacacgatcgccagctatgctctatctccaccataggtccaagactgggtagttctggcctggaggtttctgctacatctgccttctcagtgttcacctaaggacttttgtattttcctcctcgcatccccacagatggggttcaggctgccggacacagctgggtgatgccagggcagtggtcacctgtgccagccccgtgaggtagctggaggatcattgttccttccttctcgggctctgggcagatgccagggctggggtgacccatgccctcaagtttcttgctttggtgggccacattttcccttggcaaagagggtaaaggtcacaggatgccagagagctgtgacttctctgtgccctgggcccaaactatgaagacctgacacactatgctaaaagtccaaggctgggtgctccccagagcttcttgcctcaccgcttctgctgagggaggaatgaatactatgtcctcccagagctttgggagcttgtagcaagcagcctccccagcgcaaaatctcttggaaacctctaactgtgtctgaaacattagtgcaaatgttgcatcctatttcccatatgtccgcatgttttagaaaaaaatcctcaatttcctaaatatgcaagaaaaatcggtattgtaggacaatgtgactttttaaaaaatgttatttaaaaatcttccccacctccttttctgccctccaagactgccaaatacttgttgaacatatattattaaatgcctactacatgccagccatgattcatggtcttggggacacagcagagaacgaactgacaggattcctctcttatgtaactcacattcttatatgataatgataagggttaacattaattaagctgtcactgcatgttagtcacggtgcagtcattcccacacattattacacttaaacctgccagcaagcttgcaaggtagttgtttttcctttaaaaactgagtctcggaatgatgaagcactctgtccaatgtcacacagctagtaagtgtggagaccttgcatccaatcaatgcccgtctcattctaaaggccatgttatgtgttctccagcccatggagaataattttaacacagtcaatgaaatttctacacaacaatgttcttgtctcaagtccaagaatgcctcctacacctcctataatactggctttctggtgagtaaagatgccattctcatgtgtaatcaggtggcaaatggagatatgaccaaagtaaccatctgcctacactcataaccctgtacacactcttcctgtgtcgattcaattcaagtaccccttttgatcacttagcaaatctgacctttaaaagggttagggtttttatatccatgtaagtttctgtattgctttggaagtctctggttaaattaatactcttttaatagtgacctgtgattctgttttgatcaagtgttttcaaacttgacgtctttgatgggtttctccagtgtcaaaatcctaaatcaagtctttttggcttaaaactaactttgggatttttttcagctgcatcccttggggagtctaaagaatgtatctctcatcttgtagaggtattaagtgattcgatttatttggtagattaaatgggcaggcattgtcaaatgtggcgatactgcatgggagggcactgtcaagtgaggtgacattagatctcatctcagttatatttatgggtatgttgttgatatgcgtgttccaaaaattgcatacatttatacaaatttaatatgatttgtaattttgatagttatgctaaatatttgctaaagttatatttgtataaacatgtcacgaatggctgggcaccgtcactcatgcctgtaatcccagcactttgggagacaaaggcacgtggatcacctgaggtcgggagttccagaccagcctaatagagtgaaaccctgtctccactaaaaatacaaaaattagccatgcctggtggcacatgcctgtaatctcagctactcgggaggctgagacaggagaactgcttgaacccaggatgcggaggttgtagtgagccgagatcatgccactgcactcccgcctgggtgacaaaggtagaatctatccaaaaaaaaaaaaaaaaaagttattatttctgaagattgtatgaaattcataaaagtctgctggccctgatatgatgctgtcagtcatgattctgattactgtcttaaaatgctgcacataagtaattaaatttccttgtgaactgggaagtttcatcagacttttatcataactattgtttccatcatccacagttactgttttgaattcttctctaaaaatatttgtaattggcaatagtccaaattttcttttgttttctttcctgtttttgagacacagtctggctctgtcgcctaagctggagtgcagtggtgggatctcggctcactgcaaactctgcctcccgggttcacgccattctcctgcctcagccacccaagtagctgggactacaagtgctgccaccacatccagctaattttttgtatttttagtagagacagggtttcactgtgttagccaggatggtctcaatctcctgatctcgtgatctccgcgcctcggcctcccaaagtgctgggattacaggtgtgagccaccgtgcccagcctaatttttgcatttttagtagagaggaggtttcaccatgttggccagggtggtctcaatctcctgaccttgtaatccgcctgcctcagcctcccaaagtgctgggattacaggcgtgagccactgcaactgactttttttttttttttttttttttttttgagacagagactcactctgtcacccaggctggagtgcagtggcatgattttggctcactgcaacctccacctcctgagttcaaacaattatcctgcctcatccttcggagtacctgggattacaggtgcgtgccaccgtgcccggctcatttttgtattcttagtagagacggcatttcaccatgttggccaggctggtctcaaactcctggcctcaactgatccactctcattggccttccaaggtgctgggattataggcgtgagccaccacaactggctcagtaaatacattttttattatcaaaaaagagtagtgtatggttggcgtattctgtgtagaatgtattttattgatgtctcctatttttataatttctgagttaagtactttttaattaatgctttttagttttgggcagattcagttgactaaagcacctcatttcccagatacatgaaataaaatatttggcttcttttccaatttcacactgatgttattttgtgaaaatcagtgctttaagataaatcgttatacgttaagataaacatgagaaacttgatctaatatttaatatttattcagttctacactttattaacttctacaccagcagatttagacattatgtaaccatctcaagaagtttcacttggatgtaatgcttcacgcttgtaatcccagcactttaggaggctgaggtgggaggactgcttaaggcaaggagtctgagaccagcctgggcaatacagcaagatcccatctctattttaaagaaaagtttcactttgggaggccaaggcgggtggatcacaaggtcaggagatcgagaccatcctggctaacatagtaaaaccccatctctactaaaaatataaaaaattagctgggcgtggcggtgggcgcctgtagtcccagctactcgggaggctgaggcagaagaatggcgtgaacccgggaggcagagcttgcagtgagctgagattgcgccactgcactccagcctgggcgacagagtgacactccatctcaaaaaaaaaaaaaaaaaaagtttcggcaaattccatctaagaattccaccagagttctgttgtctccaatgtcatcttccacagatttcaagttgtgaagccctgaactgttaatttatcttgagaatgtatatttaagcttaatttaagactatatacctaaaaattgagcatataatttctataatttgtttatgtaaatttctgtaagtcataagtatgtggtttccaagtgtataatttatctgaatgtaataggcattaatatattttacattactgggaccatagtacagaaatttctaaatggtttgtaaaataacttgttatttgtgttgttgtaaaagcagttaatacaatggaaaaactcgtaataagaagatacagtttaacatcaaaaagtttacccaaggtaattatgagtactacctggcaaaacttcacggaagctgtggtatcacttttatgatggaagaatggtgtttgcattttgtgtaaaagtacttgcggctgggcgtggtggctcatgtcccagtgctttgggaggcgaaggcaggtggatcatctgagcccaggagtttgagaccagcctaggcaacgtggcaagagcctgtctctccaaaacctacaaaatttagccaagcttggtggtgtgagcctgtagtcccagctacttgggagactcacgctggaggatctctcgagcccaggaggcagaagatgaataaataaatggaagcaactgaatgggatgaggtctctcttgaaggagagagcaaaagagatttaaatagtaacaattataataaggctgggcgcggtggctcacgcttgtaatcccagaactttgggaggccaaggcaggcggatcggttgaggtcaggagttcaagaccagcatggccaacacggtgaaaccctgtctctattaaaaatacaaaattagccggacatggtagtgcgtgcctgtggtctcggctactcaggtggctgagacaggagaatcgcttgaacctggtaggcacaggttgtagtgagccgataaatataaaaagtattagagtactaacagaggaaagtttccactgatcaccttttagctttaaataatgcagaagcatttgcccagtttacttgtaattaaaaatcatgcatcattcacaatttatatcttttttgtttgtacaaaaatgaacacaagttattctcttttatctgtattgtgattggtttggtgagagggaattaggccacttgagagtttgtgtgtgtttacaattttctggccaggcacggtggctcatgcctgtaatcccagcactttgggaggccaaggcgggcggatcacttgagctcaggagttcgagaccaaattgggcaacatggtgaaaccctatctctacgaaaaatacaaaaattagctgagtgccgtggcttgcgcctgtcctcccagctacttggggggctgaggcagtaggatcgctcaagcccaggaggtggaggttgcagtgagccaagatcacgtcactgcactccaggaagggcaacagagcaagactccttctaaaaaaaaaaaaaaaaaaagaaagaaagaaaagaaaattaactttggtatttcaggttgtatttaaatggagacttaacatgaactatgttcataacacttgaccaaattaagtgtagatcgtctctttaataaagagatcatctggaactgcaatttctaactcatacatcattgctacaaaccttatttgtttactatttctcttccaaggaccatcagtcatcctttaaaattcatttcaagctctgaaaagatattttttgttacatgggcaatttacttttagtacagtaaaatgttatgtgaatttctacagtatgtttgccaaaatgaattatatctagaatacgcttaacaatatattctggaggcagctttcatttgaaattaggttcaccttctgagagtatgaaaaagttaatgggtttttgtgcctgaagattttgatgttgcatttggctacatttaatccactttcacccataagttttaacatctaaaaaaattaaatcactgctaatgcaattaaaatgcattatgaaatgcatttctgtccaggctggagtgcagtggcacaatctcggctcactgcaagctccgcctccctggttcacaccattctcctgcctcagcctccctagtagctgggactacatgtgcccgccaccacgcccggctaattttttttttttttttttttaatgaggcggagtctcgctccgttgaccaggctggagtgcaatggcatgatcctggctcactgcaacctctgcttcctgggttcaagtgattcgcctgccttgctgggatgacagacgtgcaccacaatgtccggctaattttgtatttttagtagagacatggcttcaccatactggccaggctggtcttgaacttctgacctcaggtgatcccaccttggcctcccaaagtgctgggattacaggcatgagccactgtgcccagcttaagatctctgttttaatgttaatgctggtcagttgtgtctggattccagagggaggaaggtagaatgaggcatgttgacacctccccttcccatcatggcctaagctggtcttttcagtttactttggaatgtccttgctcaacaggaagggtccattcagtcggattgggtggcttagaattttatttttggtttacatctcaactatcacagcagccgggcgcggtggcttcacagctgtaatcccagcacattgggaggctgaggcaggggtatcacctgaggtctggagttctagaccagcctgaccaacatggagaaaccccccgtctctactaaaaatacaaaattacccgggcgtggtggtacatgcctgtaatcccagctactcgggaggctgaggcaggagaatcgcttgaacctgggaggcggaggttgtggtgagctgagatcgtgccactgcactccagcctgggcaacaagagcgaaactctgtctcaaataaataaataaataaataaataaacaaactatcacagcataaagtaggaatatttcgttactgtctagttaaactggttaatgcagaaaggaagtctggaaattccagttttaaagtaaaattttggacattgtaggattgattatttggcatagttgtgatgtttgttcctgcgttatggttttgttggcagggcagcctttaaggacctgtatattttcttctagactctatatattccctgtgagtattagttgtatggtcaaactggcaaattttaccataggtataaataatagagaatgtggaagaatagtgaatagtgtcagagatagttaaaagtccatacaatagtagagaaggtaataagtaatagtggcttggactaaatatttgttgaataaatgttttaaaaaacaggctacctacaatttgtgttgaagatatgaatgaatgaagtttccacacctttatgtggagacctgataagtaagcaacaataaggaagggtccccaggttggggagagccccaagttgagaacaataatgaacaatgattgtatgaacaattgttagaaacagctaatcacaaacaacctgcgggcacaatgacctcattccacacgtagcacccttcagcaggaccctataaaactttcctccagcccttgcctctttgcaggtagccccttctctgctgagctgcccactgcaacatattttcacaatttctctaataaatctgcccttctttacctacaactatcttggtaaatggctttaccacctgcaaaactgaccctaggttgttgctacccgatatggtttggctgcgtccccacccaaatttcatcttgaattgtagttcccataatccccatgtgtcgtgggagggacccggtaggaggtaatcgaatcatgggggcaggtttttcccatactgttctcgtgatagtgaatacatctcactaaatctgatggttttataaagggcagtttccctgcacgtgctctcttgcctgctgccatggaagacatacctttttgctccttgccttccaccatgattctgaggcctctccagccttgtggaactgtgagtacattaaacctctttttctttataaattacccagtttccagtatttcttcatagcagtatgaaaagtaactaatacactacccgagacatcttaggagatttgtaatagctgtaatgccaggtccaccatatttttagcataaagcaaatgtttacgcgtgatatgactgcacgggctttctttcagctggagccatagcaactcaagtagtaaccctatcttagtctgattaaaagtaaatattagtctgggcatggtgggacatgcctgtaatcccagtactttgggaggctgagacagaaggattgcttgagcccaggagtttgagaccagcctgggcaacatggaaaaacaccatctctacaaaaaatacaaaaattagctgagcgtggtggcacacacctgtagtcccagcaccttgggagggtgaggcaggaggatctcttgaacccgggaggtggaagccgcagtgggcaatgatcatgtcagaggtgtgtgaaccagagcaactccatcttaaataggagccaggaaaaatgaggctgaaactactgggctgcattccctgatggttaaggcattctaagtcacaggatgacatagaaggtcagcacaaaataccagtcataaagaccttgctgataaaacaggttgcagtgaaggagctggccaaaacccaccaaaaccaaaatagagacaagactgacctcccatcatcctccctgctacactcctaccagcaccatgacagtttacaaatgccacggcaacatcaagaagttaccctatatggtctaaaaagaggaggcatgaaaaatccactccttgtttagcatatcatcaagaaataaccataaaaatgggcaaccagcagccctcacggctgctccgtctatggggtagccattcttttattcctttactttctctctttttttttgagatggagtctccctctgtcacccaggctggagtgcagtggcgcgatctcggcttactgcaagcttcgcctcccgggttcatcccattctcctgcctcagcctccagagtaggtgggactacaggcaccggccaccacacttggctaatttttttgtatttttagtagagatgaggtttcaccgtgttaaccaggatggtcttgatctcctgacctcgtgatccacctgtctcggcctcccaaagtgctgcgattacaggagtgagccacggtgcccctcctcctttactttcttaataaacttgctttcacttcacactgtggcatcaccctgaattctttcttgcacaagatccaagaaccctctcttggggtctagattgggacccctttcctgtaactatcatgctactgcactccagcctgggcaacagagcaaggccctgtctcaaaaaaaaaaaaaaaaaaggaacatgacttaatacattcattttggaggataagtctctcaaaataggcctttcactgggggaaaatggtaaaaatactccctggtaattcaagaattggagactcctgagatgctgctcatattagctgagcacttatcaatacttcacttttttccatatatactcaaggaacaagtgctatttaaagtgtttcactccactgggctaggtgcaagactataaagaggtgtgaggatcaacacttttatgaaaaccagtgtcattctggatatagtttcagatgctagtgcaaaggaagctcttggtatacggaaaaagtattcaacaataaattaggcatggttgcttccattttctgcctcacatactttttttttcgtggttaaagtgatataatgtctatgatattttagattggcagttgcaaactagtggtcctcagcgtgctttttatgacacctacaaggtctgaagactttgatttcatattaaaaatctgggtttcaggctgggtgtggtgttgcatgcctgtaatcccagcactttgggaggctgaggcaggagaatcgcttgaaccagggaggtggaggttgcagtgagccaagatcgcgccactgcactcaagcttaggcaatagagcaagactccatctcaaaaaatgaataaataaataaataaaatctgggtttcaggccaggtgtggtggtgcactcctgcaatcccagcactttgggaggctgagatgggcagacagcttgacctcaggaattccagactagcctgggcaacatggcgaaaccccatgtctacaaataatacaaaaaaattagctgggtgtagtggagtgtgcctgtaatcccagcaacgtgggaggctgaagtgagaggattgcttgagcctgggaggttgatgttacagtgagctgagatcgccctcctacactccaacctgggcaacagagccagaccttgtcttaaaaaaaaaaaaaaaaaaaaaaattctgggtttctggcatctcaaaaaaaaaaaaaaaaaaaaaaaaaggaaaggtcagggcacatggctgctacagtcctctattaagcaatgtgccacagcagggtccctgacccctgggccatggacatgtactggtctgtggcctgttaggaactgggccacagagcaggaggtgaatggtgggtaacaattgaagcttcgtctgtatttctggctgctccccattgcttgcattgctgcctgagctctgcctcctgtcagatcagcagcatcattagattcttacaggagcatgaaccctgttgtgaattgcacacacgagggatccaggttgcatattccttatgagaatctaattcctgatgatttgtggtggaacagtttcatcccaagaccattaccatcctgcgccccatcccttgccgcctgtggaaaaattgtcttccacaaagccggtccctggtgccaaaaatgttggggactgctgtgctttagaatctgccatgaatctgcagcctctattatatagctccctatagactttgcttcctaccgtcttacgttctgccttataggcatttgactttgcaacccttgtttttgttagtatgctacgctggtgacattgaccaaattgaccacacattaattataagcttagttggtgatgacctcaacggaataacgtgacataagtattgtgacaatacttcttgcatgtatctgcaggtggaattgtaaacctggtggtccgagatggtctaattccatcttcctatgtatctccttatattaatagtggtaacatttgtggtggtgattcagcatttcaatgcctcttctcatggcaacaacaaacgttttccttctgaatcaacattaacctagatgttactgcggatcaaaattagactctacattttcaaccacagaaataccgagcagtaaaaatttttcttaatattgattgcctacataggttgtgtaattagcatatgtttacagttctatgatttctgcgtggctgctacagagctggagggggtaaagcaacagtattttctcagttgtccgagcagcattacattataataaataggtaatattaaactgggctgatgagagttgcaaaagactactttaatgttcatatggaaccaaaaaagagcccacattgccaagacaatcctaagcccaatgaacaaagctggaggcatcatgctacctgacttcaaactatactacaaggctacagtaaccaaaacagcctggtactgctaccgaaacagacatatagaccaatggaacagaacagagccctcagaaataataccacacatctacaaccatctgatctttgacaaacctgacaaaaacaagaaatgcagaaaggattccctacttaataaatagtgctgggaaaactggctagccctatgtagaaagctgaaactggatcccttccttacaccttatacaaaaattaattcaagatggattaaagacttaaatgttagacctaaagccataaaaaccctagaagaaaacctaggcaataccattcaggacatagggatgggcaaggacttcatgtctaaaacaccaaaagcaatggcaacagaagccaaaactgacaaatgggatctaattaaactaaagagcttctgcacagcaaaagaaactaggatcagtgtgaacaggcaacctagagaatgggagaaaatttttgccatctacttatctgacaaaaggctaatatccagaatctacaaagaacaccaacaaatttacaagaaaaaaaaacaaaccccatcaaaaagtgggcaaagcatatgaacagacacttctcaaaagaagacatttatgcagccaacagacacatgaaaaaatgctcatcatcactggccatcagagaaatgcaaatcaaaaccgcaatgagatatcatctcacaccagttagaatggcgatcattaaaaagtcaggaaacaacaggtgctggagaggatgtggagaaataggaacacttttacactgttggtaggactgtaaactggttcaaccattgtggaagacagtgtggcgattcctcagggatctagaactagaaataccatttgacccagccatcccattactggatacatacccaaaggattataaatcatgctgctataaagacacatgcacacatatgtttatcgcggcaatattcacgatagtgaagacttggaaccaacacaaatgtccatcaatgatagactggattaagaaaatgtggcacagatacaccatggagtactatgcagccataaaaaaggatgagttcatgtcctttgtagagacatggatgaagctggaaacgatcactctcagcaaactatcacaaggacaaaaaaccaaacaccgcatgttctcactcacagatgcgaattgaacaatgagaacacttggacacaggaaggggaacatcacacactggggcctcttgtgtggtgggggagggggaagggatagcagtaggagatacacctaatgtaaatgacgagttaatgggtgcagtacaccaacatggcacatgtatacatatgtaacaaacctgcacattgtgtacatgtaccctataacttaaagtataattttaaaaaataagtaaataaataaataaaaaaagaaacaattgctggctttgcaattctctttcctccaaaatcgccaaggcctcaatttactcattgctgaaaaaggacgactctgtatatttttaaatgaagagtgttgtttttacctaaatcaatctggcctggtatatgacaacataaaaaaactcaaggatagagtccaaaaacttgccaaccaagcaaataattatgctgaacccccttgggcactctcttaattggatgtcctgggtcctcccaattcttagtcctttaatacctgtttttctccttctcttattcggactgtgtgtcttctgtttagtttctcaattcatacaaaaccgtattcaggccatcaccaataattctatatgacaaatgctccttctaacaaccccacagtatcagcccttaccccaaaatctttcttcagttgaatctctcccactgtaggttcccaggccgcccctaatcccgctcgaagcagccctgagaaacatcgcccattatctctccatatcacccccacaaattttcgccaccccaacactttaccactattttgttttatttttcttattaacataagaagacaggaatgtcaggcctctgagtccaagctaagccatcatatcccagtgacctgcacgtatacatccagatggcctgaagcaactgaagatccacagaagtgaaaacagccttaactgaagacattccaccattgtcatttgtttctgccccaccctaactgatcaatgtactttgtaatctgccccactcttaagaaggttctttatcatctcccccacccttaagaagtttctttgtaattctcctcacccttgacaatgtactttatgagatccacctcctgcccccaaaacactgctcttaactccaccgcctatccccaaacctataagaaccagtgataatcacaccaccctttgctgactccttttttggactcagcccgcctgcacccaggtgaaataaacagccatgttgctcacacaaagcatgtttggtggtctcttcacacagacacgtgagacaggagttcgagaccagcctggccaatctggtgaaactctatgtctctactaaaaatacaaaaattagctgggcatggtggcgggcacctgtaatcccagctactcgggaagctgaggcacaaaaattgcttgaacccaggaggcagagtttgcagtgagccaagatcacactgtcaggcctctgagcccaagccaagccattgcatcccctgtgacttgcacgtatacatccagatggcctgaagtaactgaagatccacacaagaagtaaaaatagccttaactgatgacattccaccattgtgatttgtttctgccccaccctaactgttcaatgtactttgtaatctcccccacccttaagaaggtactttgtaatctccccaacccttaagaaggttctttgtaattctccccacccttgagaatgtactttgtgagatccacccctgcctgcaaacatggctcttcaccccctatcccaaaacctgtaagaactaatgataatccaccaccctttgctgactctcttttcggactcagcccgcctgcacccaggtgaaataaacagccatgttgctcacacaaagcctgtttagtggtctcttcacacggacgcgcatgaaacacacgaccgcacttcaggctgggcgacagagctagattccatctcaaaaaaaataaaacaaaaaggagtcacctcccccgagaggcctctggaccaccccatctgagcaggccactcttccttctctatcttaccatcttgtttctgtcccagtagttagggctacctccagtaatcctatttgtccctttactgtttagtgcgtctcgcttgactagaagctccatgaaagcaagagaccctacctgcctccttcgccactagacccccagggcctggtatgtggtgatcgctcagggcccattttcttcctttcctcctcctccaagggtggggaaagagcatcagaaggtctaggtggccccaggcccaaacaatgctcctttaaaaggaaaccagattgttacaaaggtcagaggctgaaaagttatttccgccttttatccctctaaattcttcacttcctgaaaaaacaaacaaacaaaaaagccactgagggcccttggactaaatccaggcctcagttgctgggcagaggtcagtcttgtccagacatgggaaaaaaataattcgagtcagacaggtgggtcaccagagaacgaatccagcctgcaaatggcctgtgcaatcttcagctctgtccagacctgcctccctttggggatgcctttaaaggtgatgaatgatctggatgaatgggcttagaagataagagggaaaaacaaatatcacaggtcaaatcgttatttgtcttcaagtttaacaccgtctactggactaaaagatgtccaaagaatagttgttcaactatgtaaattcctttttttctttttttttttttttgagacagagtctcgctctgttgcccaggctggagtgcaatggtatgatcttggctcactgcaagcaacctctgattttagtattgttagtacagacagggtttcaccatgttgaccaggctggtctcgaactcctgacctcaggtgatccacctgcctcggcatcccagagtgctgggattacaggcgtgagccaccgtgcccggccaactacataaattcctaacaacgtatctccagaaagtataggcacaacagcacatgcagtcattcctgtaattaagtgctccgggaggccaaggcaagaagatcccttgagcccaggagtttgagaccagcctggacaacatagcaagactgtgtctctacaaaatatacaaaaattgggctggggatggtggctcacgcctgtaggcccagcactttgggagaccaaggcaggaagatcgactgaactcaggagctcgggaccagcctggacaacataacgagacccagtctctactgaaactcaagaaaattagccagacgtggttgcatgtgcctgtagtcccagcactttgggaggccaaggtgggtggatcacctgaggtcaggaggtcgagaccagcctggccaacatggtgaagtctcgtccctactaaaaatacaaaaattagccaggcacggtggcacacacctgtagtcccagctacttgggaggctgaggcaggagaatggattgaacccaggaggcagaggttgcagtgagccgagatggcaccattgcactccagcctgggcaacagaacaagactccatcaaaaaaaaaaaaaaaaaaaaaaaaaaagaaagaaagaaagaagaaaagaaaattagccaggtgtggttgcatgcacctgtagtcccagcactttgggaggccaaggcaggaggatcaatcaaggctaggagattgagactgcagaaggaaaccctgtctctaaaaacaaggtccagctaaaatcagggtccagctccaccacaagcgcagctccaggggctgttgagttttgcctctaccattccaagtagtctctgctccagaccaagtcccaccatctggcagtcatgtcagtctaaccacagtcatatcagggcgcttccagtcattgagtgccccttgaggaggctggaggagaggccaatgacatttgcacttgagactccagagtctagatttataaccactatgttatggctgccagtgtggctgcaaggacacttctttcattcattcatttacaatagatgtagcatctgctgtgtgccagatgccattctaggttatagggaaacaaggcagagcccctgttttccaaggcatccacattctaggaaagactgctaccagcctggcgtggtggctcatgcctgtaatcccagtactttttgggaggccgaggtgggcggatcacttgatgtcaggagttcaagaccagccaacatagtgaaaccccgtttctactaaaagtacaaaaatcagctgggcatggtggcacgtgcctgtagtcccagctactcaggaagctaaggcaggagaattgcttgaacctgggaggcagaggttctggtgagccgagatcatgctactgcactccagcctgggcaacagagtgagactccataaaaaaaaaataataataataaaataaagactgctactaaacaataaaataaccaaaccagatagatgacttcaggtggtggtaagagctttgaaagaataagcaaggtaactaactggtcagaggaagggagatgggtgcattccctcagatagaccgccccagaggtctgcctctctgacatgacatttgagcagagacccaacaggaaaaggaagagactgctctatggccaggcacggtggctcacacctgtaatcccagcactttgggaggcccaggcgggcggatcacgaggtcaggaaatcgagcccatcctggctaagacggtgaaaccctgtctctactaaaaatacaaaaaaattagccgggcgtggtggcggatgcctgtagtcccagctactcggaaggctgaggcaggagaatggcatgaacctgggagatggagcttgcagtgagccgagatcgcgccactgcacttcagcctgggcgacagagtgagactccatctcaaaggaaaaaaaaaaaaagaaccaagaggtgtccaggcgaagagaacagcagatgcaaaggccctgtggcagaaacaatcttggtatgctggaggaataggaaggcagccagtgcagctggagcaggataggttaagggaggatcaaggtgatgagggcctggaaagaggggctggggtcgaatcaccagatcctgttggttgcaatggaagagcctggagtttattctcagagcagtgagaagccactggaaagttgtttttttgtttttctgtttttgagacagagtctagctctgtcacccaggcagactgcagtggtgcaatcttggctcactgtaacctctgcctcccaggttcaagcgattctcctgcctcaggctccccagtagctgggattacaggcacatgccaccacacccatctaatttttctttttcttttttttttttttttttgagacagagtctctgtcacccaggctggagtgcagtggcgcaatctcagctcactgcaacctccacctccctggttcaagcgattctcctgcctcagcctcccgagtagctgggactacaggtgcatgccaccatacctgggttaattttttgtgtttttagtagagacaagatttcaccacgttagccaggatggtctcgatttcctgacctcgtgatctgcccaccatggcctcccaaagtgctgggattacaggcgtgagccaccgtgcctggccagccaccggaaagttttatgtaagcaggggagtgatctgttttatcatttagaaggatacacacctcttcttctttttttagagacagggtctagttctgtcacccaggctggagcccagtggcacaatcatagcttactgtaacctcaaactcctgggctcaagtgatcctcctgcctcagcatcccaaagtgctggattacaggcatgagtcaccatgcctggtcacacttctcattctttaaaccagacctcatttgtccatctcccccatcccccgccccaccccacggactgtcctataatgcccatacaacaggtcactgtttagaaagtgctacaaagttacaaacacagtcccttctgagcctcccaccaatgttggtgggtacaaggtcaaaaaaaaaaaatctcatctatctaaggggcataggagactttttagttagagggcccaattatagtcctcctgaaaagatgccaaaagtccccttcaacacttagcaaagattcaagaaagatgaatctcacattctttgtatgggaaatgaggaacttgacatcttcaatataatggattccactaaaataagatgacgatcaataggaaccaactaaaaaaatacttgactagctgttattgaaaggctgaaattcagctgacataagcagtattaatattgagctagaaaataattcgcattgaattcagcccaacttttgttttctgatttgggtctcttctaaattttttttttcttctggacattgggaacaatccaatttgaaggcctcaatgcccaaatctacactcttgttttattctatatccttggtttcttttttttttttttgagatggagtctcattctgtcgcccaggctggagtgcagtggcgtgatcttggctcaatgcaagatccgcctcccgggttcatgccattctcctgctgcagcctcccgagtaattgggactacagatgcccgcccccacgcccggctaatttttttgtatttttagtagagacggggtttctccgtgttatccaggatggtctcgatctcctgacctcgtgatccacctgcctcagcatctcaaagtgctgggattacaggcgttagccaccgtgcccggcccacacctaggtgatttttaaagttcttctagtagagacagggtctcactatgtcgggtcgccgtgtttgatgtcagttttccctgccagaatctacaatctccttgatcaccattatatcccaacgtagagctcagtacctggtacaaagcacatttgatcaatacttgctgaataaagaaataaaaatgaagaggcactccagcctgggcaacagagtgagatggtctcaaaaaaacaaaaacaaaaacaaaaaacgactggaaaggagatgagggtacttgtgaagccatattatatgacacgctctgtgctaggacttttatataccttgtctcatctcttcatctcatataatccttacaaggatctcaaaagtggggaaatccccatataactgaagacgaaggcagttcagaagttcactgatttgccctaaggttcctcaatttgcaaacgtcaggccaatgatccaaccccaggtatgtttggcagtgaaggaccagttgagtcacagctgcaagtaaccaccctgcagtggtccctatcttggccgttagcttacattgacatttaacactcaaatttactcagtaacaccagctatcatgttttccactaaaactccacagcattctggcaacttttctattttagagcaataaagtaaattgttagcatccctttgacatataaatatttctacaaatagtaattctctagccattcatttggagtatttaaaactcaacattcatagcacattttatgtgacaaagaacttctgttcagaacacaaaaataagtcgtacatcttcattaaaaacgggtgaagaatttgaacaaacatttgcaaactaaaatacaaatgaaatacactcaacatcattagtcatcaagaaaataaaattatgagataatcactaataatcactacatatgcaccacagtgattaaaatttttttaagttaagccacgtgacccaacaaggtgcattcactcaagagaaacgcaaatatatgtccactcaaagacttgcacatgaatgttgagagcaggtttatactgaatagcgcaatgtgaaaaaaccccaaaatctagcaaaggatgaagggagaaataaactgtggtatatacatacaatagaacactactcaataataaaaaggattatattcctgatacatgcaatatgggtgaaccgtaaaaatatcatgctgagcaagagaagccaaacacaagagaacatgttgttatgatttcacgtacatgaaactttagtaaagacaagtctaatccatagtgacagaaagcaaatcagtaactgctgacaggggcaaatgaggagatgatctcaagggaaccttctggggtaagatgctgttctgtatctcgatcgtattggtggtcacacaagtgaagacatgttagaactcatcaaaccatacacttagaatgtgtaatataaacctcaataaagcaaaattaaaaaaaaaaaaccacctttaattttctcttacaaaaaaaaaaaaaaggaaaaccacttaactttaattttctccaacaactgattctggtacacagtataccttaatgcctgcatccacggcctcacgtcatgctgtttacatgaacgtaaagcttcgccgaagagtggaataagacagtcctgccagagaaaaaccaaaattactcaacgtaaaacaggctgttgatatgtttgcagatatatagcaagtcttaagtccaagactgcaatatagtttggctacttcagattgattgcagtagttttatctattacactatacccttccatcatttatcttctactcacaagaggcaagcacacagtaagagaaagccttttgttttgaagggaaatcttcttcagaatattaagtctaatttatcaatatacttaataaagcacattacaaaaaaaatgtcacagcacatttactataaagcagactgcagaaaaacattacaactaatgctttattatgaagttctcgaagatcaccattcattcagaagcccccatctctggtcgaactttaccccatttaggatgaagaggagagatctttgtttgcagcaaatctaaaatttacgtaatccgcctaaaggaactgtctttacatacaccacctcccaccccaaaaatagaagaaaaaactgagcaatttgccatccttgcgattatctcaggttcttccatctgccccatgtacttcccaaatgaaagactgcctgaaaacggcatgttagatttctggatttaccagcttgcccaactacaaatcctattccaaaaaactcaaaaaataaggtctttgttctacagtaatgaccattaatagtcataagagtgtgcttgtaaaaatatacagacctctgttgaaagtctgttagaaactgtggtctccaaagcaaacgagcaatacagctacaaggtacttagaactggcaaagactgtgaaactgttaaagtagaaagtctcagaggtccaatagtgatgcgggatgtttgcttcaagtactttaccacatttctgaaacaaaatatttactgtcaattaataaaaattacaattcataaccactcaaagaataaagcaattgataagatgctatcaaactgacatccaaagttagggggcagtaagaggagcagcctgctctataataaaatgatatcagcaagtcaagacatttgcttttggggatttttacattttatttcatttcaacctcagtttttgttggcaagcagcattcatatatcatatgacttctacaactaaaatgaagctattagcactagtatttagtaatctagtaactctccttccagccctcttcaccccatgtatgtttatcacatgatatacacaatgtacatttacctccgtaagagtaaacttactcagttatagactgccacttctgatcttgttctatcgggtttaaagcagttgccaaacaaacagaacttcttaacaatggaacttcaatggatttctgaggttcccttggatctggacttcacatgttacgaagcagttttttcatgtctacagaagttaaatgaaatgtcattaagttaatgtgcttttattataaattttgatttatgtttggcattattaagaactaatcaccaatgaacagctcctttaatatttcaggcagttaaacactataagcattactgagagctatataaaaatcatacttcatacaaaattactgtacctcagacccctaaaaagcagttgccttcaaaggctcaaaaatcactaagtcgaggtcaggtgtggtggctcacgcctgtaatcccagcactttgggaggccaaggtgggtggatcacgaagtcaggagttcaagaccagcctggccacgatgatgaaaccccgtctctactaaaaatacaaaaaattagctgggcacggtggcagacacctgtaatcccagctactcagggggccgaggcaggagaatcacttgaactcagagggcggaggttgcagtgagccgaaatcgcgccactgcactccagcctgggcaacagagtgagactctgtctcaacaaaaaagaaaatcggtaagtcaatctactatttaaggggacaaatctagacctgcattagcaagtcttgctcaatccagaatactcattaaactttttaataacatcttatcaagtgttccatttgtgataaagaacttaatgagccacatcaagatgaaaatcaagaaaaatatttagctgaaacactactttgtcctttatcaaacaaaatggctagataaatctcaaagtattaaggtggtcattttttttatttgacttaattttaagtgcttttcatttcccaaatcaaacataaatagggcagccctaaatttgttgcttcacatgggattctgcccccacaaaaatgtaaaataacttccagattttccagtaaaatatactaagccaaacattttgagcaacttgtccactaaaataactttaaaactattttctcaaatacctacctattttttcttttgaccctccagcaagtagattgatattttctcctggtaacaattctaattgctcggtacatttgacaaattttccagactcaaagctgcttaatgatctgtaattaaaatattgcttagcttgtattcctatgcagcctgtggaaccattaaaaaaaacaaacaaacaaaaacagaacaaatcctaggaagacagcaaagtacacagcatttttctgacaaaattccttccacgaggatgccattattttggtttttatgttgaagatgtgactaccacttaattagtactcaaattggagtggcaaaccagaaagtcacagctacagactttcagtggagctgactcgcccctgtgtctccttcctgttttcatgtgttgcagcctgttctcttcagagcctgacacactgacagtagacctctgcaggacaactttgacacccagttctctccaagctgccagtgagctccctgtgcagcctcactcctcacctacagcatgagcccttgcagctctcccagcatcacaatcttgtatctcagtcctggcttctttcactgctggcatccctctgtctctccctttttcacctacttttcttttttcaaagaattcttctctttcatctgcttatatgaaaaataatgacacctctgaaattctttcctgtagttctgcagcatcaatgccaggaagacaggcctcatcctcccagcttctatgctgctcctttcagatcccttaccctgtccccattttcatgacacgggctctccagccaggaagaagacactgtttctcactctctcttttccatctttgcctgtccctctcgctgtgtaacttcccttataactcagcctgaggccagtgctagaaaggcacatcacctgacttattctgtgcctgattctacctagatcagtgcaaccactggcttctcagggggacccttgagtactgggcactgatgaactgctgccaacacagtcatcatttctgccattaaaaggtcctaagtcctctccagtggcaggttccccaagtccccactatgctctataatgccctatgctttcagctaatgactcagtcctcagaaaaaacaaacaaataaacaaaaaaacacaggctttaatttcctctacccctacccccaatccaccatacactgccgaaattctgtctataccaactttgactgctttccttgaggcagagaaaaggtgagggccagttaatctatcaatgttctttctcctgtttcttcaacctctgctttctagtggctccttccccttggccaaaagaacataatctctccaacatttaaaataaacatctcatatttccctccagcaacagcttcctatcctcgacttcaagaaaaactcactgaccaaataacttacctcaagcttttcattttcaaatgtctctaccactcaatactattcaatctagcttcttctgtctctctacaaaactctttttccttataatccctagagcatctgacaaggctgactactcccatctggatgtcctatatctagggcacttcccttctcaatgtccctgttatttttttgaatggcttcctcttctatcctttcacaaaaatgctaaactaggattctgacccaggccttccttcctcttcactcactattctccagaggcttctctctggtttggttgcttacaaaggctctagagtatagagactgaaaaggaaagagggccttttctgtgtactaatcatctgcaaatctctcaagcttagactgtctccttagttcaaaatccaattcttaacagcttacccaacaatctcatctgcacatttcattagaaatcttaaaacatggcttgttctctgtgtgctcctactccagttaatagcattgtttctcttccctctaccattgcccccataaattaatggtctccatgcttccatacttgccccgcacctccagtctcttcaccacagcagaatgaaccaagtcagatcacaacacatctctgttcaaatcccacctgaaattttcagtcttactagaataacagccaaagttcttctcagttcccagctacttctctgcccttatatcctactgtttaaggcgctcctaaacacacaggcctcccagctatttccagaacactccaagcccatcattctcacatcaggtctaggcccaaagggcatcctgatgggcatgtcttgaccttgtgtcttccctccaaagaaggtcagctttacctaactgctttccttatggcacagaaaaggtgagtgaggtccaattagtccttctatcaataatctttatctaatctttgctttaaaaggttggaatttgtgtctgttttatgtgctgcctgggtcacagcacatgctcagtgaagcaattacacattaacccatttagcagtagaagtatcagacaaagtctaatgacctttatcttcccagccaagtgtctgcaacagagtgctcagttttgaattacagaattaataaaagcacagaggaatgagaagaaagtttaatttacagatgttcacaaactctgtcctcattagaataaatgtttttgatatattcagacctcatttagaaacaaagccatcaaatgtgattctttctaaagcagtacaaatttttctttatattcactctggcataatcttcaaactgtattaaggttttagaacaacaggttctgaaaattaataccaaatgactatctcagcagtgttttcccattatacaaataccttccctcatctctgatgtcagtttcctgttgtcattttcataatggcagtaagttagaaatataaccattttgtattactacatatgaccaattttaatatttttttgccataggaaaaacatcgtagttattggaaatttgttttataactggaaacagaaagccttactttatatagttgaagtcagctttcaggttgaaggaagtgctactggtactctttttcaagtcatggatagcgttctgccattcctgcacagcagcccaatcggcaattgagatgtagcactcacatgctttatttcctaaataatttataacctcaggggaagagtcagtcggtttggacagcacagtttttctggattcacctgaaagtattttataaagtaagaagagagagattcagatcaattagaaatatttcaaagagcacagaaacctaaaaacatgataagatcatcagtacgaaatatattactataacttttgctttatttaaaaatactgaacgctcaccattcagacaatgtttcgggctggcactgttacacccagcattggctaaggtgagcaccgatttgtcaaagctggagatgcagcaatgaacacctatcatggcacacaggtgttcctggtactccacagaggccttttcaaacctgaaaagcaaattgaagcagtcttatttctttatttatctacttacttactttttttttttttttgagatgaagttttgctcttcttgcccaggctggagtgcaatggcactgtctcagctcaatgcaacctctgcctcctgggtacaagcgattctcctgcctcagcctcctgagtagctgggattacaggcgctcgccaccatgcccggctaattttcttgtatttttagtagagacggggtttcaccatgttggccaggctggtcttgaactcctgacctcaggtgatccgcctgcctcggcctcccgaagtgctgggattacaggcatgagccaccgcgcctggcctttacttacttacttacttgttttttgagacagtcttactgtcacccaggctggagggcagtggcatgatcatggctcgctgcagccttgccctcccaggctcatgcaatcctccaacctcagcctcccaagtagctgggactacaggcgcccaccaccacacctggctaaaacaaggttttgctctgttggccagggtggtctcaaactcctggactcaagcgatccgctcacctcagtctccccaagtactgggatttcaggcgtgagccaccgcgcccagccccaaaggaggctgttattttaaacacacatatctcatttcccccctcccacaaaaaatggtgcaagaataaactgagctaaaacagtgagttgactatggtggggggaggtttgatgtcttcctcacaactatgaaactaaatttaaaagtggttaaatgttttttaaaaaatgtaagagtataaaagaactagtggaaaatattgataagtaactgatgtcagtgtgtggaaaggctttgtagaaggataaaatgcaagaaaagatgcacaagtaacagcatctagatgcataatgctgaaatacaacactaaacattaaaaacaaattataatcaagaaattggatagcatcaacaatcttagtatttaatgaaatttcacagattaacacaggaaaaattgagaggccatgaagacatgatccatgttttaaaaaatcacaaatggtcactatatggggcaacttctactattagtcattaatacatatagaaatgtaaagtacaataactattttcgctgatggtggtggcagcattcttgtttctcagtgactctcagtatccacaaaggtgaagggaagggggtactctattattaagggtatacattgcagccatcttttctgtagagtaacttagcaatagaatatatcataagacttatggtttggcagcctttcttctagtaaatcagtttatgagaatggattccaagaaagtaatcagaaatataagcaaagatattaagtgctatggtacatttagtaaaaaaaaaaaaatcagaaacaaccttaatgcccaacagtaagaaatattaaattatggtacactcataaatacaaatctttattaaaaataacactgtagaatacttaacatggcaattttttttttttttttttttgagacagagttttgcttttgttgcccaggctggagggcagtggcacaacctgggctcacagcaacctccgcctcccgggttcaaccgattctcctgcctcagcctcccaagtagctgggattacaggcatgtgccaccacaccccactaatattttttgtatttttagtagagacggggtttcaccatgttaggctagtctcaaactcctgacctcaggtgatccacctgcctcggcctcccaaagtgctgggaatacagatgtaagacaccgaacccagcctacctaacatggcaaattttttttttaaatattgagtgggaaaaacagatcataaaaccatgtgcctatgtatgctgctgttttggtgaagaatggagaaaacgacatgaaagaaaaaagaattacaaagcatatggatatggaaatatgggactacaaaaggacacacaacagaagttactacaaagatatggaagaatgagcagttcttttattttcctaaattcgcaagatttcattaaactaacataaatggacacagaatattatggtacaagctcctctatctggaggaagcaatgagtctgaatgtagagttcacaggactaatgagcaaatactctgacaataaagggtaatttgtatcagactctgagggggaaggagctcaactagggatcaagttcaaaagcatttataaaacaactgacaggtcttgtttttcagtgtgatttgccactaattcttaaataagaaaggcactcaagtattgctgctaactaaagaacaaactgaagatgcctcctggtgaagtgatttatagcaagcttcaatgctgaaagcaaacaaagctgttttaagatttggctacaatgtcagtgagtaatacaaagaatttaaacataaagtaattctatcacccatttccttccctccaacctacctcccttcagcctgttgagccactgagttaatccacagaagattttttccaacaatagatgatgaccagacagcaattccctgtatagcttcaggacaatgaagttcacatagtgcttctaccaccatcataatggttacttccaattcattcccctgaaaacgcattcagaaaagttagtcacccaataccattaaaacataaatccctataaaatttacaactgatcacagtctgtgcctgcttaaagccaaatgtatttaacaattattttcacaattttcacattatttagctcagaattctttaaaatgttacatataaaatagccacaaagggtgactaacagaaccttagcagcacatggatgtttgcacccccaccccaaagttacccaaacatttaacctgtgacctctgtaggaataacacatggagtaaaaagaaagcaaaaattaaatataaataaacaggaattaaagaatgattaacttcatgtgtttgaatactgcttgacattacctgaattgctaaacattttgttatttttggattccagttatttattgtgagcccactttcaagccaggaattactcaagcatttgtcatacgttataaaaacaatttctcctggccaggtgcagtggctcatgcctgtaatcccagcactttggaaggccaaggtgggcggatcacttgtggtcaggagttcgagaccagcctggccaacatggtgaaaccctgtctctactaaaaatacaaaacttagctgggtatggtggtgggtgcctgtaatcccagggactgaggcaagaagaggcttgaacccgagaggcggagcttacagtgagccgagatcacacaactgcactccagcctgggcgacagagtgctgtgtctcaaaaaaataaataaataaataaaaaatttcccccataaacaaattttcagaattacctttaaagttctaaactttgcacataagaaatatagttttaacatgttctaagatgaatattgttttaacatgaacaaaaacatgaacattattttaacttctaacactgttttaacacgaataaaataggtaactctggcagttgttgcttttacaaaatacaggatcaaaacctttgaaaatgaatccaagctttaacttattttatccatagattaaatcataccaaaggaattaaaccatgtttttcttattaacagacttaaaatgaatttcaaacacaccactttacctgagataggctggttgttttcatctctgtaagcaagtcaaagccatgtctcactgtcactgcaggctggcctgccaacaatcctaccctcatgatggagagtcgaatccgcgttagccagtcctgacaagtttggcgattggtatagaaaaaagttctagtcactttacgataagagaaagaaaagctcaggactggttcaatttgtaggtaaggatgtctcacctatatataaaccaaatacacaagtctattgtgatttcagctctgcacatactgccagctgtgaccattaaactgctataaaacaacactatctcatggaaaccaaccttgggaggtgaagttaatgcattagcacatccctcgtatgcattatacattaatttctccagatattccagatactgcagaagaagaacaagtctaagttggttgttaccatggccttcatcactgtctgcagttgtccactgactaacatcctgatcagggtttaatgtgtgagctgcgagacttcgaatgatacctgaaagcaaagacaacattctgaatttttaaaaatcttaaaagttcctagaataagtgtgagttttttatgatcaattcacatttatcaagtatcctctgtctacccatcatttaaaaataaaaaatcccaacatgaaagatctttcattttaggggaaaaaaatatatattttttccacacaactcccataagttttgggaaaaaaacaaacatatttccaatgcaattattcaatgaaagcttattctaacaaacatacctgaaaattactgacttcttttcaaaaaaatcatatactctcaaatctttaacaaagatttaaaaatccattatttcttaataaggctttgaaagtattcacatcacaaagcttgagcgagttaccttcaattgtctggaaggtgtcttgagctctgcccagtggggttctcagcttagaaagaacagtgaattgtgcagcttcccatacggcccactgccaaaggatagcatctgtcttcaggagattgcgtggaattgttgactggtcatgcttatccagtctctggcagctatagaacagtctttccaaccaattgtccttcctgggaaaagtagtttcatatttaaaagacaatgacaacttcattttaataatgaaaaaaaaatgcaaggggaatgggaataaggaactgtaattttccctactccaaaaaaaggcaaaacctatgaaattgagaagcattatgtcccccccctcttattttgaggtcttttatagttaacaggatgaggtacagcgtggaaggatgattagggtaaacggctcatgccggtcaggaatgaaactcattcaatgcaactaagcatctctagaatatctccacccccaccccattccccaaagtgttaatgacatcacatcagttaactgttaaccacatttcattactcaatttcaaagcccatttttgtttctacagatgctatcttcaaagtaattttcctattgatgaaaactgaaataacccatatgagaagaatgttacttgatactctgccacccccaaacatattttctcttcaaaactgcatgtaaagtaaagggaatcttaaaattatctttcctagataaaatagtcaaagaaatgccttaccctgttctatgagagttcccatacaaaataaaactaataacatcagagaaatcttgggggtggaatgtattacttggtgctttactcatgtgacttcttaatgctaaagaaatttcttgaatttctgtgtgattgttattgctgtagacagaaaataaagttgttgttacgcaaaatattttagcttaaaaggttagcacatactgtaagtggattatttacttattaactcactggaggtaaaaatatagaaaaattgagactttcaaatggatacggagatgtgattacaactttagatcctttttttattcacttcagatgggtcatgtgccgacatcataagaggatttgagggaggcatatcaaacatgtgaacataaaaacccaatcattatgcttatgtattacaaaaggatcaagtttaggctcttaaaagctcccaaatcaacttgatcaaaaacaataaaagattactgtttagtttttcaaatatctgagctactaagaaacatattttggcactacatgagttattctatactaattattgtgagcctataaagctcattaaaaatttttaattttcttgcagacctgcaaaatttgattatttgacatcacttcaatcactgacaagcagggccataaaagatgtgtcattaatgctctaataggtgatctgtcttctcctaaagtagacaaccagtagaggctgtaaatatcacagaatgtctttgctccaaaacaactgttataccttaggataacatctaaaggaattgatttcaacagttttccaaatgcttgtcgaatacgagttccacagtgcactagttgaacatggcaaacatcaacacatctatgaaagaacgaaatagacaaagcaggtgtgttaacatttcaaagttattaggattaatgtcaaaagacatgatcttaatttcatacctctgtaaaagatcatctggcaaggaagaggacagagcaggtagactgctgcatgcctgcagacagatattcacatcttcaacgagaactattaaacattaaaagacagctactttcagctggccaaaagaaattatatcccagtttgtcataattatctgaatccattcattcattcaacaaagagtgagtgcctactctagactaggcactgttcttgtccagaatcctcattgactgtcatgtttggaaaaatgacacattcaacaaaacccacgtaatgtaactgatgggtcatcacacaaaactttttctgagagaaaatgtaaaagtatatgcaaactataaacattcacgtaagcttaaaaatgtgacaatcacttcaaaacatttttctaatactaagaatgaaaaaaaatcaagactgtgtatctgtcattaaaatgaggattacacatctgcaggtcaggaaaagagctctattgatgaccatctcccattaccaaggattgataaacaaaatagaaaaaaaaaaacagagtcttactgttggctaaaaggcctttgcaaaatttatggaaagacggaagacagaataaaggtgcatatgtttcggacttcttcattaaaacagctacttccaaagcccaagtcattaacagtttcctgaaacacaaaatatacagttgactgtacattaaaaacaataacaaaaacaaaaaaacgttaaaagcctagtcttcttacattggttttctcttggtttttcaaatatctcaaacaataaaaaataaaaataaaaaatgaaactatagaaattactgtcaaaattgttgtgtgccttttaagaaaacctcccaacgcagcatgataatagcaaagaggccgggcgtggtggcttacctgaggtcaggagttcaagaccagcctggccaacaacatggtgaaacaccatctctactaaaaatacaaaaattagctgggtgtggtggcgggcacctgtaatcacggctacttgggaggctgaggcagaagaattgcttgaacctgggaggcagaggttgcagtgagcaaaactccgtctcaaaaacaaaaaaagcatagaatattaaaaatctatatatattcttctatgaaacactgggggtgggggattgaggtttttcatgtatttcttttcagaaagaataagaaagcctagattaaataataaaaccaaattataaggtgtttgacagtaaagaagctgctctacctcacctctataatccacattttttaaaattttttgtaattcacatttcttattctcaaattataaaggcaaattaacaaagttaggaatagttaatactatataaaatctgttacctcgtgtcctggttaaggttatctttcttaagtaatattcacagaagatttaatataattgagaaatgtttctttgtggccgtagttacagtgctaatcacagctccatcaaacaaagaaggagaggaagaactgaggctactagagataaagtgatcatgcctgaaagacaaagcatagattatcttttcatctttaatcaaagaaagcaagcaagtccaaagttaaatcaacatacatctttaaaatctatccattaaaaaaataaaatgttttgtggggttcttaagaaaaatttgtgaatacagtacctggtacaatgagaatacaatgtgtagagcacagcatactgaatggcagggaagtgaacagccaggtcactgtgcacaatcatcagattcttactcagaagtgcaaagacagttggagatagcgcccacatctgatcatgtacaaaacaaagtaagtttatggcttctccaaaataagcacaagcatacagagtttatccttcaaaacaggggtatttggactttttttatttggacatttttaaattaaaattacagattggaagggatctagtacactacaccttggacaaatacttttttgtgaagtcagtaaagcctttgcgtgcaatatagcatctctatgcaatgcagcaactccttgtctatcgctacagtaagaaaacagccacaggtcaggtgttgtggctcacacctgtaatcctagcactttgggaggctaaggtgggcagatcacttgagcccaggagtttgaaaccagcctgggcaacacagcgggaccccatctctactaaaattacaaaaattagctgggcatggtggcgcacacttgtaatcccagctactcgggaggctgaggcaggagaatcgcttgaacctgggaggcagaggttgcagtgacccgagatcataccaatgcactccagcctagatgacaaagttaagactctctctctcaaaacaaaacaccagccacatacgaaacacaggaatgagagtacctgtgttccaagaaaactttcttgagtcggagtctctcgctctgttgcccaggctggagtgcaatggggcgatctcagctcactgcaacctctacctccggggttcaagcaactctccctgcctcagtctcccaagtagctgggactacaggtgcccatcaccacgccctgctaacttttgtatttttttagtagagatagggtttcaccatgttggccaggctggtcttgaactcctgagctcgggtgatttgcccgtctcggtctcccgagggattacaggcgtgaaccactgcgcccagcccaacgagaactttctttacaaaaacaggcactagtgttgcgatggttgtacacttctgtgaatatactaaaaatcagtgaattatacacttaaaataacaaacaaaaaacaggtgctgggctgtatttggcccacggaccatagtttgctgatctctggtctaaacagagccctttgtatgtgccttttgcggaagtagactgtatttcttcaattttccatatactgcaaatggcaaggtgccctgttcaataaggaaacaaaggcacaccctgccactatacaccttttccatccatcttgttcctttacactgccaagacactccattccacctgactgccccagccccacccactttctccttatttctagagtacaggacataaacatctttgaatctgcaaataatgtgaataattttcctcaaaaatcaagctttcatgtttgaagaagagtttattgtgacttcaaacataagctgtaactggtaataagcgaagcagctatggaattatacaaggcaatccaatcaaacaacatggagcacactgaagcgcaaacatcaaattttacctttttcctcctaaaaactttattccctaattacatccattactttctttctttgtttctttctttttttttttttcttttgagacagagtctggttctgtagcccaggctggagtgcggtggtgtgatctcagctcactgcaacctccacttcctgggttcaagcaattctcctacctcagcctccaaagtagctaggattacaggtgtgcaccaccacccctggctaatttttctatttttagtagaggcgaactttcaccatgttggccaggctggtctcaaactcctgaccacaagtgatcagcccgacgtggcctcccagagtgctgggtttacaggtgtcagcaaccgtgcccagcctacacctattattttctattaaaaataatgtttttcaactctgtgtggtccaataggaagaagaaatacacaaaccataaacaataaatacaaatcaagagcagggccacgtcgaattacttaaaaaaaaaaacacacgggctgggcgcggtggctcgtgcctgtaattccagcactttgggaggctgaggcgggtggatcacctgaggtcaggagtttgagaccagcctggccaacatggtgaaaccaagtctctactaaaaatacaaaaattagcccgtcgtagtggcaggtgtctgtaatctcagctactcgggaggctgaggcaggagaattgctggaacccgggaggcagaggtggcagtgagccgagattgcaccactgcactccagcccaggtgacaacagcatgactctgtctccaaaaaaaaaaaaagctttttttttcccccctcctaaaagaaagactacaggttgagtatcccttattcaaaatgcttgggaccagaagtgtttcagactctgtatatgtttggatttgagaatacttgcacatatataaaatgagatatgtgggggacgcgacccaagtctaaacacgaaattcacttatatttcatagacgccttctattcatagcctgaaggtcattttatgcaatattttaaataattttgtgcatacaacagtttggactcatcacatgaggtcgggtgtgggattttccacttggggcatcatactggtgctcaaaaagtttcaaattttggagcattttagatttaggattttcagattaggggtgctcaccagtaagtgttatgaaaatattccaaaatccggctgggcatggtggtgcccacctgtaatcccggcattttgggaggccaaggcaggtggatcacctgaggtcaggagttcacaaccagcctggctaacatggtgaaaacccatctctactaaatacaaaaaaattagccaggcgtggtggcgcatgcctgtaatccgagctacttgggaggctgaaacaggagaatcgcttgtacccgggaggcggaggttgcagcgagccaagattgcgccattgcactccagcctgggcaacaagagtaaaacactatctccaaaaaaaaaaaagtattccaaactccaaaatcaaaaacacttccagtcccaagtatttcagataaggaatattcaacctgtatgaatgttcctagggaaaaaaagacagccaaaatataagaccatgtataagaactaacttcagtagacagaaagaaaaaagtaccaggggaagaaagagaccgcattttaaaacaactatacaaatttgagctgtaagaaacactgacattttctataagcatgctagagcaaatgggagaaattcataagacgttttctagaaaataaaactaatataaaaaaacttatcaagatttgtcaaggaaaaagaagaaacgttaaatataatggcaagaaaacattcctaccaattttatttatccaggcatgtcttaaatatggctgtttgttacatacagtgattctgcagacatgttgacatgacagtgaaatacataaatatgtaatgagaaaaggcttaactgtggataaaacaaagtcattacaattaaagactcgagtttttggcatttccagttgtagtcagggcactgaggtcaaatttaactacaaattttgcattgtctacattgaacacatgattcttaaaagcctcatgttttatttcagaacaggcctcaggaagttgcagactgtgcaggaggttgtttagggcacaagtcatttctcccaatattaacttataggcagtctccaaaacaggaatattcttcaagctgagcattgcttgataaacagcatgggctacagcaacaacctgaaaaacaaaaaattcaaggaagtgataaatggaaaataaatcttctaaaattatatggaaaataaatcactatctgtattagtgctgatgatacaaataaatttaagattgatcaattcactgtccgtagcacttaatattttaatttttaaaaaaccaatcagaaaactgacacagatcagtaagctatttcaaatctattaagttttatcacaaataaagagtactataaatgaaaactgtcaataggaaatttccaaaatggccgtttttttttttttttaaataatcaacatcaaaagacatatgcaaacagcagtttaagactgggtttcttaaatctaccaggaaagtctgtggtggatttgactagggggtggttgaaaagccagtcatttttgtttataaaatatacagtacttaatttataactttataaatgtgtcaacttgttttacccttatgaaaatttaataaatttaataacagcaagagatgcataatctgaaaagagtatctggcacatcattcatgaaagtattcagtatgattatcaagaaatataaatttaaaagaacaaatacaatcactatattctaaatcaaacatttcacatttcactcaatttcacttatatagcctggtaagcaacattaggtccaactcttcagtgactcaagttgtcaaaattcattatcagtatattacttacctctttttctttatgataacgcaagaatagtagtttagatgatggtataaacagtttttctacaaatgatgatggcagtttcgtatttatctgttcaacaatctaaaagaataaaatttttaaaaaatgagcttctcaaattacaaaaagacatggagaaaccttaaatgcacactggtaagtgaaagaagccaattgaaaaggctacatactatatgactccaactacatggcattctggaaaaggcaaaacgatggagacagtaaaaagatcaggggttgccatgggcttaagatggagggagggaggagtggggagagggaacgaggaaggagtgggtagaacatcaaagatttttagggaagtgaaactatcctgtatgatactggtaataggggatacatgtcattacacatgttaaagtccatagaatacataacacaaagtaaactataaaattagttaataataatatatcaatattcactcctttgtaataaatgtaccacactaacacaatatgttaatgagggggaaactgttgggatgaagaaggtatatgggaactcattgttttctgctcaattttctgtatatctaaaaaataaagtcttttaatttagaaaaatatatctaagctatattttaaggccttaatactgtgacattaaagtgtttagacacctaaataggacacacgtattttacagttatcatgggcattttttcacattagcaaagagaggtgtaaatctggcagaaatgctcagcagaatgtcatctagaatttgctttaaaataatccagctggagatgaaaggatagcaaagaggcctagatgaaaccagatgggccatttgtttctaattatagaagctgagtgttaaatatgtacaaatttattataccatgctccctatttttatgtgcttcagaatgtccataataaaagtggggggaggatatttatggttaagaaattaaaggaggccggccgggcgtggtggctcacgcctataatcccagcactttgggaggccaaggcaggcagatcacgaggtcaggagatcgagaccatcctggctaacatggtgaaaccccgtctctactaaaaatacaattgtgccactgcactccagcctgggcaaaagagcgagactccgtctcaaaaaaaaaaaaaaaaagaaagaaattaaaggaggccaggcatgattgctcacacctgtaatcccagcacttcgggagggcaaggcaggaggattacttgagaccaagaatttaaggccagtctagacaatgtagtgagaccccttctctccaaaaactacaaaggttagccaggcatggtggcatgcatctgtagtcccagatagtcgggaggctgagtgggagaatcacttgagcccaggagtttgaggctgcagtgagctctgattgtaccgctgcactccagccaggggaatacagcaagatcctgtgacaaaaaaaaaagaaagaaagaaaagaaaagcaaaaaagaaagaatctggtgcatagagcaatgtttcctcagaaaaaacgagtaaagctacactgagactagctatcaaccactaaaaatagaggcctggcagagtggctcatgcctataatcccagtactttgggaggccaaggcaggtggattgcttgagcccaagaattcaagaccagcctgggcaacatggcaaaactccatctctacaaaataatataaaaaattagccaggtgtggtggtgcacgcctgtagtcctagctacctggggggctgaggtgggaggatcacctgaacccaagaggtcaaggctacagtgagccaaaatcatgccactgcacttcatcctgtgcaacagagtgagaccctgtctcaaaaaaaaattgcattaaaaataaaagtaaatagacactaaaatgaaagcatagattataagactgatgaatgtactctaaaaaataatataataaagcaaagcccttattttttttcttttttggagacagggccttttttgtcaccttggctgagtgcagtggcacaatcagagctcacttcaacctcaagttcctgggcttaatcgatcttcctccctcagcctcccgagtagctaggactgcaggtgcacaccactacaccaagctaatttttgactttttgtacagatggggtctcactacattgcccaagctgtgccagaattcctggatgcaagcaatccttctgctttggcctcccaaagtgctgggattacaagcatgagccaccatacccagacaaagtccttaatttcttacatatcgatttaagggcctgaataaaccaacacattaaaaaggaaaagaataattcacataccagcgtgagtaaattcaagactgagatgatataattggtaccacaagtctggcaattctccagttggtctaatccatatgtaatgaccatgtcacaatgtatagtcatgctaggatccaagctgccgagcaaaacaccaacacactcattagcagctgtcaacacagcctcagaaaaaaacacctggtttgcagccgtcacacatctcattactctgtacagaacctgtaaatggggaaaacaagcagctttttacaaaaattcacgtgcttccacaaagcaagaaaatactttttatttaatgcaatttcaactgaaaattaactgcttgccttgccagcagtctcttaatattctagttctcagtagctgaataataatgatccctttactacaatatgtaaacatgatcttggctaaaaaatcctaaagtgctactatgacaggaaatggaacctgccatcctctatttcccatatacccaacttcgtttctcccaatgtcactaaatggctgaagctcagaatctttatcatgaaatacaccacgacagtaatggtattgacagcatgggaatagcctgcccacacatactacaagctagctcttgggcttttgggaatcaatctttcaaaactgaacatacaagtcactttaagcttattaaagtttctatctactgatggtctcttttgaaagataagcactctcatgcttaccacataatatcttcaaaaatcatattatttccaatacacacacaaacaaaatcccccacttaactataatggccaataattgtgtactaaatttctaataaaatgggggagaaaacagagcaaatgtttaaaaatatttctataatatttaacaaccaatacatacaggattttatttagtctacccatagttttcattaaaagtatccttggaggttgggcatagtgactcacatctatcatcctagcactttgagaggattagctggaaggttctcttgagtccaggagtttgagaccagccatgtcaacataacaacacctcatctctaccaaatttgtttttaaattagttgggcgtggtggctcacaccagtagtcccaccaactacttgaggctgaggtgggaggatcacttaagcctgggaggtcaaggctgcagtgagccaagatcgtgccactgcactccagcctgggcaacagagaccatgtctccaaaaaaaaaaagagtgggggagagagggcggagggggaaccattcttggccatgcatgcacagtggctcatgtctataatcccaacactttgggaggctgaggtgggaagactgcttgaggccaaaagttcaagaccagcctgggaaacactgagaccccatctctacaaaaataaaaaattagcaggagctgtggtgggaggatcacttgagcccaagatacagaggctgcactgagtcgtgatggcaccaccccactttaaaaagaaaaacaaaaaaagctgggtatggtgacacccgcttgtagggctgagtgaatgggaagttcacctgggcccaagagttcaagactacagtgagctatgattgcactactacactccagcctgggtgacagagtgaggctccagctccaaaaataaataaaaaaaataaaaaccccaccattctaccattctcaaaggcctaaaagatcctcataaatcaatatacacctatcctataaattatgtcccttttattttatgtctgaattaacggctttttatttcaactctgtacagtcttcaaacaaccaccttttagacattaaaaatgaagcaaagatattaaaccattttgaaaccatattggtttaaaataccaatatgctggtttcatttatctttaagttctgacatttctgctcaagtacacaacttactatataatcaatatcctattttatttagcaacatgttcagcaaaagtatatgctcctaaaagcgagttttatcctaacagtaaaattttcatcagttagattaaattttttatgactgtatcacacatgcttctttctccttattcaaagcagagtacaatgcctggggttcacttcttgtgtcttttccactgaaccctcattggatgtgctatatacagtgcagctaatgtttgaggctgctgaagtgtggcaatctagctacctcatttttaatttgtttatgttctttgatatcaggctatcaaagaatataaagatatacaagttttcatatgagttccatcttatgctcagagaaggttactttctgaggcttctcctatagtgtgctattcgtaatatgttgaaaaactaaaaggaaacccaataatttaaaagtaaaattataagatatattatttaaaaatgaaagaataagatttaaaaattcagagtggccttttgtcatgggagggtaggggagttggatgaaaggaggatgagatataacaggattccctgcttttctggttatttaagaaagcagtcagacaatatatacatatatacatacatacacacatgctaaacaaatgaaggattaataacagttcacctggtaaagagaatcatttacaatgtaaaacaattttatttttgaatgacacttcaaatgcccaaaagcacttacaactgttacgtatgcctcagtaattggaggacccgaattgggctgaagcgttccccaatgctcctcagcacagtactaaatacccggagaagcgcagccagctttggtgatgacactgatggaggagggacgtcttcatccactgattccccagaggccacatggctgaggtcctagatgtgaattcacagcattcttaataagtagtacattgtttaaaaaaaaacaaaaaactctaaaatatttcaatcaattcattttagaatagatttttaggcttttagaaagagaactgtggcccatgagaatattcatgactctgaatataaaaatgggttttacctaattatttcaaaaagccaacattaaacccaatagacaacaaattaaggaaataatctcttaaatcaactcagaaagctgttggggaaaaataaattctagcacatatgctctagttatatgtaggtataaatgaagacggaagcttttgccactcctgaattagtttttggctaaaaatctcattctaggtattctttgagccactcagctcaacagtaagtcctccaaaccaagagcatgcacatgaagagcaaagggagattacaagacctggtctacagatgtgtaactgaagaagtacgatatatgaaaaggacaagattcgcaaaaactaggatactagaaccaatgtatacatctacctaaaattaagcaccaaaataacagaagagaatgagatcttaaggataacaaggggaaacatctctacaaactagaatgtgtggcttatgagaggtagatcagctttaaacgtgggctgtgaaaaaagacattctaggtgtgggggcaaagaaaaaacaacgcagaagcaaaacatttccttgcttttctaggaaagagtaaacacatcagtacagctaaaggtactgaattcctgttgactacaagcagcaaagatgaaaaaaacaagatgaggccaaaatctttatgggagccttgattggttgatctgaataggggagaaacacaaagagattcagataagagatggcacagagttaagccatgacagtgcggccagaaaagccaagtaccagtaacagaggcttcagcagcgctcttaaagctcctatgctatattcgtacagccacaaaagctggctgaagccaaggcttgtcctccaaagtacgattcaagttctcctgtacatatgtaagaggaaaatctttaggagcttttggtgttttgtgtttttttataacacaacatcaatttgctttaagactctgaagactggggacaaaaaataaaaataaataacaaaaaatgtctttagaaaaataccagctaccaagagtatgtaaagctttgcgaaatacgaagcttgcaacgtttcttttagtctctccagtaattctcctggtaatttaaacacatctgaaataaatgtttaaaatactgactgggcacgggggctcatgcctataatcccagcactttgggaggccgatgtgggtggatcaccagtggtcaggagtttgagaccagcctggccaacacggtgaaaccccgtctctactaaaaatacaaaaattagctgggcgtagtggcgggcacctgtaattccagctactcaggaggctgaggcaggagaatcatttgaacccaggaggtggaggttgcagtgagctgagatcgtgccattgcactccagcctgagtgacagagcgagactccgtctcaaaaaaaaattttttttcaaaatattgcgatgggcttgtaatttctgcttaaatgtcaggaggtctgagccattttaaaataaatctagcacaattttaagattttttcttaaccaaaattttaagaaacagctttctatatactcacctcagcatatgcttccatgtcttctagaaactgaccaagaagagtcgtaggaaatgcaagatcagctacccaaaatggctccaaactctgcaaccacccttggaatcgtataagaaattgtgaaagggtaggggggagaaaaaacaccaaaaaatccaaattaaaaaaatataagaggctcgttttaaaaagtatctggttttcaagcagcataccctaaaacatgtcctatatcataaaattaagactgctaaacatgctgatcacgattaaccaatacctctttaatacctctttaatttctgcagaaattaacttgtaaatgttatttccttactttttcagtaaatttcatatctatattgtcactacacatgacttaagactaaaatgccacaatctaccattggcctggctaatcccagggccacatctaaccattaaaggtgtatactcatctcctcagtgaaaatgaaacagaccactatcacctgaatatcctattttcaaaagtttattacaccaagtaagttacgagaaactatgacacttgaaacaagctgaaatgtgcaaatgagccacgctagtcattcacttaaatccaaaaaaatgggaaacaaaaccatttctcatttatgacaattctccaaattaaccctatatttccttttttaaaaaaataaccagaaaaacaataaaatgtgacaaataacttggatcttccattgtccacttcagggtattgccactgcaatatattcttaccatatactttcctaccagtacaaactacaaataacttgggtaagtcctgtctgtacttactctacccacctactagtaatttcctctgaaaatatatatttagctaacaagtcacgttcatttacaataaaacatttctctgaattagttttcttgcattattaaagaaatggtattggccgggcgcggtggctcacgcctgtaatcccagcactttgggaggccgaggcgggtggatcatgaggtcaggagatcaagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaagaaatggtattgatagatggtcactgggggaccactgctcctccccgacagtatttaaataactggtataggctgcaagacttaccagatacctgctgcgtgagcgaaggtttctgagtatgatctctatgccatccaactaatatatcaactgtatccttgatggaaacaaagagagagggggccaatcattttaagatattactgccattcacctgtggaccatttcacagcaaaagatcctaaaaggagcatctatgttctacctacttgacattctagaaacttagaaaggggagaggggcaggaaaataaaagaactacatttctgacaacaatgaaatagtttattttcttcaaatattttaaggtacgaacgtcagaaagaaaaatgcggcatttaaccctggaacctcaaatatcactgattatattcaaaggagcagaggcattgttttccatctgattcctcagttcctcacacacacaaccatccccctcaccccatgatctgaacaacggaatgaggaactcaccctaaaattagcgctgaaaatatgagggtaacatcgagccaccaaaagaatgcacttaacacatttgcaaagcaattctggtgtatccacattttcaagaattgactgcaggctggtcattacaagcttaaaaataaaagttacaaaccgtgaacattcaacaaaatagggagaaaacaagcaaattaggttcattatttactgactacataaaaaactgagtatgagaccaagaaaaatagattctgtagttttagttaaaaaaaaaaaaaaattcacttgtaaatcccaactgcttgggaggctgagacacaagaatcgcttgaacccaggaggcagaggttgcagtgagctgagattgcaccgctgcactccagcctggacaatacagccagagtccatctcaaaaaaaataataattaataaataaataaataaattgaaaatatttcgctccactaagatgttaagctaaaaacaaatactgctttctcctcttcaatgtttgttaatattagtcctttgacatcagttaacattagtccttaataacatctgtttacaatatccctaaatgctctctttaagattctacctgtgattaaatttcaaatacaaaaaagtaaaatggatttgggaaacttttctataaagtacaacaattactttgcaatccaaaatataaagcaaattttatataatttatgctttagtatattagtacttgcttcatattaaaattaaagaagatcagtatggcaccacacatgaataacatgcaggctcaggttaccattatacataaatttttaaaataaatatatggcaaaaataaaataataaataactatttgtcattccattgaaagaatatttattttgcagctgttaaaaaacatttttccctaaaaaaggaaaagctgcgctttacatagcaatcttataaaagaaatgctagaatcagaaaaccatcattttacgctgggtgcagtggctcacacctgtaaccccagcactttgggaggacgaggcaggtggatcacctgaggtcaggagttcaagaccagcttggccagcatgatgaactccgtctctactaaaaatataaaaattaacagagcacagtggcacatgcctgtaatcccagctactcaggaggctgaagcaagagaactgcttgaacctgggaggcggaggttgcagtgagccgagatcgcgccactgccctccagcttggacaatagagcaagattacatctcaaaaaaaaaaaaaaagagaaaaagaaaaccattattttgcaatagccaatgttataatctacacaggcacagactatcaatgctaaaaatcatttaaaagacatcttaagggtaattacagaaatttgaatatagaacacatatgtaataaaattcattttcttaggtatgattacaatattcttgttatacagaagaaaaaccttattcttgggagatgcatactaaaacattatggggtgaactgtcatcatgtatatggttttcagatgctcaacaaaagtgtgtgagaaaataaaactgtggcaaaatattagtaactggtaaatctaggtgaagcatatattatgaaattattatcgtatttacaggtatttattttactggtgcatctatctttctatgaatgtgagaattttcacaagagatgggaaaatgttcataattatgcatgcagaataagcccaagctggtggcattctgttcagttacaggtaattttctgaatcctccctcaaatttttctcaaacctctataatcaagggggaaaatgtttcgttttgttttgcttttttgagacagggttgcctataatggagtgcagtagcttgaccacagctcactgtagcttcaacctcccaggcacaagcgatcctcctgcctcagcctccaagtagctgggattacagatgcatgccaccacgcccgactttttttttttcctttttttgatagaaacagggtttcaccatgttgcccaggctggtctcaaactcctggactcaggcaattcaccggcctcagcctcccacagtgctggggttacaggagtgagccaccatgcccagttaaaaatacattttttatttaaaaaaaaaaaaaaagaacattccttatatttcctttatattttttaaactacatacccaaaataaagcatatcaaaaactgtattaaaaaaaaaaccctaatatcagatattccaaacacaacaataccataatttaatcacttaaaatcttactcaaaactaaatcaatgatcttttaggccaggtgtggtggctcatgacactaatcacagtactttgggaggctgaggcaggaggatcacttgaggtcaggagttcaagaccagcatggccaacacaatgaaaccccatctctactaaaaatacaaaaattagccaggctaatggcacactcctgtaataccagctactcgggaggctgaggcaggagaatcgcttgaacctgggaggcagaagttgcagtgagccgagatcatgccactgcactccaggctggacaacagagcaagactctgcatcaaaaaaaaaaaaaaggaatgatgttttaatatattcagatacacaaatgtgaaataaaactaagtagagctggtattcatttacacataattatcttataccatttggaataagaatttggggcacgttagcaaaccaaaaggctcagaaagaagttgtgatatttagttcttgtctccctctacaaatgtgaagcactcttctatccagcattcctagtggagttcctattttcaaatttgcaaatcattctggtcctaagcaatctcaaaaaaacatttctaaaaaccaaagaggaaaaaaatccttttttttttttttttttttttttttttgagacagagtctggctctgttgcccaggcaatggtgtgatctcggctcactgcaacctcggcctcccgggttcaagcgattctcctgcctcagcctcctgagtagctgggactacaggcacgtgccaccatgcctggctaatttttgtattgttagtagagacggggtttcaccatgttggccgggatggtttcgatcccttgacctcatgatgttcccacctcggcctcccaaagtgctaggattacaggcatataggccaccgcgcttggctgaggaaaaaaatcttaaaactaacttatttcaaatctaacttcaacgtgtatctttttttttcttttgagacagagtctcactctgttgcccaggctggagtgcagtggcgcgatctcgactcactgcaagctccgcctcccaggttcacggcattctcctgcctcagtctcccaattagttgagactacaggtgcccaccaccacgcccggctaattttttttgtatttttagtagatatggggtttcactatgttagccaggatggtctcgatctcctgacctcatgatccgcctgcctcggcctcccaaagtgctgggataacagacgtgagccaccgcacccggcgtgtaagccaatttcttagaagaaatctctccctctttctccacatatatgcatatatgtatgtagcactaatccttgaacagtgtatcctttactcaaactgagaaagaggaatttttaaaacatatttcctatcagtagataacccctattctatgtttcccttcttcaagctcccctccaaggacatgtgttaagggacaattttcttcccaagtacatcatgcatttttcccccttcattcttacctgcattacagatgaaaaggctttcttttctcctacagtctctagtgctttgtaggtggcacataagtagaggagtttaacttcatcttttgcagatgagctaaatttgctaaaaatccacttgaagatcttctcagcctcatagctcagagaagcacaaagaaggccaagacagcaagctccctcctgtctcaactcctgaagcaatttgctactgtgtttattttaatgcaaacaaaaaacacacacaaaaggcttaagttttctatgatgacacgagtaatacatcttacaaaagaatgtcttaagtggttttttaaatttctattcaaactacataaaaggttgaaattttctccactctaaatactacattctgtctagcctgcattgccctcaagtatctgtctgacattactttctttttacaaaatcaattatttacaaacagtgagggaaggcccaaaaatgctaaattccatctcaaactgtattaaataactctcagaaaagggcagcaacaaataattagataaaacactctatacataactacattctacataatatccaatatgtaatgactataaaataaaaaatggtaatagttaaatacagaaacttaaaaggataacagtaatgatttacatagaactttaataagtaactctataaaacaaaaccatcaaaaggcactaaggtttatgaccagctgagataaattttgggtacttgccaacactgcaaatctttgggaatcaccataacaaaaaatgaccacacacctctggagacgctaatagccagagaatatatggtttggatccactcttacccaaagaaggaaattcctttttacctctattctctaagcagtttcaaattctctagtttacaaaaactaattttattcttcatgcctgcatcaagagtttatgccattccataagtcaagactcagttatccagtgagactagtaaattaaaaaaataaaatattccagccaggcacggtggctcatgcctgtaatcccaacactttggaaggctaaggtgggtggatcacctgaggtcaggagttccagaccagcctggccaacatggtgaaaccctgtctctactaaaaatacaaaaattagctggcagttgtggtgcatgcctgtagtcccagctactcgggaggctgaggcaggagaatcacttgaacccgggaggtggaggttgcagtgagctgagatcgcaccactgcactccagcctgggcgacacggtgagactctggctcaaaaaataaatattcttttcaagtggattccatttgtattcaaccgtaattaacacataattaatgcagataaaaatgacaagacccactgaaatgtcaatagatgttcataaacaaagccagtgggtttgtcttcttgtgtattgttaagtaatttctaaaaatatattttaaagtcatttaaaccgaaccattattagttacttacctttcattaagcacatcatgtgcagcagccaagatattatccaattgtttaactagtacctttaaaagaaaacacatttataaaaacttcaaattcctatacttttaagaatagcattgtgtacttttttacttgtcttcccctccaaattctaattcaacagtactttactttctttattattcccactccccaatgagcatgtatcaggaatgtcatgtttcctttcagcctatgaaagaaattcacccactggaaacatagagctgtgatcatcaacaaaaaaataaactcaaaaagtttgttttatttactttgaaatccatttgaaaaattgactgatggatggagggatagatggagagatatgtgacaaggcagtatttagggcaaaacattaacgacaaaaattagatgatgggtttaacagattcaatgtcaaattctttcaacttgctatatatttgaaactactcataataaaatttggaaggaggagaaacttgctttgatccaagtgtcatctgcctcactagaccattttcattaattttctcctgctcattgtcaagttctttttttttttttttttttaagatggagtttcactcttttcgcccaggctggagtgcaatggcgtgatctcagctcactgcaacctccgtctcctgggttcaagcgattctcctgccacagcctcccatgtagctggaattacggtcatgtgccaccacgcccagctaattttgtatttttagtagagatggggcttcactatgttgggcaggctggtatcgaactcctgaactcaggtgatccgcccaccttggcctcccaaaatgctgggattacaggcatgagccaccacacctggcccatatcaagttcttaattggtgtaaagaaagtgaagaaaaaaatttaacccttcctatactttgttacatttctgttgttgttttaagagacaaggactccctctgtcgcccaggttgacatgcagaggtgtgatcatatctcactgcaaccctgaattcctgggctcaagtgattcttccacctcagccaggtgtagtggcacatgcctgaagtcccagctactcaggaggccacagcgggaggatagcttgaatccaggagtttgagactgcagtgagctatgattgtgccactgcactccagcctgggtgagagcaagatcttgtctttaagaagaaaaagaaattacatattagagagcattaagttcttgatcatcataatacagactttccccattcttaaactactcaaggtagcattacctagtttattatggaaacacaaaaatcctcatatttccaaacatactatacttaccagcttattttctggttgctgaataaattctttcaactgctttacagtgaccaatcttcagtctctgtcgtcttcccgggtgatcctccgaagaagatttgacagtcgagactcatcacaataagacatcgatctctctgtgaatatataaacattttgttgtccattgagtataaataagcaaaggaatttttaaattttaaaataatttttaaatttttaaaattaaaaattatttaaataataattaaattattatggtggctcatgcctgtaatcccagtactttggaaggcgggtagatcacatcagttcaggagtttgagaccagcctgggcaacatggtgaaaccctgtctccacagacacacaaaaaattacataaactagccagccaaggtggtgtgcacctgtagtcccagctactcgggaggctgaggcaggagaatcactggagcccatgaggtggaggttgcagtgagccgagatcaccccactgcactccagcctgggtgacagagcaagaccctctctcaaaaataaaattacatcaaaagtcacagtccactggtcaataaaagctcagggaatataggtcctatcgctcttttgttcaactctatattccaaatcccagcagagtgcctggcacataacagaccctcaaaaaaatatttgctgaaggaaacgagaaatgaataaccctaggccagctgaacacctcattccagaggactggctgggagagaaaaaagaaaggccttagtaacaacttcctttgggtccattccaaactgttttcaacatgcaggtaaagagcctgggtgtaggtaaattaaacaacttccaaggggtacggataaagcctcaatcgagtaaaaacaggatataggcttctacttatcatctaggtatcccactggaggaaagcctcttattcacattatcatcatttccctgggatgaagttttggggagccataatcacacatttagttcaacaaatgtctaattatcatctaccacatgcaaggcatgcctccactagaaaggtagcaaaccacaacttttctccccttattttttaatcacaagaacaagcacacaatagtgaatactattagtatattaacaatgcctttaaaaactagatttttgctgggcgaggtggctcttccctgtaattacccagcactttggaagggcaaggcaggcagatcacttgagcccaggagttcgagaccagcatcggcaacatggtacaaccccatctctacgaaaaatacaaaaattagctgggcacagtggcacatgcctgtaatcccagctactcaggaggctgaggtgggaggatcgctttagcctgggaagcaaaggttgcagtgaaatcacactagtgcattccagcctgcgtgacagagcgagactgtctcaaaaaacaaaacaaaacaaaaaactcaatttttgcaaaacattttcaactgtgctatttaccataattagccaatacatacgtaaacaacaaatcacaaagggtctgacagtttcatttctaaggtatgagaaaaaattgataataaaagaaaccagaaggctgggcgtggtggctcacacctgtaatcccagcactttgggaggccgaggagggcagatcacggggtcaggagattgagacctgcctggccaacatggtggaacttcgtctctactaaagatacaaaaaattagccgggcatggtggcacgctcctgtaatcccagctactcgggaggctgaggcaggagaatcactttaatctgggaggtggaggctgcagtgacctgagatcgcgccattgcactccagcctgggtgacagggagatactccatctcatagataaataaataaataactacaaggggagcaaaacacactggatccttttggagggtggggggtgggaggagggagaggatcaagagaaacaaccaatgggtaccaggcttaatacctgggtgataaaataatctatactacaaaccctcatgacacaagtttaccagtgtaacaaatctgcacttgtatcctgaatttaaaagttaaaaaaaaaaaaaaaaaaaaaaaagaaactacaatgtctgagagaagaataggatttttacaaatccgtagcccatagagtatttcaataaggacagataccaaaaatgtcatcaagttaccagctgggaaattaggctctacttacaattctgtcactagcaaactacctttgaagaagaggaattgtttactgaactactttagagtcactgtttagcttctataatatcataagtctaaggcttcaaacactctgttttaacaaacagcatacatagcctttgaattcattccacttgtgaaaacataaaaagaaatcagttttttaaaagttatataccaacaataaaagctacaggcacaaagattttcaccaagatacacgaagcacacacacagtataaaaaaaaaaaaaagtcaaaaactaaatgtccaaaaagtaattacatctgacaaagcccataactcagctttaccgataaatttctctttaaggaaaaaaattatcattacctctaatcctctgaactttcttttttgttgttgtttttttgagacggagtctcgctctgttgcccaggctggagtgcagtggtgcactcagctcactgcaagctctgcctcccgggtagctgggactacaggcgcccaccaccgcgcccagctaattttttgtattttcagtagagacagggtttcaccgtgttagccaggatggtctcgatctcctgacctcgtgatctgcccgtctcagcctcccaaagtgctgggattacaggcgtgagccactgcacccggccaatcctctgaacttccaaggcactcacctatacagtgaggctacgccataaggcagaaatgctatcagtgtatttaactttagaaaagtgcccactctaggcagggcccagtggctcacgcctgtaatgagcacatgtgatcacttaaggtcaggagttcgagaccagcctggccaacatggtgaaaccctgtctccactaaaaatgcaaaaatcagctgggtgtggtggcatgtacctgtactcccagctacttgggaggctgaggcacgagaatcacttgaacctgggaggcggaggttgcagtgaggagagattgcagcactgcgctccagcctgggtgacagagcaagactctgtctcaaaaaaatatattgaaaacaacaacaaaaaaaccagaaaagtacccactctagggggcggggggaaggagagcatcagcaagaatagcttaatggatgctgggtttaatacctagatgatgggatgatctgtgcagcaaactatcatggcacacgtttacctacataacaaacctgtacatcctgcacatgtaccctgaacttaaaagagaaaaaaaaaaaaaagacagaaaagtaccccctctatatatatatctatatcctccacaggcccaagagttcaaggacttgctgtagtaagagcctactatgcactatacattcaatatccacgataattgggtaaaccttttctgtaagatcttatccagtcttctaatcttgttttaagagaattctcttttaaaatgtactataacctttctagtgggaaattaacaattcacaggaaaagaatgtaaacaatttttacctgcacagtagactaatcaacttatgcctgtgcaaggcgttagtaagaggcatccagaataagaggagatacaagtctttggaaggtgtatgtgattggtccccattttcccagacttaccctgtgatttcctcatgtctttggtggctaaagcacgactgccatgctgaacactggtgaactcagggctggtcacattgttaaccctcagctcttgccccaacgacttccgaccataagtattttccccagatcctccattgacactgtagccacctacaaacagcaatgtgtacgttatttaaatatgattgttcgtttcattcagtcaatttcctgatagctcaggatcttactactcaatctgcagctcaaccagcctttgcttctcctacctttttcctgtactgtctgccttgaaaatcattttcatttcttttaatacacctttgaagttaaattaattttattttgatcccttcattggaaaataagcaaagaaatgaaaactaaattaaatcaaattttgcaccttaaaactttcttgaagtttagagacagtagccaagaggaacttcaaccttagctaaatatttttgaaaataaaaacaaaaatagtattgtatcttttttgtaagaaaactgcattgatgaattatgtacggaaaaattttaaattttaaaaataataaagtggataaacgtcctatgaagttttcagaaataacactgcatttgttattcgtattttaaatatattagaagaaagcgagaaagttgggggtgtaagaaggcaagaaggtgggataggtaggttcaaaaaacatgcttgtagcaataagaaaatatatatacccttttcgtcattctgtatgtcagcgtggactctggtatcatcgtgcctttgccgagacaccacagctgaatttgaaggttgcagtccgtaagaggaagaaccacctctatctctggatgaagaatattttaaattacctgggtcagctgatgcactatcagttctataaaaagagaaaagtttaagattagaactttaaataacataaataaatctttctttaaacaagcctctcttctcccaaattttacatttaaccattactattgtatttaatgtaatatgtactatatattatatgtaagcactcagccgtctaataagaagtctttcactgggaagagattctcaatggatgaaatgccaacttttcagtctcttctactgttctaaagacccattcagaaatacgaataactactgggattagggtgactttgctggttttagcattgaaagcctcctgtcccaggcaaaacaggacaattggttactctggtccagtgttctcctcacatgacttgataataagaataattctttctaaattctcccccatggagagggttaatcagtcaaaacatttcagcctttcctatcataaaaataaaaaacactggcagcatgtcagggacaggcaatgtcttaccaagttattttctaagtactgattaggtactgtagtattgaagaccccattgaagatgccttaattgtaaaggtagcaatcaaaattttaaaaagtaaaaaagaagacattttaagaaaataaaaggtatcagaaatgcaataacgttatatcggaaagttgtagttcataatctatttaaaatttaggtactgtttagaataatacctgatgcttattagtaaacaagtagggtacagccaagggtaaaagtttgtcctcatctaagtatctgctctacgcttcaactgcctcataagtaaaacagagctgagttacaagacttctcacgagtgttactctttcagccatcaatcataaactattaagaaagaagacaacaaaataatctgttatagcatatgaaaaatccaagtaagttcttcccctactgattttctcctgagaggaacaactttgaggaaaaaaaaaaagaaaatcacttctatgatatttactaaaaatgctttctcaaccttttagaacctgaatcttttagaaaagtttaggacactggcaaggccagaaactaacctattcctctacgctttgcccctctatggtgtaaaagtgacagcagtgtttgtatactgtatatatttcatttagagtttattagtctttccttgctcccaaaaatactaaacataaaactttgcatgagctcaatcagttggacaccttgatctgcacttactgcaatcactgttaatacagaatgcagacaataggtccaattaaacttggatatctaactggtacaagtcattacttacaaaggatctcaatctgaaacttcatgaaattcaaaacctagcatactaaaatgactacggctccataaggagtaccttctaatattcagagttcgcttattcataaagctaagtacttcgaacataagggaaaattaaatctatggaatttcaagaaaaatgtatgagaatattttctgagtatactaagtctataagcattaaaatattaactcaatggaccataacttttttaaactaatgaaaagacattccttatgtacctaaaaatagcacatttaacatgcgtctatataaatcatagcataccattactttctgaaaggagactgaaatgtaagagagcttataatcttttctgacagggtgtgaactttatatgtacgccacagtaagctcttattagatgagcaaataaaataagcacttgactaattcagaaacacaaagataactgaagtctgccaatatttaaacatatcttcacttcctgttttcatcatgtttacttatctcctatactacctttactattaagagttaaatgtttgtatcattttctggtgacacagtagtaccataaggcagcagagaatacaagttaaaaaaagatctgggctcaaatcccagctccagcactgaaaagtatgtgtgcctttgcacaaattacttgatctccaagccttggttgtctcttgcataaaatgaggatgatacctatctaacatgtaaggttgttgtgaggcttaaataagataatgaattataaagaaacacttagtttgcagggtatgttaaaagttattatgaccataatacaaaataaactcagtttccagtctaaaagacaatgtacaaacagttcatgagtatatgaatataatcaaaacaagtttttacagtcaatatagagcaacttaaatacttcactgaagaaagcaggtaatctgtggctaccaacaatgtgtttccaactaggaagcatctgatttcaaactaaactgtaaaaccaggagcagcttccccattggttagaaataaggtttctaaatcccctaagttatgaacactgagatttttttcccaaaaaaatttgtgttttcagaaatatagcaaaaaaactggaatagagccactgtctcagaaatacctgaaaactccctagctgccaaattattttaatacaaattgatcaaagcatccccaaccagaactcaggttgtaagcattctgaacctaaaagcacaaaatggtttagcatttatacgaaatttctatttttatacaatcttgactgcttaggtttcaaaaaatgtcaatgtcaggctgttagcaccaacaagatcatcccagtccaataaatagaaaactgttaaagaacgggaatgagaacttaaaatgaggcaatcaaagccacaaaatagaaactgcagatttgaactccaagaagcaggcatgaatgttaggctagttagttagaagagctgaaagggatatcatctgccagaattagtgtctcaatttagtgaaaaaagaaaatctatctgttaagtctaagaatcctaacaaggatccaaaaatacttctacagcccctttaatattctaaaaatatcatggagagaaaaaaaaagaaatgcataaatttccccaaaacgatcaaactaaagttaaagcctgaggtacatgccacatgagaggtaagtttctaaagctcatacctcaaaaatcgcatactgtgtaacatggagcctttgtgatgttttgcatcaagtcaatctgtaagacagtagttacaatattagtgaagacagtgggttaaaacatttgttgttcaaacatggagcaaatatcattcatgagttaggtgcctttagttgaactatggtcccattagggttcatacattaaagcaaaaattgaggtggaaagccactccgtgccttacaggataaagaggcttaatgtggcaaccaaaaaatttttagtacataagagaatttaaatgttaactataacatacaaatcacatgcaaatatagttaccacttattttagttacctcttctcaatatacagaaaaatgccacaaatctaggaggccactggtttcaaatgaccggaatccttagacctcacaccaacaatccaccatgtggtggggatggtatcgcctgactaaatgtagtcttgcagtccattcttgtaagtattagagagaaaaagagagagagcgtcatctctgcaaagtgtgaagtcagggacttccctactaggaagcatttccataaagcaccccaaaatgacttgatgcaaacaccacacctagtggtgtcactggagtaagcatcatattacttcaaattgcttttacctaggtttattaagggattttgctctcatgctgagatctaatttgtaatggatataaaccaggaaatgagatttgcactaaagccaatgaagtaggaatgtacttattctctaaagtagcaaagatagtctcactgtcacagagcagttataggatatgttgctttccatactaatggttaataccacttggaaatgatttacccttcaaaaataaattcaaggttttcccctgtaatgcctcttacctggattcaaacatgctttaatgaggaataagagaaagggtgaaactatgaataaccccgggccttgtatcattacattagaaacactgctctaaatatgagtctatggctaaaatattaatttgagaggctcagggaatttattatacaaatctcttcttgcagagaactttaagttcaaatttaataaaacaaaacagaaccattccacgtcaaaattgtaaatgagtatgcatcagttttgcaatactgagatactaaattaatataatttattggtaaaactagtttaactacctcagtattaagtgtctataataaccaaatcttaattatccatttatgggtgatttgtttccttttttgagacagggtctcactctgtcacccaggctggagtgcactggcatgaccatagctcactgcagcctcgacttcatgggttcagcctctcaaacagctgggaccacaggtgcatgccactccatttagctaattttttatttttatgttttttggagacaggtgtctgattatgttgctcaggctgctctcaaattcctggactcaagcaatcctcctacctcagcctcccaaaatgctaggattagaggcatgagtgaccacatctggactgtcaccaatttttaactgtctctcaactaaacagccaatatagactgataaaatatacttaactattgtaaaattgtaaagaattgtatcttcaccaaggagaggtctggcttttacctgtgaattctggaaggtaatctctaaactcttgaaatgtcatacctaataagagggtcctggccaggagcagtggctcacacctgtaatcccagcactttgggaggccaaggcgggcagatcgcttgaggtcaggattttgagaccagcctggccagcatggtgaaacctgtctctactaaaaatacaaaaattagccaggcatggtgacgggcacctgtaataatcccagctactcaggaggctgaggtttcagtgagctgagatcatgccactgtactccagcctaggcaacagagcaagactatctccaaaaaaaaaagggggggggggcggcggtggggggaaagtgtccttgttcatctgggggctttaggccacagcagagtctaataatgtggcttatggtgggggctttgagtcacatggatcagcttgacctccagtggggctggagactaaggttagccacatgggcatgcaaccatggaaccccagtaaaaacgttggacataaaaaatagagtgagcttccctggttggcaataatccatgagtatggtcgcacaccagtgccaccaggaaggtgtcatttttcacaactctacagggacaggacaattcaaaactccaacatttggaacttccccgaactctgccctatgcacctctacccttggctcattctaatctgaatccctaaactgcaataaactctaactatgggtatgagagctttcaatgagttctggtgagtcctcctggcaaatcatccaacctaagagtggtcttggccaggcacagtgactcaagcctgtaatcccagcacttcgggaggcccaggcaggcggattacttgagctcaggagtttgagaccagcctggcaatatggtgaaactgtctctaaaaaatatagaaaaactagccaggcgaggtggtgtgtgcccatagatccagcaactcaggtggttgaggtaggaggactgcctgaacctgggagggaggaggtcagggcacagtgagccgtgatcatgccactgcactctcgcctgggtgacagagagaggccctgtctcaaaaaaaaaaaaaaagagtggtcttgggaacccccaaacttgcaactagtattagaagcaagggtcatcttatggactggactccctcttactctgcactcatatttaaaaccattaaatatactgtagctcaaaaaaaattgctcctttgttttgaaaaagggtctcacactgtcgcccaggctagagtgcagtggcgcaatccgagctcaagcaaacctcccacatcagcctcccaagtagctgagaccacaggcttaccccaccacgcccagcaacttttgtatttttttgtcccattctctacaacattcccaaaatgttgcccaagctggtctcgcactcctgagctcaagtgatccactcacctcagcctcccaaagggttgggattacaggcataagccactgcacccggccataaattttgttttttagtaacatttctagcaaacatgataaagatttgacttcagtgttgcttattttccttccaaggaacctctaatattctctattttcagaactccaatcaaattagccagaaagagcaaacgaagccaataaatctaggagggcaatagatctgattttaacccttgtttcacatgcacaattgtcttcagagaaaagctgaagaaagtaccccctcacctccatgccccaatgctccttttctctgacttcaagtgggcctctgatgctgcccacatttccctcaccaggtttctttcctttccaaaacatctgtaaaactttctgcaccttcttccttctcccaccactaccagtggatgaccttatagatttctgctccatgagaaatagaagccatttgacagcaccctcagcaagagctaacattttagctcctaacaagagctagtgggcaactgatccaagcagtttacaaatgtttatcatgtcatttcgtgttcaacacaatcctattagttataacttgataactaaggtttcataactggcctaaggttgcacagcttgtaaaaggcagagtcagaactcagacccagtactgtctaatgtttgagctcttcaacactccatcgctgcctgtcatcttccttctaatatatccacaaattcacctgcatctgcacatacaccttttcttcccatcatcttcccataatggaacaaataaacctcctatccatagaaatcatctggatctgtctattccccccattttccaaggtatgtcttgtcttttttttttgagatgtagtctcgctctgtcgaccaggctgaagtgcagtggcgtgatctcgactcactgcctcccggattcacgccattctcctgcctcagcctcccgagtagctgggactacaggcgcccaccaccacgcctggctaattttttgtatttttagtagagacggggtttcaccatgttagccaggatggtctcgatctcctgacctcgtgatctgcccaccttggcctccccaaagtgctgggattacaggcttgagccactgcacctggcctgtttcttttgtacgttgcaaaatctcccattttactactgcttatcacatcgtcaacatatgagcactctcaaaagtcttactttaaaaaaaacaaaaacaaaaacaaaaacaaaaaatggccgggcacggtggctcacgcctgtaatcccagcactttgggaggcaaagacaggcagatcataaggtcaggagattgagaccaccctggccaacatggtgaaaccccatctctactaaaatagaaaaaataaaactacctgcgcatggtggcacgcacctgtagtcccagctacttgggaggctgaggcaaaggaatcatttgaacccgggaggcagagcttgcagtgagccgagatcgtgccactacactccagcctggtgacagagcaagactctgtctcaaaaaaaaactaaaggccgggtgcagtggctcacgctggtaatcccagcactttgggaggtcaaggtgggaggatcatgaggtcaggagttcaagaccagcctggccaatgtagtgaaaccccgtctctactaaaaatacaaatatcagccaggtgtggtggcgagcgcctgcaatcccagctactcaggaggctgaggcaggagaatcgctcgaatccgggaggcagaggttgcagtgagccgagattgcaccatttcactccagcctgggcggcagagagactccatctcaaaaataataataataataaaataaatttaaaaattaagaaaataaggccgggcacggtggctcacgcctgtaatcccagcactttgggagggcgaggcaggcagatcatgaggtcaggagtttgagaccagcctgggcaacatagtgaaaccccgtctctactaaaaatacaaaaaattagccgggtgtggtggtgggcgcctgtaatcccagctagttgggaggctgaggcaggagaactacttgaaccccggaggcggaggttgcagtgagccgaggtcgcgccattgcactccagaccgggcaacagtgtgagactctgactcaaaaaaaaacaaaaaacaaaaaaaccctttaactgcctttctccctctatcaatctaatagcctggactcttcacagacaaacctgttgaaaaatttatcttccttgccttcatttactttttaacccactttaatctgggttccacctgcaacacaccactgaagctattcctactaagataggaactgccactcaaggccttcttggctctaaaagcccatgagcctttatcagttcaccttacaatttctcaataccattctaaagtttatgagttttttaactttaattccagtgactctttctactttatcccaatccaagtattctcctccttctttactttttttttttttttttttgagacagactctgactttgttgcccaggctggagtatagtggtgcaatactggctcactgcaacctccacctccaggttcaagcgattctcctgcctcagcctcccaagtagctgagattacaggcccctgctaccacacccggctaatttttgtatttttagtagagacagggtttcgccatgttggccaggctggtctcgaactcctgacctcaagggatccacccgcctcggcctcccaaagtgctggaattacaggcgtgagccaacgtgcccggccccttcttcacttctttaaccagcttagatttcattgtgtatcatttcaacaacactcttgcctatacccttaactcttaagattttcatcacagccatctggcaaaaccccaatcctggataaacccaacgatccatcaataagcaccacactcccaggtcctccagtgtttacttcccattctatacatgcactatccagacattcccattctcttcaaattccaaaatatcctatccacctgccctccccatacacacattctacttcaccaacaacaaaaaaaaaggtaccagctgggcacggtggctcacacctgtaatccctgcactttgggaggccaaggcaggtggatcacttgatgtcaggagttgggacaccagcctggccaaaatggtgaaacctcatctctactaaaaatacaaaaattagctgggtgtggtgatgcgcacctgtaatctcagctacacgggagactgaggcaggagaatcgcttgaacccaggaggtggaggctgcagcgagccaagactgcaccactgcactccagagcctgggcaataataagagcgaaactccgtctcggggtagggtggggaagataccataaaatatctgcacccgattctagaccttactgaggattccatctacttccaccttactgtaactttgcaaatacttttcccactgaactaaatcccccccataaacaagcaacactttctaatgtatcccattgaaaaatacaaaaacatataaaaaggaaaaactccatcaatcccacatgtccctccatcaaacaatctgccttacttgctgcagccaaactaaagttgtctagactcccctctcccatttcttcagttcttctagctccttaacacacactggtccaatttctgccccatcactcttggcaaaatccattatgacctccaggctgctaaatccaagatacagttcaggcctcaatctgctcatcctttcagcagctttcacagggctgctgagtagggttgagcagttttgccctgcacacaggtgccctgcagaggaatgaggtgggctgaatgaaactccttttttaaaaattctcggctggcatagtggctcacgcctgtaatcccagcactttgggaggctgaggcagacggatcacttgaggtcaggagttcaagatcagcctggccaatatggcgaaaccccatatattaaaaatacaaaaattagctgggcgtggtggcgggcacctgtaatcccagctactcaggaggctgaggcaggagaatcacttgaacccaggaggcggaggttgcagtgagccgagactgcgccactgcactccagcctgggcaacaagagagaaactccatctcaaaaaaaaaaaattgtttatgccaactaattgtacacctaaatgcaccaagttcatgactttctccttgcatttatttatttatttattttttaattaggtctcactctatgttgcccacgttgtagtgcagtgtgtgattacagctcactgcagccttgaactcctgggctcaagagatcctctggtcttagcctccccagtagctagaactataggtatggagtggctctctgcctttatttctaacccaagctaccttacaaccttaaaaagagacgctgcttcgccaggcacagtggctctcgcctgtaatcccagcactttgggaggccaaggcgggcggatcatgaggtcaggagttcgagaccagcctgaccaacatggtgaaaccctgcctctactaaaaatacacaaaaacttagccaggcctggtggtgtggcgcctgtagtcccagctactcaggaggctgaggcaggagaatcatttgaacctgggagacagaggttgtagtgagccggaggttgtagtgagccgagatcacgccgctgcattcccacctgggcgacagaacgagactcaaaaaaaaaaaaaaaaaaaaaagagagagaccctacttcagctctcaattgcatcgcttatcttccccttttgtcagttaagtcctggaagtaccctagaaacctatcatttggcctgggaaattgccaagattgaaaggaaatgtcttactctatgacctctttaacagatgaaggacaaaaaaggctgaaaatgtacaaagatatgcatccctcccccaccagttaaatgccaaacataggccagccacagctgatcacacctgtaatcccagctgtttgggagtccgaggcaggcagattacctgagttcaggagttcgagatcagcctggccaacatggtgaaacccagtctctactaaaaatacaaaaaaattaggcaggcgtggtggtgcacatctataatcccagctactcgggaggctgaggcaggagaatcgcttacccagaggtggaggttgcagtgagccgacagctcgccactgcactctggcctggagaacagagtgagactcagtctccaaaaaaaaaaaaaaggccaaacatagcccattccaaccaagattaagaatcactaagagttacattgcaccactgcacaccagcctaggtgacagagcgagactccgtctcaaaaaaaaaaaaaaagagttagttacacactgcagaaatctaaacaatctcaaaagtagactgggactttataatcaaggtaaaggtgaagtgatgtttaccaatataagaaatgaataggccaggcgcggtggctcacgcctgtaatcccagcactttgggaggccgaggcaggaggatcacaaggtcaggagatcaagaccaccctggctaacacagtgaaaccccgtctctactaaaactacaaaaaaattagccgggcgtggtggcaggcgcctgaagtcccagctactcgggaggctgaggcaggagaatggcatgagcgcgggaggtggagcatgcagtgagctgagattgcgccactgcactccaacctgggtgacacagcgagaccccgcctcaaaaaaaaaaaaaaaaaagaaatgtatgcaaccatttttttcaactcctgaaaatagtcagataataactgtagttattctgataaagttcctttagccaacaggttgaagcacattcccagggaataacatgtttataagattttctaacaattgcatatgttaaatcttctctttaaaaataatcctggccaggtgcggtggctcatacctgtaatcccagcactttaggaggccgaggcaggtggatcacttgaggtcaagagttcaagatcagccagaccaacatggagaaaccctgtctctactaaaactacaaaattagccaggtgtggtggtgcatgcctgtaatcccagctactcgggaggctgaggcaggagaatcacttgaacctgggaggcggaggttgtggtgagccgagatggcgccattgcactccagcctgggcaacaagagcaaaacttcatctaaaaaacaggaaaaaataaaataaaataaataaaaataaaaataatcctaggccaagctggctacagtagctcacacctgtaatcccagctactcaggaggctgaaacaggaggatcacttgagcccaggagtttgagaccagcctgggcaacacagtcagactgtgtctctaaagaaaaaaatcgtcatcatcctaggccagtccagacaacatagcaagacctccaactctaaaagaaaatgaaataaaaaattttaaaagtcaatttaattagaggtctcaagtaattccagaagatacagtctcacaaatcaaatactgagaaaggaagacacctttcaagataatcacactattattttaactgtaggaaaatgtattaaatgaagacagcttttgctagctgctgaaacatactagtaagaacaggaaacgatgctcccaccatgctcagcagtagccagaaatttactgaggtctttgtatttagccttaagtataagacacctaggaaacttcaaaatcatcacttaagccactttaaacccacagtctatacaaaccctttttcttttgttacattttatactaaacacactttaatcagactgacataagtgatttaaaagtaacttttataattcccttttacaagaaaaaaagaaacaatgtttccagatactaagttccttaagagacagcaatcatttattatagatttacagtactacaatttcaaatagtaccagaatctttttttttttttctttgagacagtggcacaatcacagctcacggtagcctcgacctcctgggctaaagcaatcctcccacctcagcctcccaagtaggtgggactagaaactcatgacaccatgtccagcttttttttttttttttttgagacagagtcttgctctgtcacccaggctggagtgcagtggtgtgatcttggctcactgcaacctctgcctccagggttcaagcaattctcctgcctcagcctcccaaatagctgggattacaggcatgcaccaccatgcccagctaatttttatatttttagtagagatggagtttcaccaggttggtcaggctggtctcgaattcctgatctcggtgatctgacagcctcggcctcccaaagtgctgggattacaggtgtaagccaccatgcccagccaatttttttattttttgtagaaacgaggtctcactatgttacccaggctggtctccaactcctgggctcaggtgatccacccacctccctgccttggtctcccaaagcaccaccatgcctggcccaaaatcttgtaattgcttaatactgtatatacattcttataatgatatgatatttcccatatttgtgtagaagatgcatgtggttcttctccaccccctcaagtacttaaaactatcacattggcagagtacaacctttaaatgtttctggcatcctccctcctcccattaaaaaaaaaattaaaataaaaatatgtatatacacgcccatacacactacaacagagggaaaaaagcaactcattgttcaactggtgttcttataagaatcagttcttaaattccaactgtgtagtaaaaggtaagcaagctataagctaccttttaacctatcctttctctatatacgttccatttacattgtacttgccctccaatctatgcaaacagtcacaaagattagattatgtttgctggcttatcatttcaactagtaacaaattcttaaggtgtgaatacaagatatggagaaaaaatgatgatgcacagctatgctgaaatttcgtattgttcaacttgaaatacgtttacagcctaatgggagtacactagaaaatgtagaaagagagcaggcacggtggctcacacctgtaatcccagcactttgggagacagaggtgaatggatcacaaggtcaggagttcaagaccagcctggccaacaaggtgaaaccccgcctctactaaaaatacaaaaaaaaaaaattacctgggtgtggtggcacatgcctgtaatcccatctactcaggaggctgaggcaggataatccaggtggcggaggttgcagtgagctgagatcgcaccattgcactccagcctgggggacagagcgagactccgtctcaaaaaaaaaaaaaaagaaaagaaaaaaaagaaaatgtagaaagagagccactccactgcagagcaattaattctatctccactaatatttttctaaatattcactgaaacagttttaaaaataatttcctgaactttaaccctcccaacatcttcaaaaggcaaaaattaccccctcagagggacacagctggtagtgccaatacaaaagatctttgtcttcccattcttagtccatagcttttttcatgacaccagcctctcttaagataaatatctgtgaaggatcaactttttaaaatacacacattctagctgggcacggtggctcacatctgtaatcccagaactttgggaggctgaggcggaggtatcacctgaggtcaggagtttgagaccagcctggccaacacggtgaaacccgtctctactaaaaatacaaaaattagccaggcatagtggcatgcacctgtaatcccagctacatgggaggctgaggcaggagaatcgcctgaacccgggaggtggagattgcagtgagccaagatggtgccaactgcactccaggctgggcaacagagcaagatgccgtctcaaaaaaaaaaaatatatatattcttaaaaataaagacacttagagaggaatctaaaacacactggttctatttttaacttcaccaatgctaagacagcgggtgtttttttttttttttttttgaaaaagaaaagggaacaaatttcacataggagaatagtttttgaaatctttgcacaacagggtggccatagtaaataatgattatttatttgcaaagagaagacagagataacaatagcaataataataatgtatttcaaacaattaagagtaaatttcaaatgcctcaccacaaaatataagtaagcaaagtaaggcgatagtatgttaattagtatgatttaatcatactacattacacacatatatataaacattacgttgtaccctatgtgtacaattatgatttctgaattaatattagagtggggagaacaataatgattaatttttacttcttcagtaagattacaatgaaaatgtagagagcactagcattatagtaactatacgataggccactttaaataaatggcatcttttacaaaatttttagtcaataagttgattacgacatacttacgaactatttgctattaagtgtaagttaatttataattttagtattttcaaaaaaggaacatattaaaatcctatcaatatttcaaataatgacaaaattaatcatttttaatagaatccttactcaggtcctccaaaaacaatataaactatgacttaaggtaaattcctttaaatctgactaatgaataaatgttaaatctcaaatttcatagtcccagtgctggaaaatctatatttttatttttcttcacgtttatacaaagaatgtacagacaggcaagaaatgtaatcaacctttttaggaaagaatcccaggatttgttttcttttcaattaaatatatatgaattctgggggatactggtgatcatctctggatctttttactcatctaatgagaaaagagtctcattatacaaagaggatagtcaaaaagcctaatgatttcctcacataagtaggtttttctgtctggcaaatctgaagaagtcaacatagaatctgtcattaatgcattgaatctgaacttccactattcaaatcaaattaggacctggaaataaagtgttaacacttcagacaagaaattccagggtttgtatcatcaggaatataaaccagggacactctcaagaggctgaagagcaagagtcatgcactgcttcagagaattaaatactccaagatgaaagttaaaatttcaaacacacatatcacacatacacatcttttaacatcaggttgaaatgctaaagggaacagagtaaaggtatgtttttaattaataaatttaaatgagagaaaactttaaattcaaagagcttcagtaaaaaaaaaaaagaaaatattagcaatgttatcaaatgtggacgaaaagctaatatatgtcactatgtaatccaagacatattcattagtggcgccttttttctgggctattaatatattagatgccatccaaaaacaaatatctagtaaatattaagtttaacgacttcttaaaaacctgtaggttcccaaagacatatacatgtatgtgcagtgaggccactgctaagcctctaataatattcttgtagactactaaagttctctatgatgataaaaagggtaataaaaaaaaaatctagtgtctccccttaataaacaaagaacgagcataacttaggaagttcggtaacaaaaacaatctataattctggtaccagaaatccctctgaggctgggcgaggtggcttacacctgtaatcccagcactttgggaagccaaggcaggggggatcacctgaggtccgaagatgaagaacatcctggctaacagggtgaaaccctgtctctactaaaaatacaaaaaattagccaggcgagtggcacatgcctgtaatcccacctacttaggaggctgaggcaggagaatcacttgaacccaggaggtagaggttgcgtgagcctagatcgtgcccttgcactccagcctgggcaaaaagagcaaaactccatctcaaaaaaaaaaaaaaagcaacaagtccctctgaaaaaagttttaaataataaacaaaagtctataacaggtttttaaataactataaagtcctacacatattacatgaataccaacataataatatgaatatgaatatcaacagggtatccaattccttttttgaaaaggtctgaaaattaatatgaaagaagtaattctgtatgttcagaaatctgttgattctaggccaggtatgatggctcacacctgtgttatcccagcactttgggatttacaaaatgggatttcctcctcacctaaggtcaggagttcaagaccagcctggccaagatggtgaaaccccatctctactaaaaactacaaaaattagccaggcgtggtggcagtcgcctgtaatcccagctactcaggaggctgaggtaggagaatcacttgaacccgggcggcagagtttgcagtgagccaagatctcaccactgcactccagcctgggtgacaaataaaataaaataaagaaatctgttgattctggaatatttgcgtttcattccccaatcagcaggtatccaattggcaagaagtgtgtttccccaggcattctaatgggatgccagaaggctcaacccagtgcttaaatttttagtgattacattgcttaaataatgtagacagatacaatagattcaagataaatcaatatgtaaaaagactttaaatatgtgcacaaggtatttttcaagatggataaaacatatgaatcttaaattaccatctttttttttttttccctgagacggaggtttttttcctcttgttgcccaggatggagtgcaacaacagcatcatctccactcactgcaacctctgcctcccaagttcaagcaattctcctgcctcagcctcctgaatagctgggactacaggcgtgtgccaccatgcccagctaatttttgtatattttttagtcgagatggggtttcaccatgttggccaggatggtcttgatcccttgacctcatgagccgcccacctcggcctcccaaagtgctgagattacaggtatgagccactgcgcgtggccaaattaccgtattctttcttctgtaaaaagatctggccactccagtccattacgatactgtccttttgagcctgctcaatcagtttgtttaagccctgcctcaggctaacagggctgccataagaggaatgctttccccaaaaacacatcctacaagaacagtgttgtaatctctagagttaacacttaatataaaaacacaaacttgcaggatctcgttttcatgaatttacttgaggaaagacacaaatatagagtggatgctatttattgatgcacttagtaggaaagaaggggatagcaaaagtaacaattttaccagatccatgcacatatgcagattgtattttactagagatggcacacataaaaattccagatagtggtaaggatatgaaaaaaagtggcaggaatgggtgtgatagtgaaaaagtcactgcatatctgtaccttgactgaggtcatggttacacaggtgtatacatttgtcaaaatttactgaatttaagacctatacaggccgggcgtggtggctcacgcctgtaatcccagcactttgggaggctgaggcggatgggtcacctgaggtcaggagttccagaccagcctggccaacatggtgaaaccccatctctactaaaagtacaaaaactagccaggcgtggtggcaggcatctgtaatcacagctactcagggggctgaggcaggagaatctcttgaacccgggaggcggaggttgcggtgagccatgatcgcaccattgcactccagcctgggagataagagcgagacttcacctcaaaagaaaaaaagaaaaaaaaaaaaaccaccaccacctatacatacataaattttatctcaaagaagcaccacaatagaattcaaaaacgaaatcaatttaaaaaggaaaagtacactcgattaatacaagatggaaaagaataacattataaaaccaagtatctctgcatgagcgaactccacaagaatttagtaagttatactctacattaaaaaaaaaacaaaaaacaaaaatacagaataaggaagcatttcctatacatatgaaaccacaaaatttctgtaatctttactgttaggcctctatacaaggggaagtatgtttcattttatagttccaaaaataaaatgggctctgaaaaacttcaagatagtcaaagacaggtaaccaaaatgatgacaatgtgaaaagattaacaaacagctcctctaaatcattaagggtggtccaatgaaaggagcctcagggatttgttttaggtgattaggataaggaacaagagccagataacaaaggcagaaaatcctaaagaatttaacaattcaatgttcccaaaagacaccatggaccacactccattttatatgacacttaaatgacattccatacatgtgtctaacatgaagattgagcagataaaaagtatcactttagtaatcatcctcaatcaacaccagataacaaatgaggggcttttgcttatggaaattctcacatattgagctgaacacttttaccttaattaattaattaatttatttattttttgagacagagtttcgctcctgctgcccaggctggagtgcaatggctcgatctcggctcaccacaacctccgtctcccggattcaagtgattctcctgcctcagcctcccaagtagctgggattacaggcatatgccaccacgcccggctaatttttgtatttttagtagacacggggtttctccacgttggtcaggctggtctctcccgacctcaggtgatccacccaccttggcctcccaaagtgctgggattacaggtgtgagccaccatacacagccttatcttaatttaaattgttaaatataaacataatactcaggtccttagcagccccttctctatattgttccaattaactgcctcccactgcgatctctcttgcacgtgtgtgcacgcactctaacacacacactttttttttttttagacggagtcttgctcttgttgcccaggctggagtgcaacggtgcaatctcagctcaccacaacctcggcctcctaggttccagcaattctcctgcctcagcctcccgagtagctgggaatacaggcatgcaccaccacactcggctaattttgtatttttagtagagacggggtttctccatgttggtcaggctagtctcgaactcccgacctcaggagatccacccacctcagcctcccaaactgctgggattacaggcatgagccaccatggccagcccacacactttttcaagaagcaactagatttaatcttcctaaattgtgccactttccggcaggtaaaatttcaatgattccctaaagtcactccaaatacacttaaactgggccagggtggtggctcacgcctgtaatcccagcactttgggaggccgagatgggtggatcacctgaggtcatgagttcaagacaagcctgaccaacatggtgaaaccccgtctctagtaaatacaaaaaattagccaggtgtggtggtgcgtgcctgtaatccctagagctacttgggaggctgaggaaggagaactgcttgaacccgggaggcggaggttgcagtgagccaaaatggcaccattgtgctccagcctgggcaacaagagcaaaaactctgtctccaaaaacaaacaaacaaacaaacaaaaaaacacctgaactatgattaaaggtctacaatagggttcccaacccagtgcttcagcttcacctcttatttatattactcctcataagtacccaattcctctacacactgacaatttgcacctggccttatcctaattttcttctattttgggggggattctcccccaaattcacagtgaaaactgtacagaccaattccatcaccccattttccctcctctgaccctccaagtttttgtttttgtttttgagacagtctcgctctgtcacccaaattggagtgcaatggcatgatcttggctcactgcaacctccacctcctgggttcaagcgattctcctgcctcagcctcccaagtagctgggattacaggcacccaccactgcatccagctaatttttgtatttttagtagagatggggtttcaccatgttggcctgtaaccccagcactttgggaggtcaaggcgggcagatcacctgaggttaggagtttaagaccagcctggccaacctggcgaaaccctgtcaatcatgccactgcactccagcctaagtgacagagcaagactgtctcaaaaaaaaaagaaaggaaggaaggaaggaaggtatactgagaattacatcacaaaatccacatgctctccccttcacaaagccctttacttttctcccataataacttatagcctccttgaagacagtggttttacaagtcataaaaatcctggccgtggcccagtgcagtagcttgtgcctgtaatcccagcactttgggaggccaagacaggcagatcacttgaggtcagaagttcgagaccagcctggtcgacatggcgaaaccccgtctctactaaaaatacaaaaattacccaggagtagtggcacatgcctgtaatcccagctacttgggaggctgaggcaggagaatcgcttgaacccaggaggccgaggttgcagtaagccaagattgcaccagtgcatttcagcctgggcaatacagtgagaccccatctcaaaaaaaaaaaaaaattatggccgggcacggtggctcacgcctgtaatcccagcactttgggaggccgaggcgggcggatcacaaggtcaggagatcgagaccatcctggctaacacggtgaaaccccatctctactaaaaatacaaaaaattagccaggcgtggtggcgggcacctgcaatcccagctactcgggaggctgaggcaggagaatggagtgaacccaggaggtggagctggcagtgagccgagattgcaccactgcactctagcctgggcaacagagcaacactccatcttaaaaaaaaaaaaaaaaaaaatttatacacacacacacacacacacacacatctccctagaagcatcaatatttactgaattagagtattttattacctgttataaaaaacaaacaaaaaaaccttccattatactaatttataaaggaataaaaacaaaatgggttggggagtccaggcacggtgtctcactcctgtaatcccagcactttgagaagcacaaggtgggaacttgaggtcaggagttcgagaccagcctggccaacatggcgaaacccggtctctaataaaaaattagccaggcctggtgacatgcacctgtagtcccagctactcgggaggcagaggcacgtgaatcacttgaacccaggaggtggaggttgtactgagccaagatcgtgccactgcactccagcctgggagacagagtgaaactatgtctttaaaaaaaaggcggggtgcagtggcacacacctgtaatcccagcactttgggaggccgaggcaggtggatcacctaaggtcaggagttcatgaccagcctaacatggtgaaaccccgtctctactaaatataaaaaaattagccgggtgtggtggcacatgcctgtaatctgatctacttgggaggctgagacaggaaaacagcttgtacctgggaggcggaggatgcagtgagccaagattgcaccattgcgctccagcctggacaacaagagcaaaactccgtctcaaaaaaaaaaaaaaaaaaagttggggtgaggggaaggttcaacttaaagatacgattactaactgtttcataaggaatgacttatttcatactggagtaggagtttgacaccagcatgggcaacatggggaggccccatctctacaaaaaaataaaaataaaaaattagcgtgccaagcatggtgggtcacacctgtaatccttgcactttgggaggccaaggaggaaggatcacttgagcctaggtattcaagaccagtccaggcagcatggcaaaaccccgtctctacagaaaacaacaaaaaaaaagtagctgggggtggtgacatgcacctgtggtcccagctattgggagggtgaggtaggaggacttattgagcctggaagatggaggctgcagtgagctgagatggttccactgcactccaacctgggcactggagtgagactctgtttcagaaaaagagagaggaggccaggcatggtggttcatgcctggaatcccagcactttgggaggccaaagcgggtggatcacctgaggtcagcagttcaagaccagcctggccaacatggtgaaatcccatctccactaaaaacagaaaaattagccgggcatagtggcatgcacctgtattcccagctacttggaaggctgagacaggagaatcacttgaaccaggaggtggaggttgcaagtgagctgagattgtgccactatactccagcctgggcaacaaagtaaaactctgtctcaaaaaaaaaaaaaaaaaagagagagagagagagaggaaaaataaataaattagtcaggtgtggtggtatgcacctgtggtcccagctactcaggaggctaaggcgggaggattcccagagcccaggaagtcaaggctgcagtgagcagtgattgcaccactgcactccagcctgggcaacagagcaagagcatatctcaaaaaagaggaaagaaaagaaaagaaaaacataaaaacaaacgttcctttagttttaatttttattttttagtttattatggccgttttactctcccccaagtaaaacagccatgcacaatttgctgaaattttccttagtgtactttgaaatctgtggaacagaactggcaatcgctaaattctatttgactctagttccatttaatattagactggtgtgaaagtaactgcggtttttgccaaaaccgcaattacttttgcacccacctaataagtataaaatatgtaacttcacttaattttatcctttatgtatttccctatattatgtacctatggacatcaaacttagtacagactgataaaaggctgaacagacaactctggtttcaaaaatccagcttctcacaacatcagacatactagtatacagcttttctaatttcacaacacatttccattttttggtctttcacaatagagaagatgtgtatacttttgaatactctgatctgtctacaatctaccaaaattggaaggtgtttttattatacagtttcatccttttagaaatatacaaagatcctaagtttgggcacagtaagacactcaatatagatctactactaaacaagtaagaccaagtacataattaatgtcctaacacccccagtggagaagtaaaatctacttgttttctgttgacttgaatgccttctcttctttgttgaattaatcaatctacttgactccaatgtcaaattaatcaatgtcactttagaatattaaaatgtacaattatgaattacacatttaaaacacatcattctgatctctgtcttgattgatactagaagattatcttccaaactaaggtggaaaaaatgacagactttagctattggcaatgataggtcatttttttagggaagaggagtaaagagggcaacctccataggtcagatatccctttgttctaagaagccaccacctctgtttcttcatatgaaaaaaaccagaggcatccagtggttcccaaaaccttctcaactttacgcttgaggaacccacagatttcaaataatacaactgacctaagaccactcatttgtttaaccattctttttttaattttttatttttttttttgagaaggagtcttgctctgttgcccaggctggagtgcagtggtgtgatgtcgctcactacaacctccgcctctcaggttcaagtgattctcctgcctcagcctcccgagtaactgggattacaggcatgcaccaccacatcctgctaatttatttatttttttttttttttggagagacgggggtttcaccatgtcggttggctaggctggtctcgaactcctgacctcaggtgatccaccaacctcagcctcccaaagtgctgggattacaggcgtgagccactgcccccagcctgcttaaccattcttaaatgtcgggtgcggtggctcacacctataatctcaacactttgggaggctgaaggtgggcagattgcttgagttcaggggttcaagaccagcctgggcaacgtggtgaaaaccccatctctataaaaaatacaaaaatgagccgggctgttggcaagcgcctgtagccccagctacttgtggatgctgaggcaggaggcttgagcctgggaggtcgagactgcagtaagccaagtatctgtgccgctgcactccagcctgggtgaccacagcaagaccctgtctcaaaaaaattgacagaagagttgactgagagcacagtgaatgaaaaggaagactataagccagtgccatataaatgcttactgttggaggtatgcttctatggaacacgggtttgctctcttgccatatgacattcacgtattcagccacctggaacacttcctgtctgtatgtgtgaagtatcatgtgtggtcaaaattgactcaacagtcattttccacaccaactggcaaactaacactaaaagaaatcaacaagtattgctttttcaaaagcctaaatcggctgagtgcggtgacttacacctgtaatcccagcactttgggaggccaaagcaggcggatcacctgagtcaggagtccaagaacaggccggccaacatggtggaatcccgtctctactaaaaatacaaaaattagctggacgcctgtaatcccagctactcaggaggctgaggcaggagaatttttccctgtaagcgggaggcagaggctgcagtgagtcgagattacaccactgcactccagcctgggagacagagcaagactccatctcaggaagacaaaaaaaaaagcctacatcaaggaaaacagaaccaaaacaccagggacaaaatggtacataagaggcaaaaaaaattttcaccaaaattattcagatgaaccataataaatgtgcctgcatctgaagatgttctaaaccttcatttaagcaagaagcaagatcaagatccgttccgtcagttacctggagtctgtcatctttctgaataggggacagaatcacctcaaatttaactaataaaaatttatgacttggcaaacaccccaggtatttttattgactaacaaatcagctatgacaatcttagcaacaaatcaagttatgctatggggtatgtccacactttcctgttccctctacaacaggagaaaatcaaatctttccaacatcctaacaaactgttactccctgtaaccaaatgtatcacagtatcgtctaccaaggcgttacatcctgaaactttcctacaaaaagcacagcttcaaagaaaccttgcaagctttcttgtaagctcctcccttcccacatcgcccctccccagagccaagaaataaagcacttgaaagaaacaacatggataatatttattaatagcttatgtacatattccataactacataagccatttggcttcatacctgtcagcaatgaagtcagctggccctagcacgtggctgcgactcttctctatttatttagaactacaaactacaatttacactttacaaaagctgtaggactatttgggaaggcactttattcttctaaaaggttactaaattctcttaaatacttatactgatcacaatactgaaaaataatagaaaatccattgtcattcatttaccacctgatttgttagatgccagataatcaaatttcacacatttcaataaaaaggcaaaactaagcatgtcaatcataggaagaaaaatacttaactaattttatttaaagcactcacaaactcttaagtggtacaagacaagtcaacgctgtttatcgaacaatattttttttttacgactaaacatctcaattctagactcaggcactaattattaaagtcatctagttatatacaccaattctcaacagacacagttttttttggaaaggcatattaaacagactaagatgtgtactacccattagccaaagataattttattgatttttctaatgagtcttcaaatgttacattctaacatcttagcaaattatttccaaatactgctggaattacatgtaactatcaggaaacaaaagggcttctcaacaacttgtgcgttctacattatctggccagtttccggacaattataatacaattgtgctccaaagtaggagagttccatgaatcaattgcccctaaaatatatttctgtatatttaaggagttctaagcattgggttaaattccaaacagactctgaatacaagcatttatttagtaagagaggttagaataaatcaatcctaaattaggcacagctgccctccccccattgatcaaaaagacaggaaattacatttatttaaaaagttaatgttcctaatatattcaaatctaactaagccccaaaacggtctgagatcaaatcctccataaaagaggaaattctctagacttctaagtgggtgcccaaagagttcactcaagtgtccaggtatgaattacgattcaccagagtaaccggccttgcacttagggaaaacttccatcgcccaagaccagagtgggtcgatcccatcaacagtcacacaatctcatctcatgctccactaatgaatgttctgcctaaagtcagagcaatgccttggctggagttttgttttggttttttcaatattaccacgtgggggtcacagaaagggaacagaggttacaagagctctcacgtggcggctgaaagactggggaaccgagaaagtgaatgagtaacagggagggtcctggactctcaggatctcccaactcggggtcagggggaggcggtaagtggaatgcccccccaccacccccgcctctttctcacctcctggtcccgaccctaggccagtgccaccgccgggagccccgggtctcggcttcagccccaggctgaacatgcagggaggggagaggcacttaggcctcgcctccccgtggccttcctcccccagccggggcggaggagaaccaggaagccgcgcccggctccggtgggtggagggcctaggccgcgcctcccagccccgcggccctaggcctcggcccgcccgaggcggagcccgggaggtcggggcggggtcccgggccggtcacccacctgggttgccagtcattccagctccgcgaatagttggtgccgccgctgctcagccgagaccccggggctctgcggctcattaccttccccgacacgacatggccaagcgccgccgcccagagaagcgcgagtcgccgcccgaaccggccgctgccgacaccccgctccggcccggggctgaggaggaagccgaggaggaggaagagaaggaggaggaggaggaggaggaggaggaggcggcggcggagggcggggtaagaggacggccgttccgggttccgcctgagcccgcaacgcagaatgaggaggcgggagcggcgcggtgagagagaggcggatgaaggggcgccgacttctcttccagggccatgcgcggcccacgacgccggggccccggaggacgaggacgacgaggagcaggcggtggcggcagctccccacgctcacaaggccactgcttccccgcctcccggctccgcccgccgcgccgccactgtcgcacggcatgctgggagcgagaggcggggtcggccccgccgggcctggggagagaggcgggtcctgtcggcggggcggggccgagagaggcggggccgatagcaggccgccccgccccccacggccccaggctcttggacggcgaagaggtctgggcgtagtagtgacgaatcctaagacaagggatctccactactgcggccacacacttttctcccaaacgcttcccggaaagcaccggagggctgggcagtcaggtgtaaacaggcgtccaatcaaggacctgcagtgtgggtggtgggggctggtgccctggggtgcgagcgcacacaggcgtgcccttggtttcacgtgcgccagttttcccactttctacgggggggagtggaaagtgaaaatagtaagatcgagaggtggatatccaccttcccaacctccacctgaaatgtgcccatcgagtcctagcaccttttaccatttcttcccaatgaaaaaaactaaacgatgtaagggaagggagtacccacgaccaccaaaccctgtcctctgcaatgtgaaatgtgctttgaagtcctctcaccctgaggcttgcccgccttctgctggtgaaagaagctgggggctaggcgcggtgggtcacgcctgtaatcccagcactttgggaggccgaggtgggcggatcatctgaggtgaggagttccagaccagcctggccaacatggagaaaccccgcctctactaaaaatacaaaaattagccgggcatggtggaggacgcctgtaatcccagctacttgggaggctgaggcaggggaatcgcttgaacccagtaggccggggttgcagtgagccgagatcagaccattgcagtccagcctggacaacaagagtgaaactctgtctcaaaaaaataaaagagagagagagaaagcagggagggaagaaaaaggaaggaaggaaaggagggagggagggaaggagggaggaaggaaggaaaggagggaggaaggaaggaaggaaaggagggaggaaaggaaaggaaaggagaaaagaaagagaaggccgggcgcggtagatcacgcctgtaatcccagcactttgggaggccgaggcgggcagatctcgaggtcaggagatcgagaccatcctggctaacacggtgaaaccccgtctctactaaaaaatacaaaaaattagctgggcgtggtggcgggcgcctgtagtcccagctactccggaggctgaggcaggagaatagcgtgaacccgggaggcggagctcccagtgagcagagatcgctccactgcactccagcctgggcgacagagcaagactccgtctccaaaaaaaaaaaaaaaaaaaaaaagagaatcagctgggtagaggagacgtacctgaccatctaccccatgacatgtcccatgccccagggaaaaaaattccctaaaccatctgatgcataaagtgaatgcatacacattttttaaaaggtgggccaggatgctccttaaacaagtgtctaaaccttatctgcataaggagtcttaacctatcattttatgttgcaaagaaaacgtctttatatatcgcttgtgcaattaaaaattgtaaccaaaagtacttgaagattatgaggagttgacacctccacacacatgcatatcccctccaccttgggctccttgcttatggccaccaatccctcactaagggaggatcctgccagttctaaatgatggggactacaaaaattacccggcgtggtagcgcgtgcctgtggtcccaggaactcaggagggtgaggcaggaggatgacttgagtccagcaggtggaggctgcagtgacctatgatcccaccactgcactccagcctgggctgcggagggtagggagggagggaggagaagaaagagaaaaggcagggcaccatggatggctgactcctgtaatcccagcactttgggaggccgaggtgggtggatcacttgaggtcaagagaccagcctgacaaacatggtgaaaccccgtttctacaaaaaaatacaaaaattagccaggcatggtggcgcacacctgtagtcccagctatttggggaagctgaggcatgaggattgcttgaacccgggagccagaggttgcagtgagccgagatcgtgccactgaactccagcctgggtgacagagcaagactgtctcaaaaaaaaaaaaatcatttaggtgaagtgattcatgcctgtaattacagtgatgggaggctgagactggaagatccttgagcctgggagttataggccagcctgagcaacatagtgagacccccatctctacaaaaaaaaattaaatttttttttttcagacggagtttcactcttgtggcccaggctggagtgcaatggtgtgatctcagctcactgcaacctctgccttccaggttcaagtgagtctcctgcctcagcctcccaagtagctgagattacaggcacatgccaccatgcctggctaattttgtataaaaatttaaaaaattttaaaattagacaagttagaaattgcttgagcaactggacacaatctctggtactacctttctttttcttttttatttttttattttattattattatttcttgagaaggagtctcgctctgtcgcccaggctagagtgcagtggcgcaatcttggctcactgcaagctctgcctcccgggttcaagccattctcccgcctcagcctcccgagtagctgggattacaggcgcccgccaccaagcccggctaattttgttttttgtatttttagtggagacagggtttcaccgtgttagccaggatggtctcaatctcctgacctcgtgatccacccgcctcggcctcccaaagtgatgggattacaggcgtgagccaccgcgcctggccctctttttctttattggtcaaaatattatccaactaggcatatggatgtggaggcatgcctgtgatcccaattacttgggaggctgaggtgggagaatcgcttgagcccacgagtttcaggctgtggtgagccataatggtgccgctgcactccagcctgggcaacaggatgagaccatttcttaaggggacggaaaaaatcactctggctgtggcagatttccttaggatagattccgagaagtggagttattggggaaaaggctgttaatgattttaagtctttggatacagactgttaagttgctttccaggaagtttctgccaatgatagtctgatactttctgtgtcctcacaccaccctttgtcaacactgagtgttttttgagggttaattatttctatgggagaagttaaaaaaaaaaaaaagacaacaaagaaattgcttcaggtggggcatgctggctcacgcctgtaatcccagcactttgggaggctgagatgagagaatcacttaagcctaggaggtggaggttgcagtgagcctagatcgtgccactacactccagcctgggcaacagagtgagactccatttcaataaaattaatcaaatgaatcaaacgtgagcaactctcataacttccaacatttttttcttcttcctgttggtggttctgcctctctggctccattaggatttccctactccatttcagtcatgggaaccgagtttctgttcctgaaacacaccaagcctttctggcctctggatttttgtacttgctgttcccgccatctggaatgccttccctgcatttgttcccatcagggttgggactagcaaagtgacaggggatggagttgctgagggtgcaaaatttaaggaggcacctactcccagggtcatgcaaaagccaactttgcatttgcacaatcctgtgagtgagtccctccttaaatttgaggctgtactgtaatcccagctactcaggaagctggggcaggagaattgcttgaacctgggaggcagaggttgcagtgggccgagatcctgcctttgcactccagcctgggcaacagggcgagaatccgtctaaaaaaatgaggctctagacaccacatttgccctactctggcccctgccctgattttcctggcctgtctcatctccagacaggtttgctttgacctccctgcccataaaagttggccagtgccctttccaggtactctgtcatataccctatttctttccttggtagtacccagcaccatctgcaagtattgggtttctttgcacatttagcatctgtccaacccttaggatatcagctttgcaagagcaaaggtcacgtctatctcagcctacctcctccatactcagcacacagcacagcacctgaccataggaagcacgcaagaaatgggaggaatgaaatggaaattatctaaaataaggatcaagattgatacagaagtattcatctcagctttacttattaatagcaaaacaaaaacaaaacacctggatattatactaattctcaacaataggaaactgattaggatgcagtacattcagagctgaaattttctgcagccattacaaattacatttgtgaagatttttttttttttttttttttttttttttgagacggagttctgctcttgttgcccaggctggagggcaatgtctcgatctcggctcactgcaccctccgcctcctgggttcaagcaattggtctgtcattttcagacccaacagaaacagaggtgctcctgccaggcccccggggactgcctccaggagtcatttgtaatgacagggtgcgttctgcgcacagtttcagagtctgtccaaagggccaatgctggggctgggcagaaacgatccaaggcctgtgagctgtgcagctttataggcaaatgaagatcgtttacccagaattgcctgctggagacagcatagaggaagtggcggcaacttcaccagttccaggaagcccaggcagcctggtcccccagggtgcacctggcacagcagttcgcatggggccagagagcggcagctgaccgctgcaactacagctggcctgacaccgggcacaggtaccagcccagcccagtcccgcccagcgcagcctgcggcccctagccgaaccagcacctggcaaacctgacacccagccttggagcttgggcccccctctgcagctggctggggctcctgagacagcttctttgtcggaatccactcagtacacacacggtcccaaacttagtggctgcccagtgaacatggggcttagtagaaccagtaccttcctccctggccccttcaagtctaaatatcccctgctctgagtacaagcctccaccttctccactgatagacagcccccaccatctccaccgacagacagcccccaccttctccaccgacagacagcccccgccatcttcaccgacagacagcccccaccatctccaccggcagacagcccccaccatctccactgacagacagcccccaccttctccaccgacagacagcccccaccatcttcaccgacagacagcccccaccatctccaccaatagacagcgcccaccttctccactgatagacagcccccaccatctcccgtgtcatcccctggggggacttgtaaaagcagtggtcggggagcgggatggaaacccagagcttctgatcaggcaggtcgggggagagggagacaacacatctgcacagaacaaggtcccagggaggccggcgctgctggtccagggagcaccccccagcacaggcgcgtgcttccctgatggacacgtcaccacccctgggctccagaaaatgaatgtctgacccagtgacccctgtcctcacccaaggccaacctcaccccagaatgggctggaatgctgagcctgcccatgccagctccagatccacccacctccccaccattgctggccacagagagaggtcaaagtggtccagaaaccccaaggaaaatgaagcagttccggggcagggaagcaaaggcagtgtttccattttttttttttttttttttttttttttttgagacaaagtctcgctcttgtcgcccaggctggagtgcaatggtgcgatcttggctcactgcaacctccacctcctgagttcaagccattctctcacctctacctcccgagtagctgcagcctctgcctccggggatcaagtgattctcctgccccctgcctcagcctcctgcctcagtagctgggattaccgacacctgccaccacgcccgcctaatttttgtatttttagtagagacaagggttcaccatgttggccgggctggtctcgaactcctgacctcaggcgatccgccaaccttggcctcccgaagtgttgggattacaggcgtgagccaccgtgcctggccaggatggtctgcttataatggctcaattttgatgtccagtctctgcagagcacaaggcccccgctttgggccagacatacagatgtccctgggcaagaacagagatgatcccaaggccctggccccacctgtctgctcagtgttgaatcaggtttctgtgaaaacaaattactaacaggctggtgtcacattttcaaattctgtcaccagccgttgaacacatgtctttgtacttttttccatttttaaccggggctgagttacgcccaaccacactgtcctggctggcacgggggaggaggtgtcagctgctgtccagaatggggctgacacattcattttaaacaggccaggaagatgcagatttggcaagctctgaaatttgccgacaccccaagtcaagggtaagcaggagaaccggaaaagggcagcttctcatgtagtcaggttctcctgatgcaagcgtcctggtggatttgggtttcccaagggtcctgactccaggagacccccaggaccgacaggaagggccacccctccctctgaaactctgaagccaggccacccagtgctgaaatgctgtgtgaactcgggcaagttcctttgcagggactgagcctccctttcatgtctccaacagactggaacactgcctcccgttgcatgggcgaaatacctcgcggacatgtcttacggcgccccatgaaagcatcaccattaatctgaccagtcactgcagcatgagtatcttcagggcacagatgaagccatgggcaccagtgataaggagttgccactgctggctaagtgcggagcctcacacatctgtggcccagaaacccataccccactccaaaccctctatagctccaacagttatgctaacaagaaaaaggagtgaaaacccgctccagtcacggtattgtggaggtggaaggacacttgtggcagccaatccaacacctccattttatagctggggtaaacatagttcagagaggttgtcccacttgctgaaagtcacacagcagttcctgggcggcaaagtgaggacatccaggtctcctaaatctcaccctcgtgctctgcccacttaactaggcttttcaatcctggctgtcaaagagaagcaccaagtccacttgggctcctggccagcatccaggccagtccaactcaacagcaagcggaagcaaataccacacaatgaacttgttgaacagactctgtgctcaggcttaaccagtgcacagcctgtacacccgacaggcggatgcagctgttccaaactaaggccagggcctctccccaatcccgatgggctctgcaggtgcagtgatggaagaatccctggtgacggggagcccttagctctgagcaggacctgaagccatctcagggcttgcaccggtccagatgctgctgcacaagtgctccaggggctcctgccctgccctcctcacttgccccctcacctgtcagggatgtttgattcctggctggcccctcccctacctgacccctgccaaagacctacgccaccccaggctcccagctctgaagcaaacaaccagagaagtcaagcgcctggctccgggccacacagcttgagggactcagagctccagggacagtgcccgggccctgctcaggccttctgcagaggctctgggctcttccagttgactcagctcacagggcccctacacagtaccaggtgaagacacagccccaagaaccctcagggtctgaagccacacatgtgagccgtgggcagaatcctgcattggcctccagcagctcgagagcacagggacaaagctggactggccccggggtcaccgtggccttggttttgtagcagctgcagtttgagcacgtacaccaaaaataaaattctaagccccgtaactgactgaagggaccactcctattggccaaagggatattccaaagttaacctgaaaaacgagctcaggtcatgatgggaagaggggtcacacaggccttgttataccccctccctctggaattcaggtacagctgaccagcactaacattcaaacacagatcttggcctggctcagtgactcatgcctgtaatcccagcactttgggaggctgaggtgggcagatcatgaggtcaggagttcgagaccagcccgaccaacatggagaaaccccatctctactaaaaatacaaaattagccaggcatggtggcggcaggcacctgcaatcccagctacttgggaggctgaggcaggagaatctcttgaacccggttgcagtgagccgagatcatgccactgcactccagcctgggtgacaaaaacaaaacaaaacaaaacacaatattggtctccacaacctcctgtcttacccagatactcctttctattgattccaggtctttagctaataactctttcaaccaattgtgaatcagaaaatattttgccaggcacggtggctcatgcctgtaatcccagcactttgggaagccaaggtgggtggatcacctgagatcaggagttcaaaaccagcctgaccaacatggtgaaacccccgtctctactaaaaacacaaaattagctgggcatggtggtgcatgcctgtagtcccagctactcaggaagctaaggcaggagaatcacttgaacccaggaggcggaggttgcaatgaactgagatcatgccactgcactccagcctgagtaacaaaagcatctcaaaaaaaaaaatatatatatatgtatatatatgtgtatatatatgtatatgtgtatatatatgtgtatatatgtgtatatatatgtgtgtatacatatatatatatatataaaaagaaaaaagaaatctttgaacccacttgtgaccaggaagcccatccctgccttggagttgtcccgcctttcttggcagaaccaacaaatacctttcatgtactgactgatgtctgcctgtaacttctgtccttgtacaaggtatgaactccagctgtggcccagcccctggggcacatgtcctcagggcctccaggccttggtcctcacatttgactccggataaacctcttcaaatattttacagactctggctttctcgttaacaagcagctcacacatatagtgtctcagcagtgacagatgctggcccaccccgaggtcaggatgactcagcagggattgagtttgcgggcgtcatgctccaaggcccggaataggaggttggtgctcattcctcacatagtgggcaaatcctagggcaggggagggggggcaatgccagagaatggtccccacctggggcggtctgacggccagagatgcagagaaagagacgcctcccacgctcctggagggcaggtgctgtggccaccccggagggtccgccttccagagggagagttcaggatttggccacaatcagggaaggaggcactgggggggggccctcctgttggaaaagggcagcggcaggaagggggtgctgccacagggcctctggggagcgcgcgggcacacagtaccaatctgcgtgcatacacatgccctgtccctgcagatgggccacgcaaggcctgcccatggccagccatccaggtgatgctccagggagggccaggcctacttgggggcagaaccctgtggctgtccaggatacctggatgtgagtctgggaaggatggagaagggtggaggagtgcgaagggcccctaggggttgctggggaacacagatgagcctctgacccacctgtgtccttacctgggccgactgggccacccagtcttgctgacacctccccagacccctggcacccaccagactccccaggcgtggctgtgtgctccgctatgcctgatgacaaacagtggcctcagtgtagaggtgggcactgtggcccctggctcctggctcgctcctgcctcagtttccccagctctaaattggggattatcactggcttcaaaggctggagtggaaagtggtggccaagaggtgccaagaggtggtgcaagcatgtgccctaccttggacacccctctacagggggtggctctcaccctggcctgggccctcgggggtctgcgcagcccactcttctgtgtgaaggcggctggtacactttcctgggcaagattctgcacattctgctggattatgaaagaggtctgtgacccaagaaaaaagggtcagaagtgcccgttaggctctcctgtgtggctcaggtcatgtgcttctgtgaactccccctacggccttgccccgaatcccgtgatgcagcgtgacctgcccaggcgccggcggcactttcatgtctggctgggaaagtcggatttcagcactaatcactggctgccgcctgcaatgagcccacggcttgagctctggggcccacccagctccttaaacatgcagaacctttgctagctgagccagggtcccagctgtgcggggttggggatggaggggtgcagggatcccaaaacccaacccggggccaggttttacacaggcctggactgagaagtggggctacaggctacaggtgcttgataccctgggggggccctggaacaggcctggactgagaagcggggctacaggttacaggtgctggataccccaggggggtgctggacaccccaggggggcagatagaggcagccaggcagcctgaagaccctggggcaaaacacacacaggccccctctgctctctggtcactgctaactggccaactggcctttgagtccactgaccacagctaagcccacagccatcaaaacccaccccttacacccttcaccctttagggaggggctcagagacagttgtggcgattcctacttccacccacagccccccgaccctgggcctgtgccgagtgtgggtgggtgacatcatctcgcacccagagctccagactaaaggaaaccctggctcctgtctctggctcttccctccctctctttgttcccttgctccttccttctttttgccaaaggagaagatagtgaggctgagggctgctcaacgtgcacagtgagcaggagatacaagcatgtggagggacggtcacagcccatgcaactggcaccttcacacgcggaggcctgcgattcccagacacctggcgctggggcaaatcccattccacagccagaaacaggctcggcggggccaggtggatttctcaaagccttggttgcttttggcctgatgctagctggacaatgtctcagctcacaggttcctaaacgcacacccgcccacaccaatctgctgaggagtgacagccatggggaggagacccacctcactccagggaccctggcaccgtctcccatgaggccaggtgtcctcagccacccgcagccagagtcccgcgagaccgacggacggcctgcccctgcgtgacggcacgcctgggactgtcccagcaggctcccatgcttcacccaactgcgacagggaaacaggagggggctacttctgctttcaaggcatggaggagctgtctgcaggccacttcccgaacacctatgcgcttggggaactgactgagactgagccggggtatcttctccacgatgcggtgagcccatcaggcccttcttctgagagcacctccctggaggtggaagcccctgaggcccacagcatcttctgaacctgtgagctcccacttatttactgagagctcacctgggccagtgccggtccacggctgtggccgggactttgagtagatgctaccctacttgctatgcagagccagctggggcccagggaggtcagataactgcccaaaccaaatccaggcccagccagaatctcaactccagcctttgcgccttctgataaaacccagcatcgcttgaatttccagtacacgctgccaagtcttcgttaagcaataaataacccacacaaccctactgtcatgacaagttccatatggccatccagaaagagacacatagagctggttcctctcacctttatgaccagtgaaaagcgcaccaacacgaagacacgcgtgaaaggacctcatctcctaaccagactgacaagcaagggattttttccactcaccgtcagtgggatggttctaagcaccgaggccaacccatttcacacgattatttcacaaaaagaaactttctgtgggacgtgcctgggctactgaaaagacagccagcaaaactgagaaccttgttctcaaatccgtaccctctcccaaagcagcctcagaggcccgagggctgaggatccagacccgaaagccactgtaccttctgtaggatcaggctcaaggactaagggggtaaaaggtgccctttcccttcctaagcagaaaattctggaacccaaccttacgtgtgatcatttaaaaaaaaaaaaaaatcagctgggtacactggctcacacctgtaatcccagcactttgggaggccgaggtgggcggatcacctgaggtcaggagttcgagaccagtctggccaacatggagaaaccctgtctctactaaaaaatgcaaaattaaccaggcatggtggtgcatgcctgtaatcccagctactcgggaggctgaggcaggagagtcgcttgaacccgggaggcagagtttgcagtgagccgagatcatgccattgcactccagcctgggcaaaaagagcgaaattccgtctcaaaataaataaataaataaataaataaataaataaataaataaataaaatcactttctatggcttttcactgctccaggaacaatgtccacagataaaacgcccagcctctccttcacaccctggagcgcccatcctgcccactggtccgggctccaggctgccccctgcacctgtcagaagtccccctacaagggcagggtctcccttcctgggacatccactgcccttctccgagctgaagtcagaacgacctgagaatcagcttggagttctaccagcctcagccaagcccacctctgcgacagcactcctttcgagggggcaccagctgcagggagtctgtcccttacagacccgtgaccccgtgacagatgaataaagtacagacacacagatattctgctctgccagtccagctgagggtcccagccgcttataggctccctgctgagtcctgtaaacagttgctacttggccctgatcagctagtcagacgcgcatttattcagtatgattaattaacaaaagcttgagtcaacaccattagagtgtaacagacattgtggacttcccgagtaaaaagcatttaagcacccagggtcttaagattatatgagtaaacaagctagctaggtaaactactctgcctttcttttatttctatgtttatttgtttaactaaaggtaaagggatcaggccgccttcagccagagctaattaccaaagttatgccaacttctcggccttccaagatttgtgtctatttctataactatctctaatatctttcccaccagaatgattgaaccccaacacacctccgtctctcagcagggtctgcctgttcagagaacacaacttctccttcttgccttacacacaggggcaagaataggttcacccttgcagagagcacatccctttctgttactgaaaatcactttccaaaaaaaaaaaaaaaaaaagcaacacatacacacatactcaccacatacacaggtgggtcagagaaaaaaaacaagtacaaatggcttagggacatgagaagtgtggccctaactttcgctgaaagggatcctattaacattaaccctcacctctgggtcagagagggttggcactctacagcctgccttgaggctttacctactgggaccaaaaggactgctggaaagctattttaggccgggtgcggtggctcaagcctgtaatcccagcactttgggaggcagaggcgggtggatcacctgaggtcaggagttcaagacaagcctggccaacatggtgaagccctgtctctgctaaaaatacaaaaaattagctgggcatggtgggcacctgtagtcccagctactcgggaggctgaggcaggagagtcgcttgaacccgggaggtggaggttgtagtgagccgagatcacgccattgtactccagcctgggtaagagcaaaactccatctcaaacataaaataaaataaaaataaataaataaaaatactttttaaagccctattaccacaaaataaatccaggaacgtgtgacttggtacagcctctttggaaggcacattagctattacattagaatccacaccccgccgggtgcgatggctcatgcctgtaatcctagcaaattgggaggctgaggcacatgcccgtaatcctgcacaggcaggagaattgcttaaaaccaggaagcagaggttgcagtgagcaacgagcctgggcgacagagacagactctgtctcaaaacaaaaacaaaaacaaaaaacaaaaaaccacataaccttttcccatttgcacaaagctgggaaaccccaaatgccctccacaggggtctacggggggtcagggggtgggggcggtgagcacacttgttcctgccgacacagggaagtcttcttagcagctaaagagggcagcctctgcgtaccgcctgggaacatggcaaaaccattttaggcttaaaaaaaaggtggagaacaagttgtacattatgatcttttaaataaataggccagcgatatatttgtaacagaagcagctctggaagcgtacactgtcagccacagaaactctggggctggggggtggtaaaggaggagaaatgtgtcacccaggcaggagcttagtggcaccatcttggctcccgagttcaagcagttctcctgcctcagcctccgagtagctgggactacaggtgtgcgccgtcacgcccagctgatttttgcttttttttttgagacagagtttcgccttgttgcccaagctggagtgcagtggtgcgatctcagctcactgcaacctccacctcctgggttctagtgattctcctgcctcagcctcccgagtagctgggattacaggtatctgccaccacacctggctaattttttgtatttttagtagagatggggtttcaccatgttggccaggctggtctcgaactcctgacttcaggtgatccgcctgcctcggcctcccaaagtgctgggattacaggcatgagccacagtgcctggctggtttgaatttttaaatgatgatgaattcatgtatgactgatgtgatttttattagaaagagaaaactaggcagcgccccatcctatgtctccttcctggtggccaatgaagcatttcccacaactcactcctggcaccaacaggaagtcagacactcagcacccaggggctgctttttttttttttttttttttctttgagacaggcttgctctgtcacccaggctggagtgcagtggcaggatctcaactcactgcaacctccacgtcccggagcatgcctcagactcataagtagctgggattacaggcgtgagccactatgctcagctaatttttgtatttttagtagagatggggtttcaccatgttggtcaggctggtctcggactcctgacctcggtagatctgcccatcttggcctcccatagtgctgggattataggcgtgggccatcacacccagccaacagggatccattttttaaaggtaagagtgcaggctgcataagctattatccatgtcgttacataccaggcggacatgtacctaggcgggagggagactgaaccagtgaaattctaatgacaaaaaaaagaaatcagagtcatcccttacattcacatgtccaacgcccagctggaagccacaggctctccccactcctgtcctactacgatttttcccggctttgacctgcatggtggtgcggctgctccgctcagagcctcagagaaaccacacagagccctgctgagtcttgccctcggggcattctcacatttatgaagaaatgcctccccctcccccttctccccaaagtacggtgtggcagaaaacagcgccaacaggtcctgccagtcagaagccactcccctgatttcatggctcaagaccccaactgtaaattagcccttcccaccttgaatatgtacacacactactgagatccaggccgatccttgccatgggatgaacctgagaattgccaagacccgccttcccacgccacccaaccaaatcatgtggtatctggtacaagtgattttccccctgaaatcccacaagaaaactattttgaggccgggcacggcggctcacgcctgtaatcccagcactttgggaggccgagccgggcggatcacaaggtcaggagatcgagaccatcctggctaacacggtgaaaccccatctctactaaaaatataaaaaaaattagccgggcgtagtggcgggcgcctgtagccccagctactcggaaggctgaggcaggagaatggcgtgaacccgggaggcggggcttgcagtgagccgagatcgcgccactgcactccagccagggcgacagagcaagactccatctcaaaaaaaaaaaaaaaagaaaagaaaagaaaactattttgaaaagcagttctctctggcctggtgaagaacacaccagcaccatgcccaccaaaacaggagccccatggctgtttcccagagtaacctgggacccgcacgtccattcactgcaacacagactgaatctgcagccaagctccgctctctcactactgggcaaccctcaggggggatcccttagcctaaaccagcaccagtcactacccgcacacgattttattactactgttttcttatgagtcagcccgtgtcactgattcctgacgagctggtgtggagagcagaaatgaataattttcttttcaactgcaatttccttttcaacaaccagtcagcaatcggagctttaacaataaaccggttgctcagttactccacgtgggtgccacgcaagaggctgggagtattgctcagcggggccaacgggaggctggcacttgcctgaaccgcttaagtgggggaatgaaatgcccaccgaagggcagggcagggaccctgctgtcccgtcactgaagatattcccagcccgtggggagaagtgtaaacgaatgaatgaaagaaacgcacgtggtttctgggaccaatgaccttagcctagaactgccgggacggtccaggaacgcaaaaatgtagagatgtgggagccaggggcgtagtgatgcaaggatgcagggacccagggaccacgacctcccaacccccggcccgcgccccgtactcacgcacgcagtggcaggccatgagcttggctgcctcctcgggcaccgggcagctggggaagagcggcttgagcaggtaggtggcgaagaccagggccacgatgtactgcgatgaaggccggatgacgagcagctcgatccagagcttgaggaaggcgggcagcgagccgtagacgtccagcatgtaggcgtagtcgccgcccgatttggagatggtggtgcccagctccgcgtagcagagcgcgcccacgatggagaagacgccgcacgcggcccacatcaccagcgccagccccggcgagcctgcctccttaagcacgcccgtgggcgtcacgaagatgcccgagccgatgatggcgcccacgatgatggccacgccgttgagtagcgtgatgttccgctgcagggtcacgccctcgccctcgcctgccggcgccgcgccgtccgcgcgcttggaggccagcatcttctcccgcgcctcttccttctcctcggccaccggggccgctagcgcccgccgcttcgggcccgcacccgccatgctctgcttaccggccgggcctgggacacccgagagccgcagccgagcgaggattgtgcgcgccgctcgccgcccgcagctgcgtcaagaaccccgcccgcgccgccttttaggccccggcccgctggccccgcccaccgtccgcggctcctccccgccccgtggcccggccgcggctctcagccccgccccctcgacccagctcggagcacgtgcgtcctccggcctagcctggcaggcgattcccaggcccgcgtggtcctcgaaggcccccgtcctcctgcgccatggagaccccggcctcgcgacctacccccccggcgcccgcgtcatcccaccccgtcctcccgggtgcgcctgggcggggcctggcagtcagggcgagccccttcacccactggcccgcagcctctcgtcaagcctgggagcgggcagtgcaccagggctggcctgaggccaaggatggggtttggggtaccccccgaagggaacctaggctcctgtcccggatgggcctaggggatggaaccgcccccacaaccagctcctggggcacgggggagggatgagaggatgacctgaggggaagctcctgcagcctccttccagcctgggggctgcatcaatgtggctggtgagccgcgaactgagacgagggaagaaccgaaccgaggccacccagtaattcccattgtatcccaaaagaatcttgccaaagatggcgatccggtgcccgtagctttgagaagcagtaataacacaggctttgggaagccagcaatctgcctgagctcaatttaatcaacagaaccgggggttcaccgggagccataagacccccacccccaaatctagctggggaattcaaaggcaggcttcagtgtgaaggggctttaaagcttgttattcctggggaatgcgagaggcatcttagctaaaaagggttgagaggtaatttcagttagaggcgagagcaggatgccaaggctcctaggcctggaaacgggaaggaatataaatactgccccgagattgaccagactggtgagcagccaaagacctcttcaaagggtgtgtgtgggtcagggaggaagctcctcggtatcacccccacccggggttccttggcgtgtgtcctaacgagtccttggaagctcacagcaggcatgtggggaggcctttgttctgggtgagcgttcagcctcccagggcaaacacgcaaacaccggttgcagagctgggtgttcacagcaagacagtctgctgggcagatgcctctggaatccacagaatcctgaacaatagccgtggtggagggggggtcagaatccctgtcatgctgggacctctagctgcagccaggaatgtccaggccccaccccggggaggaggcggctgaggaatgccacggcttgtcattctggaccttgctcgccccccggtatggcgggcattcctctgcagtgataaaaccaagcgaaatctcagcagcccaggcagccaccggcaggggagtgcggaggtcacacagatactaacttgtaatctgccgtccacgctgctggctgtggaaggtgcagagagccctccatccgccctattcttcccgctgtgcctgcagagggaaggagacagtaccaccatggctgggcaaactcaccgagtgctcactgagtcctcccctagatagcttcttgtgcaatagggtaggtgccagttaggagcaaggttagagattgtagggccagattttttgcttaggttcaactacgcaaaataaaaatagactttgcatgcatttcaggcactgggctgacgaccggccaccagggaggctccgccccacttcttagctttggccccaacgttagtcttgttgctgctctcaggcgtgctctgcgtgtgaaagatgacttggaggctgggcgcggtggctcacgcctgtaatgccagccctttgggagaccaaggtgggaaaatctcttgagcccaggagttcaagaccagcctgggcaacatagggagaccccgtctctacaaaaaatacaaaaactagcccagcgtggtggtggtgcacctgtagtcccagctgctggggaggctgaggtagaaggatcacctgagctggggaaggttgaggctgcagtgagctgagatcacaccactgcactccagcctgggtgacaaagcaagactccatctcaaaaacaaaacaaaacaaaaaataacaaaaaaaaagagggtgaaaggcagccccagagtgggagaagagatttgtaaaatggacaaaggccttataattggaatatataaagaactcctaaaaatcactaagaaaaccacagacagcccaagagaaaaatgggcaaatggctcaagtaggtgtctggtgaaagaggatatgcagatggccaatgaatctgcacaaagtgctccacatcattaatcattagggaagtgcaaattaaatccacaggagacacctgggcacaccctccagaaagcacacaatgacctgctggcaaggacaggaacgaccactttggaaaactctttggcagcacagccaaactgagcctttccactcgaaaatgccctttgctcagaacccagcagcagctccaaagtctccacccagcctatcgggccccagtacccacccttgcctcccatgcctctctcctcacccctgcacttggctgcctcaccctcgggctgcaccttgaacaccagaagggcgctcctgcctccagcctctgcctggaattctctgccctcgggtagccatgtggttcactcctcctttggtctctgcccaaatggcccctgtagaagagacctccccacccagccatgtcctctccctgtgacttaccaccccagactttctgtgttgatgcatcgtggtctacctccttccgtcagaacgtgagctccgaggcaaaggctcttcagacctgaaacagtctaggctctgtccccagagtctagaatagagcctgccatgtaattggcactcaataaatgttacatgaattaatggaaaccatcctggcacgagtggtagctctctttccaccaaaagaatgagcttgccaagagagagagacaacatcacgaaagagagacagaaaagccacactcagacccaactttgagttctggatcaagtctttttttttttttttttttttgagacaaagtttcgctcttgtttcccaggctggaatgcaatggcgcgatctcggctcactacaacctctgcctcgcgggttcaagcaattctcctgcctcagcctcccgagtagccgggattacaggcatgcaccaccaagctcggctaattttgtatttttagtagagatggggtttctccatgttggtcaggctagtctggaacttggcctcccaaagtgctgggtttacaggcgtgagccacagcgcctggctcctatgttattttttaggagctttattgttttacctttcctatttagatctatagtctgtcaggaattaatttttgtgtgtgctgtgaggtaggggtgtgaggtatggtgagaaaaaagattcatggttccccatttggatatcccgttggctcggtggggtggctcatgcctgtaatcccagcactttgggaggtcaaagcaggagaactattggagctcaggggttcaggaccaacctgggcaacataatgagaccctgtggatcaacagatgaattgatcgatcaatcaatacgtagatagataagtatccaaatgatccaaaactattcacagaaaagcccaaccattccctacagcatgactcagggatcacaaatgtgtggaaccttctagacatgctattctttttcattggttgatttgtccttctctgacaggtaccacattatcttaattaatatagctttttatttttatttatttattttagatggagtctcactctgtcgcccaggctggagtgcagtggcgtgatctcagctcactgcaagttctgcctcccggattcaagcgattctcctgcctcagtctcctgagtagctgggattacaggcatgagccaccgcacctagctaatttttgtatttttagcagagacagggtttcgccatgttggccaggctggtgtcgaacttctgacctcaggtgatcttcccacctcggcctcccaaagtgctgggattacaggcatgagccactgcgcctggcctactatagcttttgaaataggtcttgacatcaaattgtgtgtgttttctggttttatcctgccagattacttttggttgtatttttggtagagacggggtttcaccatgttggccaggctggtctcaaacttctgacctcaagtgatccacctgcctcggcctcccaaagtgctgggattacaggcgtgaaccactgtgcctggcctcacaagaattcctttttattttgagacggagttttgctcttgttgcccaggctggagtgcaatagtgcaatcttgactcactgcaacctctgcctcccgggttcaagcaattctcctgcctcagcctcccaagtagctgggattacagacacgcacccagctaatgtttgtgttttttatagagacagggtttcaccgtgttggccaggatggtctcgatctcctgacctcgtgatccacccacctcggcctcccaaagtgctgggattaaaggcgtgaggcaatgcgcccggccaggagtttttacaaggaggaagctgaagctggaaaggcacggaaaaggatcctcccctagagcctcagaaggaagcagccgtgcggacaccttggtgtcaggcttctggctcactgaaccgtaagagaatcagtctccattgttttaagccaccaagtttgtggtactttgttacagtgaaactaagcaccctgcacttgcgttgggtgccatggcacacccctccatcccagcgttatgttccccacggtacttacacatctttctttcacttgcagctgaaacgtactttgactaaaacaataacctcattctctctttttaatttcagaagtcacgtacaatcacattgtgaaacttgggaaacaacgcttccttccttcaaagtcagttctgctattcatgtggacctaatgtctctaggatcttgtgccctcattagtggcctggaaggacgcccagaccttccagttcatcaggggttgaagtggacgatagttgttcaccgtcatcttcttctcttcaccaagtgcagaaaacaggagagtacgaaatgcagagagctggaatagagggcagccagggtgagcttggtatgagtgcagggtgagccagcccccaggtgtccctcaggccttgtgtggtctcctcccatgctgaatcaggatggcccgaaatgaccagtaaagatggtggaagtgatggtgtgtgcagggccagcttataaaaggcattgccgcttccgccttggtctttaggatcacttgctctggggggaagctggtcaccatattgggagggtactcaagcagccccgaggagaggcccacagggagaggagctgaggctcccagccaactgccagcgccaacttgccatccacttgagagggccaaccttggaatgaatcctctagccctagttgagctttcagatcgctacagtcccagctgacactgggctacaattcatgaaagatggtaagccagagccacccaaattcacaacccaaggaaactatgggagataataaatgattggtttttgttgtcattgttgttgttgtttgagacagtgtttccctcttgtttcccaggctggagtgtcattggcaagatctcagctcgctgcaacctccgcctcccaggttcaagcaattctcctgcctcggcctcccgagtagttgggatcacaggcatgagccaccatgcccggctaatttttttttttttttttgagatggaattttgctcctgttgcccagactggagtgcaatggtgtgatctttgctcaccgcaacctccgcctcctgggttcaagggattctcctgcctcagcctcctgagtagctgggcttacaggcatgcgccaccacgcccagctaattttgtatttttagtagagatggggtttctccatgttggtcaggctgctctcaaactcctgacctcaggttatccacctgcctcggcctcccaaagtactgggtttataggcgttagccactgtgctcagcctaattttgtatttttagtagagacagggtttcaccatgttggtcaggctggtcttgaactcctgacctcaggcgatccactcgcctcggcccccaaagtgctgggattacaggcatgagctactgcacccggcccaaatgattgttttctaaagccactatgttttgcagctatttgttacacagcaatagataactaacacctataatgtaaatgctaaagtaacatttgaatttacttttcactcaaggaactaaaagactactttttatggctggatgcggtgcctcatgcctgtaatcccagcactttgggaggccaaggtgggtgaatcacctgaggtcaggagtttgagaccagcctggccaacatggagaaaccctgtctctactaaaaatacaaaattagccaggtgtggttgtgcatgcctgtaatcccagcactttgggaggccaggtgtggtggctcatgcctgtaatcccagcactttgggaggccaaggtgggtgaatcacctgaagtcaggagtttgagaccagcctggccaacatggagaaaccccatccctactaaaaatacaaaattagccagatgtggtggctcatgcttgtaatccagctcctcgggaggatgaggcaggagaagcgctttaacctgggaggtggagcttgtggtgagcgagatcacgccattgcactccagcctgggcaacaagagggaaactctgtctcaaaaaaaataaataaataaaaaataaaaaaagactttttatgtattatctcacttgttcacagaatatacttacgaactctgtgaggcaactcacacatttaattaaattcagaagtgagattatgtctacatgctgacagcatactgggccagttagccctgcgtgatgatccagcgccccctagaattgtgcgcgcatggtgcacctggcctcctgggccatgaccacagtgtgctcatccacatttgtggtctgcacatttgttgactgtctcagaaaggcagcctttctcctcccctggaaaactccccgccttccaggacatgtgcctccctggctcccctgctcaggataaggggctcctgccctgcatttttatatgacaccggccaccctggcttaatactattggcttcgtttctactttcctgccagacagcagtattctgagacgaatgccctgttcctgtgccgcccctccacacctgcccccctcccaccctctcttggtggcacagacccagaatgggcacttgtcacatatatgcttgttgagtagcataagggccttgctgacaaggggccaccttcaacaaaagccttccccatgtccaacagctctggtttggaggtaggcagatattctgcatcccacatctccacgtgcaaatgacatcatgccatggtttgtatataagggaatattttcacaggcccaggagactgaaagaccctctaagagctcacctggagccctcagaaagagatgagccagagatgctaagtcctgctgcgactgctgagaaatgtctgccgggcgggggcggggcataggcagcatgcctgtggctctgaactgccttggacagacagaattgctatagattcttaagatttccagaaaaaaatgatagtataacttttatttattttttattttatttttttgagacagtctcactctgtcgcccaggttggagtgcagtggtgccatctcagctcactgcaacctccgccttccaggttcaagtgattctcctacctcagcctcccaagtagctggcactacaggcacacgccaccatgcccggctaatttttgtatttttatttatttatttatttgagatggagttttgctcttgttgtccaggctggagtgcagtggtgcgatctcggctcactgcagcctccacctcccggcttcaagttattctcttgccccagcttcccaagtagctgatattacaggcgtgcaccaccacgcctggctaattttgtagatttagtagagacggggtttcaccatgttggtcaggctggtctcgaactcctggcctcaagtgatctgcctgtctcagccttctaaagtgctaaaattataggcatgagccatgacgcccagcccaatagtataacttttaaaaatgtatacaaggattattaactaattttcgaaaaaaaaaagcaatgaaactatttagataagaaaaaggaggccgggctcggtggctcatgcctggaatcccagcactttgggaggccaaggtgggcagatcacctgagttcaagaccagcttggccaacatggtgaaatcccgtctctactaaaaatacaaaaattagccaggcgtggtgatgggtgcctgtaatcccagctactcgagaggctgaggcaggagaattgcttgaacccaggaggtggaggtagtagtgagctgagatcgagccactgcactgcagcctgggcgacagagcgagactctgtctcaaaaaaaaaaaaaagaaagaaaagaaaaaggaagaaaacaaaaaccatgcagacccatgacgctgggacaactcccatggatgccttgtgtgtctgtgtgtgatagattagggcattgctcagaacatgctcgctgtgatcactggaaccgctgtccaatctcaacaagctcctacttcaattggaactttcttcttgtgtaagaacaccccaaatgcatgaaagaatatatataactcctcaaggctcttatgcagcatcttagtgacgctgccaagcaagagagacgccttccatgaagcgccatcatgccagttacgggcacggctcacttggcttggggccacttcaacgggctccttctggatgatccaggtgaccgactcggtcagcggcggggtggtgagcgagcccacataggtccagtaatcccagcaggtgggcagcagagcggaggggtcgaaggggcgcatggccgcccgcgcgtcctgagagaccgagaagccaaggccgtgtcagtcctcaggcgggactaggagcttccatcttgtctcagcacgggaggccttcatggtgcttggaaggaagtgctttccccgagataaggccatgaggccactgctgtcacacttggaagcagtgataagaaaatgtgacccttctatacagagcaaggattcctgccaacttacattggtgggaattacattacattacaccagcttatgttggtgcttacatttttccttttgaagtcatttcttggggcgcagtagctcacccctgtaatctcagcactttgggaggccgaggcgggtggatcacttgaggtcaggagttcgagaccagcctggtcaacatgatgaaaccctgtctctactaaaaatacaaaaattatccagatgtggtggtgggcgcctgtagtcccagctactcaggaggctgaggcaagagaatttcttgagcccaggaggcagaggttgcagtgagctgagatcacgccactgcactccagcctgggcaacagagtgagactctgtctcaaataataataataataataataattaataaataataaaaacgccatttcttttagcataccttggctgcaaaaaatattactttttattgtgataaaatatacataacataaaatttaccatcttaacctttttttttttttttgagatgcagttttgctcttgttgcccaggctggggtgcaatggtgcgatcttggctcactgcaacccttcgcctcccaggctcaagtgattctcctgcctcaacctcctgagtagctgggattacaggcacccgccaccacacctgctgattttgtatttttagtagagacggggtttcttcatgttggtcaggctggttttgaactcccaatctcaggtgattcacctgcctcagcctcccacagtgctgggatgagaggcatgagccaccatgcccagcccatcttaacaatttttaagtgtaaagtttcatggcgttaaatgcagtcacattgtggtgcaaccatctccaccatccgtctccagaacttttccatcatcccaaactcaaattctgtcctgaccccactaaacactatgtccagcttcctcccccaggcctggcacccaccattctgcttccatctctctgaatctgaggactctggggacctgatgtgggtgggatcctgtggtttttgtcttttgtgtctggcttatttcactgggcataatgtccttcaggtttatccacattggagcatgtgtcaggagtccctgcattgttgctttttttttttttttttttttctgagacggagtctcgctgtgtcacccaggctggagtgcagtggtgtgatctcggctcactgcaagctccgcctcctggagttcaagaccagcttgaactcctgggttcatgccattctcctgcctcagcctccccagtagctgggactataggcacccgccaccacgctcggccaattttttgtatttttagtagagacggggtttcaccatgttagacaggatggtctcaatctcctgacctcgtgatccgcccacctcggcctcccaaaatgttaggattacaggcatgagccaccgtgcctggcttgcctggagacatttctactgctaccttaccgatcagggtatccagtatctccgtgattaccttcatctgtccctggaaactgtgcctgccaccctacgctgcagccgtccagggactggcaggcctcggcctaaaggtctggagggtgggcgacctgcaagactcacaagaggggaagccaacagacatacctatagacggagtgctgtgcccctggtgccgacaagaaagccaaggctcgggctgggtcagcaaccgaattccagtttagaggcagatttggtcgtggacatggccagccacctcagtaaaattagagaggattattttgcattgaatacactcacagccaaaaaacaaaaaaaaagagtcagggtcttactttgtcaactaggcaggagtgcaatgatgccatcatagctcactgcagtctctaattcctgggctcaagcgatccccccgcgtcagtctcccaagtagctaggacaccataccagggtttaaaattaattgtttgtagccaaggggtcttgccatcttgcccaagctgttctccaactcctgggctccagtgatcctcctgccttggcctctcaaaatattgggattacaggcataagccactgtgcccagccagctcttttggatatatacccagaagtgtgtgattgctgaatcatagggtagttctatttataactttttattttttttatttttttgaggcagagtctcactctgtcttccaggctggagtgccgtggcatgatctcggctcatggtggttgggcctggccgcaacacagccttcatcagcatcccatgccaaccaagcacaactctgcacctgtccctggccagcactgtgggacaagagtccagtccaaagtgacagagtccctgtctgcaaggaagatggcctccctgctcagccacatcacatcaccttgactttgctgggccctggccttccaaggtggaagccggcaacctagatgccttgggcttgtctcctaacatcaagcagtgagggtcagggtcaagagaggtggctgagctaccagaaggaagcccaggagtgtccacgccggcagacacatgcatcagttctgtgcacacgtgttcacgtttataattatccagttaattaaaaaaaaaaaacagcattataggctgggcgaagtggctcatgcctgtaatcgcagcactttgggaggccaaggcaggcagatcacctgaagtcaggagttcaagaccagcctgaccaacatggcgaacccccgtctctactaaaaatacaaaaattagccaggcatggtggcaggtgcttgtcatcccagctactcgggagactgagacacaagaattgctttagcacaggaggcagaggttgcagtgagccaagattgcaccattgcactccagtctgggcaacagaaagagactcggtctcaaacaacaacaacagcaacaaaacccacagcattattgtgatagaattcacataccatgcaactctcccatctaaagtgtacaacctggttgggcgcgatggatcatgcctgtaatcccagcactttgggaggccgatgtgggaggactgcttgaggccaggagtttgagaccagcctaagcaacataacaagaatctgactctacaaaaaatacaaaaactagccaggtgcagtggtacatgcctgtggtcccaggtagttgggaggctgaggtgggaggatggcttgagccccggaggttgaggctgcagtgagctgtgatcataccactgcactctagcctgggtgacagagtgagatcctttcttaaaataagtaaataggccgggcacagtggctcatgcctgtaatcccagcactttgggaggccaaggcgggtggatcacctgaggtcgggagttcgagaccagcctgaccaacatggcgaaaccgcgtctctactaaaaatacaaaattagccaggcgtggtggtgcatgcctgtaatcccagctactcgggaggctgaggcaggagaatcgcttgaacctgggaggcagaggttgcagtgagctgagatcatgccattgcactccagcctgggcaacaagagtgaaactccatctcaaaaaaaaaaaaaaaaacagaaaaagtaaataaaaaattgaagtgtacaattctatggttttgggtatattcacagttgtgcagccatcccaagtcaattttagaacattttcagcacctcaaggaggaagcttggtactttttagctcttctccccacccccgccgtgctgcttctgtctctgtgggtttcataggaactgagtcatgtaacatgtggaacatttgtgtcttgcgtctgtcacttagtatggtgcttttgaggctcacccacaccgcagcgtgagttagagctgtgtcctttctgattgccaagtaatatctcattgcatggtctagctgggttgacatcccattgcacactctagctgggctgtgaaggagcaggctgcttgtgcacatgggtaacggatgtacagtgagacgtcagtctgtgcacatgggtaacaggtgggtgcaccgtgaggtgttagtctatgcacatgggtaacaggcgggtgtgcagtgagatgtcagtctggtgcacatgggtaacaggcaggtgtgcagtgaggcgtcagtctggtgcacatgggtaacaagtgggtgtgcagtgaggcgtcagtctgtacacgtgggtaacaggtgggtgtgcagtgaggcgtcagtctggtgcacgtgggtaacaggcgggtgtgcagtgagatgtcggtctatgcacatgggtaacaggtcggtgtgcagtgagacgtcggtctgtgcacatgggtaacaggcgggtgtgcagtgagacgtccgtctatgcacatgggtaacaggcaggtgtgcagtgagatgtcctctcctcctgccggccacacgtccccgctcccagggcacagatgtgccagtcactttctgagcaactacttcaaatcttcagaacaacccttcaagaagtatttctagtttactgatgaagatagacagacagatataaacaacttgcccaaagccatgttgccagtcagggccactgaggcctggccctttccaaggtgcgggctcttctctccctccccaggactgcaggaatcagtcgggggagtggcaggccccagccattccactgcgtgcaggtttcctgccaattaagctttccagccttgggctgagaagaggatgcctgtgtgttgcctcatcgtccccaggagttcctgtcctgtctctaagatgcatgagagctggagcagccatgtggttacagaaagctgctccccctcagggcccccaaaggaagtcagggcccttcctttatgcgtgtggtgagccccaggcagctagaatgggacaccggtgagcacaccaatgaggctgaagaccatcacatccattatctgagcacggatggcccagctacctgtggaaagcaccacaagcctttgctggcggaagtgggttggtgacttgttccacttttctcttatttatttatttattttgagacggagtttcgctcttgttgcccaggctggagtgcaatggcacgatctcggctcaccacaacctccacctcccgggttcaagcgattctcctgccttagcctccctagcagctgggattacacgcatgcaccatcacgcctggctaattttgtatttttaatagagatggggtttctctatgttggtcaggctcatctcaaactcctgacctcaggtgatccacccgcctcagcctcccacagtgctgggattataggcgtgagccaccgctctgttcctggttttgtcttctttctcttaaacaggaccccgcattttatgagcgtcaagcctcacccagcctaactccgcccttggtttgtcctcttagagtctcagtttccccaggtgtacgacaggcagtgtggtggctgtaatgggcttccatcagtgcctgccacatgggcgtggggctcggtaggtgctgccgctgctgctgccaaagctagaagagcccccacagggcatagagccattccctggatcccctggacctggtgggctgtttccaactccacaaggcagccaattccccggtagccctgactcttgcgaaggcagggaggaggggggaccccagcagcctgaggagcttgcagcttgtccaggcatggagggtggggaccctctgtgggcagtttttgccaaaacttctggctatggtgagagggtcaaaggcgaagcctcgaggtctccattctgggagtgtctgcccagggtcaccggggccacactggggctgggcctgcgtgctgggagctgagtgcatagtgacaggtcggcactggtaggggcctgtgcagatgggacggcgctgggggtgggggtgggggtccgggcttccaggcggcgcctaatgtggttttggttatagacactgcctgtgtttccctctaagctgctgaaaagctcagaaatgtgcagcagggcctggagctcagcctgggttctgactgcatgtgggaggtgggcgctgggacgactgggagttcaggctgcatggacccacttcctgggtttaaaaacgggctcttcacctgccacctgtgtgcccgggcaaggccttctctgcctctctgagctttggtttccctgtgtgtgcaagacagatgaatcacaggccctgccccgtggagtgattggaagattcagtgtgataatttatatggagggctgtcgcttctttgaacccttcccaccgaggtgtggggcgatgtccccttgccctgagcctgggcaggtgctcctggcgggagtggtgaacaggatgccgcaggagcagtgctttgtgactctggaagccagggcagaaaagacatcgtgtccgtctggctctttctggaaatgcacccttggagccctgagcactgcatagaagccagctgggtccccagggaatgaccgtggcaggcattcctggagggtctctgccgagtcagtcccacagcagggcccggaccagcctggaactaggagagatgatggggactacgtgactctggtctttcctgccctagttcaggacagcttgttccttaactggaggaaaccaggaaaacagcccagaagctgcaggtgagcccatccctgggtgaggactgctgagtccgcgggggtgagaggcagagctgggatttgaagccaaggccatctgcccttgagcctgaggccaccacggccccgtcctgccctgcactgcccaccaatcaggagttagattcaaccacacttctagcattttccatcagaaggccatcattctaaagtttcatggactcccaaaaggtaatagctctctctgggaatcagctgactgaaagcacccgcagcaacaaaaagcgactttaaccttagtgattgggctggtggattttcgtttcgtgacaggcagcagcagcctgtgcattccacagcagacgtgtgtgtgtgagtgttggccacagctgggccttaaactcaactgcacatttcaccaagaaccagacatgctccttattccattacatggtgagaatgctgctctagtgtggatttttttttttttttggagacggattctcgagctgtcacccagactggagtgcagtggcatgatctcggctcactgcaacctccatctcctgggttcaagcgattctcctgcctcagcctcctgagtagctgggattacaggagtgtgccaccacacccagctaatttttgtatttttagtagagatggggttttgccatgttggccaggctggtcttgaactcctgacctcaggtgatctacccacctcggcctccctaagtgctgggattacaggtgtgagccaccgcgcccgggctactgtggatgtttaacatctccatttcacaggtgaggaagctgaggctcagaggtgcgcagctcaggagtggtggatcagggctctggacccaggagtccaactgtggggctctctgatacactgtgctatgggagaagctcccagaagtcctaggctaggagcctctaggcgagagggttgttcaagtctcttcccattccctgacccatgaagcatagactcttgccccgaaggctgggtcttttacctcctaaggtctttttttttttttttttttttgaaatgagtctcgctgtgtcactcagcctggagtgcagtggcacaatctcagctcactgcaacctccatctcccagattcaagcaattctcctgcctcagcctcccgagtagctgggattacaggcacccgccaccatgcctggctaatttttgtagttttagtagagataggctttcaccatgttggccaggctggtcttgaactcctgacctaaggtggtctgcctgctttggcctcccaaagtgttaggattacaggcttgagccaccgcactcagcctcttaaggtcttttaatttctcaaaggtctaactcggccaggcgcggtggttcacgcctgtaatcccagcaatttgggaggccaaggtaggcggatcacttgaggtcaggagtttgagatcagcctggccaacatggtgaaaccctgtctctactaaaaatacaaaaattagccaggcatggtggtgggcgccggtacttccagctactcaggaggttgaggcaggagaatcagttgaacctggaaggcggaggttgcagtgagccgaggtcgcgccattgcactccagcctgggcaacatagcaagattctatctcaaaaaaaaaaaaaaaaaaaaaaagagtctagctctttattttcagctgaggggatgagcccagagatcagcatcaggaccagagctcagtccgcggtgcacttcctcccctgtcccgggcatcattcctcccctgtggtttgcctagaaaattttgacttaccccatggggaagaaatgctccagaaccttccccaggaggaaaacagcccttgggtaaagggtccttcacagccagctcttttctttcccaccaagaggtgggaccacctggtgtgggaggtggaggctggctgggaaaacaacccctccccaggtttcctctggctgtggagccgcgcggaggaagaggatggggcgtcagagctctcagaaccgtggccttgtgaagtttctgagcaggcaaatggggcggcggggggtgatctggtcccagccccaggaggccgccccgaagccagcatcaaggcgaaggccacgtacagatcaaacggctccttgaaccgcgaggaagggctcgccccagctccatctggaccagcccgcaccattgttaacacaggttgaagcctcatccgtccgcacatctgaggcttgcgttgactccttctgccctggaattcttttgtttgctgctgaataaataaactacatttctttggaatttctccttctccctcaaagccttttctcagctgatcttggagaaaggcgacactcttgtccccgccatcttttcgagctgtgctggatgcagggaagcgtatggagagctgggcgctggatgcagggaagcgtgtggagagctgggccggagagccgcggtttgggcaggtttctctctgcccttgggcttggggtcggacagggacgttcaaggagatgctgggtggtacatgagtcaacattcttaaatgttattagttagggatttgaggtttttgtttcaatctgttttcaaacaaactttatcattagtgaatatcatcacccaggacaaggctaaaaatttttcgagctaatcaatttaaagaaaaatattaagtaggctgggcgcggtgattcacgcctgtaatcccagcaccttgggaggccaaggcgggcggatcacctgaagtccgcagtttgagaccagcctggccaacatggtgaaaccccgtctctactaaaaatacaaaattagctgggtgtggtggcgcacacctatcgtcccaactgcatgggaggctgaggcaagagaattgcttgaacccgggaggcggaggttgcagtgagccgagatcacgccactgcattccagcctgagtgacagagggagactcctcgaaaaaataaaaaagaaaagaaaaatattcagtagaaagttgtcccattggcaggcagatatgtcaaagtcttcaggatcttgcctgcacgactgaattttgggaacttccattgagcccaacacccttattttatggaggaggaaacagggtcccagagcagtggtgacgcattcgaagtcaggaagagctagctgtggacacacgagcatcaaccctgcggaatcctgtttccagaactggaatcacagcgcctcggcggggctctttccactatgagatttctttttccttgcaaatgaatcgctgcactaaacaattttgcttgtcaaattatgctgatttcttttctttttttttttttttttttgagataggatttcactcttgtcacccaggctggagtgcaacagcgcgatctcagctcactgcaacctccacctctgggttcaaacgattctcctgcctcagcctcccgagtagctgggattgcaggcatgtgccatgacaccctgctaattttgtatttttagtggaggcgggatttctccatgttggtcaggctggtctcgaactcccgacctcaggtgatccactgcctcagcctcccaaagtactgggatcacaggcgtgagcctccgcgcccggcctgctgatttcaaatatgcagcttaccttatgttttacttccagcaagacgtccaccagcctctgcagcatctgatgatgggccccgagctgcgtggcagacacacaaggggttagctgaaaaggcagtgggtggcggggggaagctcactccactataaatacaccacgttttaaaagcaatcctaggccaggcacggtggctcacgcctgtgatcccagcactttgggaggccgaggtgggcagatatctaaggtcaggagtttgaaaccagcctggccaatatggtgaaaccctgtctctactaaaaatacaaaaattagctgggtgtggtgacacactcctatagtcccagctactgggaaggctgaggcaggagaatcacttgaacccaggaggtggaggttgcaatgagccgagaccgtgccactgcactccagcctgtgtgacacagcgagtcctgtctcaaaaaaaaaaaaaagcaatcctaatgatggatcaccactttcttcattagatctacaccccagcaagcgattacctttaaaaacacgcctatcacagaaaccattctctcccacgacagcttccttgtaattttggtatttcacagaattccagtgaactaaatgcagctgaaacacaatggaaagagaacttaaattgatcagcaagaaataagacagtcacttccccttctgaatggctgacctatgtgtccacttaatcataatgaaatggccaggcgcagtggctcacacctgtaatcccagcaccttgggaggctgaggcgggtggatcatgaggtcaggagatcaagaccatcctggctaacatggtgaaaccccgtctctactaaaaatgcaaaaaaaaaaaattagccgagcatggtggcgggcgcctgtagtcccagctactcaggaggctgaggcaggagaattgcctgaacccaggaggtaaagcttgcagtgagctgagattgtgcctctgcactccagcctgggtgacagagcgcgactccgtctcaaaaaaaaaaaaaaaaaaaaaaaaagaactaagttgttgcagccagatgtgtaagatcccagcactagcagcacctctgagctcccaggcacttgatgaagccatgggaaggaagagcctcagtcttcctggtggtgggaaaaaggagaggatcatgttaacctcatccaatagaaatgggtggtttcattattttctacttcctagttatccttggacaaggattaccagaaaaaactcacgcctcggctgggcgtggtggctcacgcctgtaatcccagcactctgggaggccgaggcgagtggatcacgaggacaggagttcaagaccagcctggccaagacggtgaaaccccgtctctactaaaactacaaaaattagctgggcgcggtggcaggtgcctgtaatcccagctactcaggaggctgaggcaggagaatcacttgaacctgggcagcagaggttgcagtgagccaagattgcgagatcgtgcgatcgcgccactgcactccagcctggggaacagagtgatactcagtctcaaaaataaataaataaataaaatatctgttcatcaaaaataaagttgcagatagagatactaaaataaaaggcatgttgttaaatgaaaggaagcacacagaagccattgttgcgctcattcttggaactatttataaatatctgtatgatgatgacaatagatatcactccctatttataaaatgtccggaggtcacctctgggtgtgcgattacaagcaattttcattttttggtttgggtgcactctagttccacattaactgcagcattactttcataacaacaacaagttcaaaaaacagaaagagtcctcaacttgaaaaagcatcaagaagtcaggtgagtgggtgagcagaggtgtgataaagtgaatatggcaaaaatgatcatcacaggactgagacgtcaaactcatagattcttcttgttcatttcttttcattttttcgtatgttgcaaaaatttcataataaaatatttggggaaatctataaggcatcacttatcacccaaaaaaactacaaaaaccaattcccagcattgatctgcactcattttctctactgactcccactttggaatgttgaaaataagactgctttaagaagatgatcttggccgggtgcagtggctcacgcctgttatcctagcattttgggaagctgaggtgggtggatcacttgaggtcaggagtttgagaccagcctggccaacatggcgaaaccacatctctactaaaaatacaaaaattagcagggcctggtggcacgcacctgtaatcccagctactcggaaggctgaggcaggagaatcgcttgagcctgggagatggaggttgtggtgagccaagattgcaccaatgcactccagtctgggtgacagagtgaaccctgtttcaaaaaaacaaaaaacaaacaaacaaaagaagatgatctctattgcaaagatgttcagcttctcagcggagggccttgtggatttgctagtccctacagctgcaagcacacagctgagtgaagcgtggcaaagagctcaagctctgactttgaatcccagctgtctggctttggcaagttccgtaaccattcagaacctcagtctcttcttccgttaaatgagagaacttacagtgtcttcttcgtaggaggggggtgtgaccaaacgggtggggcggccgacggttctggtttgagcactgacagtcccaggccccaggaaatccttcacatctgagcggcaggcatggcttgttcaccccccaccatagagccggagacatggaaagcgtccagatatgtgctgttaggccacgtctacaaacctctgcggggtacacgtggccgtccactgtgtgctctgagcccccctcgttcactgctccccagtggaagtgaaattgcttcagtctgtagtggttttccaagggcccgccactaattcctggaaataaaggcagcgagacgtgtgtgtcattttgtctgtttgttgagctgtggtgttacctgaggcattgtctacattagggttatatgagttcactcgcaaggggttgctgtatggttgaagtgacaagccaaaggtgggctccgtgaaaggtgggctctgtctgtcccattcactctgccccccgccagcccagcgcctgcccagaggttcacagtaaatgtggaatgaaggcagggtcccagtgctgccactgggtggtggtgagggcctcatctccctgcaggcagaaatcggtaaagaaagtttctgagatgcctgcctgtcctataagatttccagactttaatttaaaaaaaaaagatgtcttccaaatattttttaaaagcagcttaaatcctatcaccaaataacattataaaataacacaatgagcaaagtttttgttttgttttgttttgttttgttttgttttaagacagaatcttactctattgcccaggctggagtacaatggcatgatctcagctcactgcaacctccacctctgggttctagtgattctcctgccccagcctcctgagtagctgggattacaggcatgtgccaccaggccaagccaatttttgtattttaagtagagacggggtttcaccatgttggccaggctggtctcaaactcctgatctcaggtgatccactcgcctctgcctcccaaagtgctgggatgacaggtgtgagccaccgctcctgggtgagcaaggtttttaaataagcagaccctgagctatagcatcagtcctgatctctggcagtccctgcttaatctaggcccaccacagggccagcttttattggaacactccttccgtcctaagtcaccctaaacactcaccttggagtcagcgctctccacctgcaggccttggggtgcccctctccatggcacagtgccaggtgcagcctcccaggagcttccttctcctgacacgtggggctcagccataagcatcgctcactgaggcctctggctctgcctcacagagtcatggctgccatccccaggtccaggtagtgctgggagtctgccttttaacgagctccccaggggttctgatgtgggtggcttctcctgtgtctaagcactttgtcactaacagatttccatcaacagctgctacaaatgtggtacctattccacacgttttcattgaaaggagcacagtgtgctcctgggatggctgggcaaggctggaaggcgccagcagaactggagcactgatcacgaattcgcggtggcccgagtgcctcccgtagctgtggaggagcctcgtgtcacccgccttgctcatgtcacctcccactgtggcaaaagccaggaaaacactgagcgcatgacaaatgccttggggagcttgacagtgctgactcctggtggtttcctgacaccaaaagtacttgggctgggcgtggtggctcacacctgtagtcctagcactttgggaggccgagatgggcggatcacttgaggtcaggagttagagaccagcctggccaaggtggtgaaacccatctctactaaaaatacaaaaattagctgggtgtggtggcgggcgcctgtaatcccagctactcaggaggctgaggcaggagaattgcttgaacctgggaggtggaggttgcagtgagctgagaacgtgccactgcactccagcctgggcgacagagtgagactcagtctcaaaaaaaaaaaaaaaaaaaaaagtactcatagttggaggcaccaaggtgtaaactggaaaatggaaaatggatttggctttggtccagtcaggggctaggcaagtgctggaccaagccacagagctgctcactgcccctcttcactcaaaatctcagtgttggtctggagcaacctcggagtcatatctagttttaaaattctaccattatgagcaagtcttctagtctccttaaatatacacagatgaattacatctcaatttttaaaaatacacagaaagagtgcttcacacaataagcacattaaatcactttgttaggccaggcacagtggctcacgcctgtaatcctaacactttgggaggccaaggcaggtgtatcacttgaggtcaggtgttcgaaaccagcctggccaacatgctaaaacctcgtctttactaaaaatacaaaaaattagccaggtgtgttggtgggcgcctataatcccagctactcgggaggctgaggcaggagaattgcttgaacccgggaggcagaacttgcagagagccgagatcataccaccgcactccagcctgggcgacagagcaagactccgtcttgagagaaaaaaagaaagaggccaggcgccgtggctcacgcttgtaatcccagaactttgggaggctgaggcgggtggatcacaaggtcaggacatcaagaccagcctggccaacatggtaaaaccccatctctactaaaaatacaaaaaattagccagatgtggtggcacgtgcctgtaatcctagctactcaggaggctgaggcaggagaattgcttgaacctaggaggtggaggttgcagtgagccaagattgcatcactactctccagcctgggcaacagagtgagaccccgtctcaaaaataaataaataaggccgggcgcagtggctgacacctgtaatcccagcactttgggaggccgaggtgggcggatcacctgaggtcaggagttcgagatcagcctggccaacatgatgaaaccccgtctctactaaaaataaaaaattagctgggtgtggtggcatgcacttgtagtcccagctacttgggaggctgaggcaggagaattgcttgaacataggaagcgaaggttgcactgagccaagatcgtgccactgcactccaccctgggcaacagagtgagactctgtctcaaaaaataataataataaataataaataaataaaataaaataaagtctactcttactcttaaaaaaaaaaaaagaaaaaaggccaggcatggaggctcacgcctgtaatcccagcactttgggaggccagggcgggcatatcacgaggtcaggagatcgagaccatcctggccaacatggtgaaaccctgtctcaccgggtgcggtggctcacgcctgtaatcccagcactttgggaggccgaggcgggtggatcatgaggtcaggagttcgagaccagcctggccaagatggtgaaaccccgtctctactaaaaatacaaaaattagccgggcgtggtggcacacacctgtagtcccagctacttgggaggctgaggcaggagaatcgcttgaacctgggaggcagaggttgcggtgagccgagattgtgccattgcactccagtctgggtgacaagagtgaaactccatctggaaaaaaaaaaaaaaaagaaaccctgtctctactaaaaatacaaaaattagctgggcatggtggcatgtgcctgtaatcccagctactcaggaggctgaggcaggagaatcgcttgaaccaggggagttggaggctgtggtgagccgagatcgcgccactgcactccagcctggcgaaagagcgagactccatctcaaaaaaaaaaaaaaaaaaaaaaagaggccaagcgcagtggctcaggcctgtaatcccagcactttgggaggccaaggcgggtggatcacgaggtcaggagattgagaccatcctggccaacatggtgaaaccccgtctctactaaaaatgccaaaattagctgggcatggtggtacgtgcctgtaatcccagctactcgggaggctgaggcaggaaaatcgcttgaaccagggagtcagaggttgcagtgggccaagattgcttcattgcactccatcctggcaacagagcgagactctgtctcaaaaaaaaaggaaatcttcctgcctcagctcctgagtagctgggattacagatgtaagctaccacatctggctccaatttaagtatccacatgtggctagttgttatctattggaacacgcagttctggaggctttaatatagggactccttatggagaaatggatatggttaaaggaggctacaaggaatgctgaagccctaagagactagcaactattggagcctgttactgcttctaggactgatggggtaacaggcagaaactgtgttaccgaaactcattaaaacctggggatgtagaaggggccacctgacaggtgctgcagatgtgggtggggagatgaagccactgccagagatgtgaggcacagcaggaagggagcagaatagaaatgtcctgactgtcctcccccttggagctccagccagtcctccctttagctaaactcaagtgaaatccaggccgggtgcggtggctcacccctgtaatcccagcactttgggaggtccaggcgggagttcgagaccagcctggccaacatggcaaaaccctgtctctatttaaaaatacaaaaaaattagttgggcgtggtggagggcacctgtaatcccagctatttgagaggctgagacagaagaattgcttgaaccggggaggcggaggttgcagcgagccaagatcctgccactgcactccagcctgggcaacagatcgtgactccatctcaaaacaaaacaaaacaaaacaaaaaacagagggtgggggagcctccagggcagagggtagggctgagaataggtctgggagtgagggtagatgatgaccagcccagagccacaaaccccaaaacatcacctctgaaccccagggctctgaggaaccctgtctgaaaccacttcctaggtgggacacatccaactgaacggaaacagaactgaacagatacgagggtggggggacccctggaggtcccttctgagggatctttgcttagttctgttctgttcctttcttttttcttttcttctttccttttcctttccttttctttctttctctttctctctctcttcctttcctctttccttttttttttttttttttaaccgagtctcgctctgtcacccaggctggagagtacagtggcatgatctcggctcactgcaacctccgcctaccgggttcaaatgattctcctgcctcagcctcccaagtagctgggattacgggtgcctgccaccaagtccagctaatttttgtatttttagtagagacaggattttgccaagttggcaaggctggtctcgaactcctgacctcaggtgatctgctcaccttggcctcccaaagtgctgggattataggcatgagccacctcgcctggcctttactgagttcttaaaggctgagacaggaaaagaaaaatagtaaactctgtgcgtaatttcactattttcttgtttaactttatgactgtcctggagagggcagcatcattacctttaatttagagctgggacagggacagtctgtgacacttatcttgatattgaggaatggagtcagtcctccaatggagggaggccgattgaggtgtgatactgagtgccccatcagttgttcaagggctggggcagatctaatattgtgtctgtactggctgatacttaggtggccagggccccagctttggaaacctgtgatggctgctaccacctctggctttgctaggcgcacacatctgcccagactcaatgtattgcaaacccatgcaacctccaggcccacactgagaatcaagaattgtggactcttgattctccaaatcttctcaaaagcccagctgctggctgggtacagtggctcacatctgtaatcccagcactttgggaggacgaggcgggcggatcacttgaggttaggagttcaagatcagcatggccaatgtggtgaaaccccatgtctactaaaaatacaaaaattacctgggcatggtggcaggcacctgtagttccagctacttgggaggctgaggcaggagaatcgcttgaacccgggagacggaggttgcagtgagccgagatcgtaccactgcactccagccttggtgacagggcgagactctctctcaaggcttgagggctgagtgaacactccttaactatttccagttatagccacgggtcgacttagatcaacagaagtctgtatggattactctaatagagtgcaaaaagatctgaactaggacctcattgtgaattcggatcctaccccttaccagctgtgtgaccgtgggcaagacacagaatctctgagctgtcactgccctctctgtaagtgaagtggcacccacttcttatgtctgtgttggtcctcttctcctaattgacactcactcgtttttcgttgttttttttttgagacggagtgtcgctctgtcgcccagactggagtgcagtggcacgatcttggctcactgcaagctccgcctcctgggttcatgcaattctcctgcctcagcctcctgagtagctgggactacaggcgctcgccaccacgcctggctaatttttcgtatttttagtagagacggggtttcaccgtgttagccaggatggtctcgatctcccgacctcgtgatctgcccgcctcagcctcccaaagtgctgggattacaggcgtgagccatggcgcctggccactcttttttttttttttttttttaactttgagatagaatcttgttctgtcacccaggttgaagtgcagtggcataatcctatctcactccaaactcaaactcctgggttacagcaatcctcccacttcagcctcccaagtagctgggaccacaggcacatgcccccctgcctggctaatttttaaaattttaagtagagatagggtctcaccgtgttgcctaggctggtctcaaactcctgggctcaagtgatcctcccaccttggcctccaaaagtgttagggttacaggcatgagccatggtgcctggtgacactcactcttgagttgagctcacacagacccctggctttaaatatcatccaaatgttgatgtcccccaagttttcatcttcactgcagacctcttctgtgagcttcagaactgctcacttgaaacttccccttgggtgtctgacaggcaacacaaacttaacatgtcccaacatgaactttttttttttgagacagaatcttgctctgttgcccaggctggagtgcagtggcctgatcttggctcactgcaaactccgcctcccaggttcaagtgattctcctgcctcagcctcccgagtagctgagattacaggcacgtgccaccacacccggcaaattttttgtatttttagtacagacagggtttcaccctgttggccaagctggtttcaaactcctgagctcaagcgatctgcctgcctctgcctcccaaagtggtaggattacaagtgtgagccaccgtgcccgggcccaaaatgaactctttatcttctcccccatacctgctcctcctgcagccttcccatatcagaatacaacaattctattcttacagttggtgtggccgaaaaccttggtgttgtcctcaatcctctctcacacatccccaaatccaatctgtcaagaaaccctggtgatcacttgagcccaggagtttgagaccaacctgggcagcatagcaagaccctgtctctacaaaaaatacaaaaatcagcggcagggcgcagtggcttacgcctgtaatcccagcactttgggaggctgaggcaggcagatcacaaggtcaagagatcaagacaatcctggccaacatggtgaaaccccgtctctactaaaaatacaaaaattagctgggcatggtggcacgtgcctgtagtctcagctacttgggaggctgaagcaggagaattgcttgaaccagggaggcagaggttgcagtgagccaagatcgtgccactaccctccagcctggtgacagagcaagactctgtatcaaaaaaaaaaaaaaaaaaaaaaaaaaaagctgggcatgatggcacacacctgtggtcccagccactcaggaggctaaggtgggagggtcgcttcagcccagaagttggaggccgcagtgagccataattgcaccagtgtactccagtctgggccacagaataaaactctgtctctagaaaacagaacaaaacaaagttgaagctctctaaactctccacactgactcagagtgaaagtgctaataatgacctaaagccgtgccctatggccccctttcctcttgacttcgcttttcatgcactctgctccagccatactggcctccttgggcttcccagaacacgcgaagcaggacccaggttagggcctttgaactggctttgtttgtccgtgggattccccatgaacatctcatggctgctccctctcttccctcaagtctcccctcagatgtccccttctcagagacatcagcctgtagaaaggagcacttccttcccccactttcctgcgtgatgtttctccatgatgcctgcttcctacatatgtagagtctgtctcactccggagaaggctacctccaagaggacaggtgactggcccttgatttcattaattgtcacaatcctatgccggacacatggttggtgttcaacaaatatttgcggaattaaagaacaaattaataatgttgtgagataaatactctgtgcccatttttctttactttttaatatattttttaaatctagagagacagggtctccctatggtccccaggatggcctcaaaactcctcctgccttggcctccttggctgggattactggactactactgtgccaccatgcctggctcttcttttccttttactatgcccattttaaaggtgaggaaaactgagactcagaaatgttcccaagggcacacagtgagtggtggctgccttcaggttggtctgactccagtgcccaagcctttctcaggagtggtgtgttgcccatcagccattatatccatgacatcaactggcataagatatgttcttatatgaaaattaattttagaagtgagtgtcacgaaatattgaccttctctaaggaactagttcttatagtcaaaaaggaggaacttatgtaaattttccctttcagggccagccccaggaagttcagagcctaatgtggtgttcattctattaattttttcttaccctgggacttttttctttctttcatttatgttaacctaatcaccagctgcttcctgttccttaggaaatagctaagtcgtacatgacacttttggggttccagtgtgcccggcatgggttttctttcattgggcaggcactaggtgggcttttcagcctgaagacgcatgtttctcatcagagtgagaatgatctctgatcattctccttcttccatttcttgggttctctcttcctggcactcctattggttagcttttgggcctcttggattgcctggctgtgtctctgtggcaaagactactcattatccaaaatccaatgagcccttcttccccaagaacatggtggaactgcatgtcccagcctcccttgcagtaggcatggtcatgtgactaagtttccaccaatagaatgtgaggaggtgatgtatgtgacttctggtctttggccttaggaagtaggccagcttcatactctccattcctgctggctggagatccccacaacagattcaaacgtgcaggtgacaaacggtgccctaccgatggcagaaaagtgatgaggaagggcccttggtccctgagcaatgagagaagcagagctgcctccctaactaccaccatttcacttgaacatgtctcttcttttgtttatttatttatttgttttttgcagacacgtctcttcttttttttttttgagatagagtctcactctgtcccaggctggagtgctgtggcacaatctcggctcactgcaacctctgccttctgggttcaagtgattctcctgcttcagcctcccaagtagctgggattacaggcatgcgccaccatgcctggctaatttttgtatttttagtagagacggggttggccaggatggtctcacactactgacctcatgatccacccaccttggcctcccaaagtgctgggattacaggtgtgagcaactgcgcccggccgacacgtctcttctttaagccgccacttattggatctctatgttagagcggcagtctcatatattttctctcatattttcttctccacccctacaccttctgggagttctattttctgggataattaattaattaatcaatttttgagatggggtctcactctgtcccaggctggagtgcagtggagcgatcttggctcactgcaacctctgcctcctgggttcaagctattctcctgcctcagcttcctgtctcaaactcctgacctcgtgatccacctgccttggcctcccaaagtgctgggattacaggcgtgagccaccgcgcccagctttatttattttttaaattttttattcttgagacagagtctcactctgtcacccagggtggagtgcagtggcataatcttggctcatggcaacctccgcctcccgggttcaagcgattttcctgcctcagcctcccaagtagctgggattacagacgcctgccaccacacctggctaatttttgtatttttagtagatggggttttgctacgttggccaggctgatctcgaactcctgacctcaggtgatccgcctgccttggtctcccaaagtgctgggattacaggcatgatccaccacacctggcagttttctgggataatttattaactttttattacaacacttcctgtttgtgtttgtacagatgaggccttgctatattacccaggctggtcttgaacttctggcctcaagccattctccttggcctcccaaactgcaggaattacaggagtgagctactgtgcccagcttctttattctaatgcttttagtaattcagtatcatagctttaatttctaagaattcagtctttgctctatttatttatttatttgagatggagtctcactctgtcgcccaggctggagtgcagtggtgtgatcttggctcactgcaacctcctcctcctgggttcaagcgatcctcctgcctcagctcccagaatagctgggactacaggtgcctgccaccacacccggctaaatttttttttgtatttttagtagagacagggtttcaccttgttggtcaggctggtctcgaactcctgtccttaggtgatccacctgcctcagcctcccaaagtgctgggattacaggcgtgagccactgtgcctggcctctttcttttttataacaccctgtttttattgtaacatagtgtagcaattttttttttctttgagatggagccttgctctgtcgcccagctggagtgcagtagtggatctcggtttaactgcaacgtccgcctcccgggctcaaatgattctcctgcctcagcctcccgagtagctgggattataggcacctgccactgtgcccagctaatttttgtatttttagtagagacagcgattcaccatgttggccaggctggttcgaacccctgaccccaggtgatcagcccacctcggcctccaaaatgctgggattacaggtgtgagccactgcacctggccagcaatatcttttttttttttttttttttttttttggggaaagagtcttgctctgtcgcccaggctggagtgcagtggcgcgatctcggctcactgcaagctccgcctcctgggttcatgccattctcctgcctcagcctcccgagtagctgggactacaggcgcccgccatcacgcctggctaatttttttgtatttttagtagagacggggtttcaccatgttagccagaatggactcgatcttctgatctcatgatccacctgcctctgcctcccaaagtgctgggattacaggcgtgagccaccgtgcctggcccatctttttttttttttttaatatggggtcttgctctgtcacccaggccagagtgcagtggcatgagcacagctcactgcagcctcaaatacccaggctcaagtgatcctcccacctcagcctccagagcagctgaaattacaggcacgtgctaccacgccctgcccagctaatttttttttggaagcagcaccttcatttattagggacttcggtggggatggggaaaggcggcccccgggtcagaggcgccggaagaagagcttggagccgtggtctaacgtgcactcgctggggcccagctggctcccgcccagctctttttttttttttttttttttttttttgagatggagtctcactctgtcgcccagactggagtgcagtggcgcaatcttggctcactgcaacctctgcctcccgggtttaagcgattctcctgcctcagcctcgagtagctgggattacaggcacccgccaccacacctggataatttttgtgtttttagtagagatgaggtttcaccatgttggccaggctggtctcgaactcctgacctcaggtgatccacctgcctcggcctcccaaagtgctgggattacaggcatgagctactgtgcccagccccgcccagctaattttttaattttttgtagagacaggatctcactatgttgccagggctggtttcaaactcctggtctcaagcgatcctcccgctttggcctcccaaagtgctgggattacaggggtgagcctcgtgcctggcctgaagcagcattttctcaaatgtctttaaaaataccagatttttttttttctttttctttttttcttttcttttcttttcttttcttttctttttttttttaagacggaatctcgctctgtcgcccaggcgggagtgcaatggcgcgatctcactgcaagctcactgcaagctccgcctctcgggttcatgccattctcctgcctcagcctcctggtagctgggactacaggcgcccgccaccacgcccggctaattttttttgtatttttagtagagatggggtttcaccatgttagccagaatggactccatctcctaacctcatgatccacctgcctctgcctcccaaagtgctgggattacaggcgtgagcgatcgcacccagcctctttttctttacgtaaattctgtttcctccaggattacttttcttttctttttcttttttttttaaatttttttgaatgtacttaggatgcatttggctacaaataactaaacatccgacttacaggaagctcacagaagggggtggctgggattcagggccccttgatcaggcatttgcgatgccttgggatcccatgctcttcctcccattcctcctctgcaatcctgcaatgtttccatcctggggccagttcctctcagagttacaggatgtatccttaatcatggcttgtgggaggcagaagttactgcccccgggttctcttttaattaaaaggaagaagcctttcttagaagcctcccttccttttatcttagtggctagaactggggcatgtaccctttcctaatgcaatcgtgggcagaaggggagtggttactttagactggtcagactttgctggagctgaagaaggaaggggtcagtgcccaggatgtgtatgctggtgggcacctgaacaaactggggtacttttaggaaagaaggaggcagaatggatgatggggttggtttatcttggtgctttcctttcatgttgcagggtttctttgaatgttgttgatatttcttccaggcgtgacggctcatgcctgtaatcccagcagtttgggaggccgaggtgggtggaatctcttgcgctcaggagttccagaccagcctgggcaatatagggagacctctgtctctacaaaaattagccaggcgtagcggtgtgcacctcccagttttgctgggaggattacttgagcccaggaagttgagttgaggctgtagtgagctgtggtctcaccactgtattccagcctgggtgacagagtaaaaccctgtctcaaaaaaaaaaaaaaaaaaaaggttgatatttctttcaagtcccatcatacttcagagtgagccaataagaggctgactggggcttttggtaccagagtagagctttccaacttgagggttggactttcatatcaagtgtgagaataaactaaagacctatttaggtgcaagattactttgggcacggtggctcacgcctgtaatcccagcactttgggaggctgaggggtgacgatcacctgaggtcagtagttcgagaccagcctggccaacatggcgagaccccgtctctactaaaaatacaaaaattagccaggcatggtggcgcctgcctgtaatcccacctactagggaggctgaggcaggaggatcgcttgaacctgggaggcagagtttgcagtgagccgatattgccccactgcaccccagcctaggtgacagagtgagacaaaaaaaaaaagcaaagttcacctttttattagggagctttctttggatgtgacttgaaaatgtgctcctgcaaaattaagagggtaaatcacaaaagagaagggtgcagactacaggaaataggagatcccacccaagagagaaataaccactggtcccaagatgtagcagtgtagcaacagggagtgggaggggagaaggaaggtcacactggagcaaggaattagtgaagcaattagaaactctaggtaaaattaaaagagatgtattgtagtaaatttactatgatacattatcgtagtaaatatcgctaaaattttatatatatatataaatatatatatttatataatataactgaacaatagttatataatgctttttttttttttctgaggtggcatcttgctctgttgcccaggctggagtacaatggcacgatctcagctcactgcaacctccgcctcctgggttcaagcgatcctcctgcctcagcccccctagtagctgggattacaggcacgcgccaccatgcccagctaatttttttatttttagtagagatggggtttcaccatgttggccaggctggtctcgaactcctgacctcaggtgatccacccgcctcggcctcccaaagtgctgttattacagacgtgagccaccgtgctaggcatttttttttttttttttttagagacatggtctccctttgtcacccaggctgcagtgcagtggtatcatcatagctcactgcagtcttgaacttctgggctcaagtgattgtcccgtctcagcctcctgagtagctgtaagtacaggcatgtgctaccatgcctggctactttttttctttttttctgtacagatggcaccttgctatgttgccccagctggtcttgaactcctgacctcaagtgatcctcctgccttggcctctcaaagtgctgggattacagacatgaggcaccacatccagccccataatcttaaaaacaaagaaaattaatagttttccattttagactcaaactctggaccagacagcactgatcttgactatctgaggtgatagaaatagcctttatctgtgttatttgatttgatagctactagccacatgtggtttctgaacacacttgaaatgtaactagctagttgcaactgagggaactaggttttaaatctcattaaattttaattaagttaaagtagtctcctgtggccagtggcttctacattaggcaatgcagctctaagcaagatgaaagagagaatgccaatattatctacatttaacaacataaaagtaaatgtacaggtaacagaaatgagcagaagagagataaaggaaagccactatcttcatgtcacaaagtgataagaatttaggccagaagctgtggctcatgcctgtaatctcagtacttttggaggccgaggcaaggaggatcgcttgagcccaggaattcaagaccagcctgggcaacataatgagatccctgtctctacaaaaaaaattaaaaattagctgggcatgatggtgcacacctgtagtcccagctactcaggaggctgaggtaggattgcttgggcccaggagttcgagggtgctcatctctttaaaaataagtaaataggtcaggtgaggtggctcatgcctataatcccagcactttgagaggctaaggtggacggattgcttgagcccaggaaattgatctcagcctgggcaacagcgaaacaatgtctctacaataaatataaaaagtaaccaggtgcatgccgggcgcggtggctcacgcctataatcccagcactttgggaggccaaggcagggtggatcacaaggtcaggagatcgagaccatcctggcgaacacggtgaaaccctgtctctactaaaaatacaaaaaattagccgggcatggtggcgggtgcttgtagtcccagctactcgggaggctgaggcaggagaatggcgtgaacctgggaggcggagcttgcagtgagccgagatcgcgccactgcactccagcctgggtgacagagcgagactccgtctcaaaaaaaaaaaagtaaccaggtgcggtggcacacacctgtagttccagctacttggaggctgaggtgggaggatcactggagcccaaggttgcagtaagctgagatcaggccactgcactctagcctgggcgaaagagtgagaccctgtctcaaaacaaaacaacaacaataataaaactcatacataactacgtaaataaagttacaaaagcaactttagttcgttacaaaggacctgaagagagggatttaactgacctgcaaggtggaatggggctggagcagggccagtgggtcagacacctatgattatgccaggcaaaatggatacatgaagaaataaagttatagcatctccatgtagtaatagaaaaaaaaaaggaataacgaaattagcacactttttgggaatgtggacccaccagtagaattgagactagaaaaagttaaaagcattagaagtgttctctttctgagatcatgacttgttggggaaagggaagacttattgttcatgacaaacacttctgtgcttataacatgcattagcttaggaaacagcacttttctttttctctttttttttttttttttttttttttgagacaaggtcttgctctgtcgcccaggctggaatgcatgttgcgatctcggctcactgcaacctctgcctcctgggctcaagcgatccttccaccttggcctcccaaggcgctgggcgctgggattacaggcatgggccaccgtgcccggcctggtgcttttcagtgaataaataagtatgtaaacttctcttttctgactagacggaaattccccagaggacaagggtggcgtgacttgtcagtccttttcattgacagcgctgtggatgggaagaaagggcccctggtcccaagcaagccccagtcctgtggccctggaggatcagaagggtaattaagtgtcaaaggaaaacatagccagacatgagttactgtggtgaaaacagattttattcagtaactactcgtggtaggagaaagagctgagctccattctgatttgtgcagaggtgatttaggcatttaattagttaattagtttttgtgggacagggtctcgatctgttgcccaggcttgtgattgtgcctgttgctcagattgtgcagtggcacaatcatggctcactgcagcctcgaactcccaggctcaagtgatcctcctacctcagcctcctgagttagctgggacccacaggcgtatgccactgcacctggcttttttttttttttttttttttttttgaaacagagtctcgctctgttgcccaggctggaatgcagtggcatgatcttggctcactgcaaccaccacctcctgggttcaagcaattctcctgcctcggtctcctaagtagctgggattacaggcgcgtgccacaatacccagctagttttagtttgttttttatttatttattttttttagtagaaacgacgtttcaccatgttggccaggctggtctcgaactcctgacctcaggtgatccacccacctcggcctcccaaaatgctgggattacaggagtgagccaccgcaccagtgtctctctcttataacaccagctagtccttatcaggctttgactgtgggcccctcacctgtctaacttatccttcccaggaactttgaagaatactattattattcctattttgcaaatgaagaaactgaggcagattaaatgcctgacccaaggccatccagacggcaggcgatgcaggcaggagtcaagctcaggtacccctccccttctgtggcttccctgcctccaggcttctgccagcccctgtctaccttggtgtaggagcggcccctcaaagacctgcagggagccgggcacggtggcgcacgcctataatctcagcactttgggaggctgaggtgggcgtatcatgaaaccctgtctctactaaaaatacagaaattagccgggtgtagtggtgggcacctatgatcccagctactcagaaggctgaggcaggaggaacgcttgagaaccccagaggcggaggttgcagtgagccaagatcgagccactgcactccagcctggacgacagagcgagactccatctcaaaaaaaaaaaaaacctgtagagggaaggaggaactggggcctggggagggcagagctattatctcaggagaagcaggcaaacctctggtgacctctgatgacctcagggcaggatgggcaggccttcacaacagctccaggcacacccagcctcccgtccctggcctcatcactcccctctctgccctccaccctttggcctccttgcctttgtccacagttctgcagcctgataccctcttccttgtctcaaccagagaagtcttcagtcaataaacgtcatccaatgcctactgtgtgtcaagcacttcctgggtgctggggcactgtgcaagcacacacgcacagctgtgaggccatggggctggcattccagtgtggggagagcgacggaagcaaaataagaaagtccattacatggcgcatttgaaggcgcgaagtgctatggggagaaagcaaggaggggggttacagtccagagggaggggggtgcgattttttttttttttccagacggagtcttgctctgtcacccaggctggagtgcagtggcgtgatcttgcaaactccgccgcctgggttcacgccattcttctgcctcagcctcctgagtagctgggactgcaggcacccgccaccatgtccggctaattttttgtatttttagtatagacagggtttcaccgtgttagccaggatggtcttgatctcctgaccttgtgatccacctgcctcagcctcccaaagtgctgggattacaggcatgagccaccgcgcccacccgggggtgagattttaaatacaatggccagctgggctccgtggcacacacctgtaattccagcactttgggagaccgaggtgggaggctcacttgagtctaggagtttgaaacaagcctgggcaacaaagcaagatcccatctgtatgaaaaatttaaaaattaggccgggcatggtggctcatacctgtaatcccagcactttgggaggccgaggagggcagatcacttgagctcaggagtccgagaccagcctggccaacatggtgaaacactgtctctactaaaaatacaaaaaaattgctgggcgtggtggctcacgcttgtaatcccagcactttgggaggccgaggcaggtggatcacctgaggtcaggagttcaagaccagtctggccaacatggtgaaaccctgtctctactaaaaatagaaaattagatgggcttggtggtgggcacctgtattcccagctactcaggaggctgaggcaggagaatagcttaaatccaggaggcggaggttgccgtgagccgagatcgaaccattgtgctccagcctgggcaacgagagtgtgaaactccatctcaaaaataaaaataaaaatacaaaaaattagccgggcatggtggcgcgcacctgtaatcccagctactcgggagactgaggcgggagaattgctggaactcgggaggcggagttgcagtgaaccaagattgtgccactgcactccagcctgggagacagagcgagactccatctcaaaaaataaaaaattaaaattaaaagttagactggtgtggtggcatgtgcctgtagtcccagctacttgggaggccaaggcgggaggatctcttgagcccaggaggtcgaggctgcagtgagccatgattgtgccaatgcactcaagcctgggtgacagagtgagaccctgtgtctaaaacaaacaaataagtaagtaaataggttggccaggcaaagccatcctgagaaggtgacatttgagcaaagactgagaaagcagccaagcaacatctgggtggggagccctggggcagccaccacagatggcgcaaaggccctgggcttgctttctccagggacacatcagaggtccgggtggcaagggcgtggatggcagggccatgggtggaagggcagaagcaacgtggataagagaggtaggcaggggtcagatcggatgtggccaacttggcttctaccctgagtggggtgggagtggtctcagggctccaagcagaggaggggtggggtcagatgtttcatctgggtccctctggctgctgtgtggaaaacagcccggaggaggatgagatctcacacagggagaccagagctgagatgactgcaccagtccaggccagagaagacagaggctcaggccagtaggcagcagtgacggggcgaagagggatcagattctggatctttctctctctctctctctcttttttttttttttttttttttttttttttacagacaaggtatcactgtgttacccagggtggagtacagtggcgaaatcatagctcactgcagccttgaactcctgaactcaagcgatcccttctcctgagtctcccaaagtcctgggattacaggagtgagccactgtgcccagggcaggttatacattttttttgggaacaccacagaagccaagcacagtggctcatgcctgtaatcccaggacttctggaggcgaagatgagaggattgcttgagcccaggagttcaagaccagtctgggcaacacagcaagaacccatctctaaaaaaaaaggaatactgctgggcacggtggctcatgcctgtaattccagcactttgggaggctgaggtgggtggatcacctgagattaggagtacgagaccagcctggctaacatggcgaaaccccatccctaataaaaatacaaaaattagctgggcatggtggcagggacctgtaatcccagctattcaggaggctgaggcaggagaattgcttgaacccaggaggcggaggttgcagtgagccgagatcacatcactgcactccagccagggtgaccatgcccagccaactatgtaaatatcctatacacacacactcttctgatttcaccaatggttttaacactcactcttacctgaatccattattattatattggttatgtttatcattttttaaattctacattccttttacaattgttagctttcctacagtaaaataactttccagtggccgggcacagtggctcatgcctgtaatcccagcactttgggaggccgaggcaggtgaatcacgaggtcaggagttcgagatcagcctggccaacatggtgaaaccacatctctactaataatgcaaaaattagccaaacgtggtggtgcgcacctgtaatcctagctacctgggaggctgagggaggagagttgcttgaaactaagaggcggaggttgcagtgagccgagattgcatcactgcactccagcctgagcgacagagcaagactacatctcagaaaaaataaaacaaaaacaaaaaaaacttccatactgtcctacctcccttccctgctccctccctccttctctttgtctctaatattttcagaatcagtatgaactcattttcttttcttttttttttttttccaagacaaattctcactcttttgccgaggctggagtgcagtggcatgatctcagctcattgcaacctctgcctcccaggttcaagcgattctcctgcctcagcctcccgagtagctgggactaccggcgcccatcaccacacctggctaattttttggtaatttttagtagaaacggagtttcaccatgttggtcaggctggtctcgaactcctgacctcaggtgatcctcccgtctcggcctcccaaagtgctgggattacaggcatgagccactgcgcccagcctctttttttcttttaattaaaacaattaaatagagatggggttctctgtctgttgcccaggttggtcttcaactcctgggctcaagcaatcctcctgtctcgggctcccgaagtgctgggattacaggagtgagtcaccacgcccagcctaagtattgctcttctgtgatgatttgcaggcaacaatcacctcttgttcatattttcattatctttccctccaccccgagcctatagtctgtcttggtcagaccccatttcttgagtgcaccaggctggagtttggacccatccacatcctcgcagctctcctgagttggggcccaacatctggcttggggaacagacagctttgccgacagcagtaacaatttggttgaaatgataactttgtcaaaaatgaattttgccttagtgtttttttaaaggttgagaatcttgtacattcttacaacatttctattttctacagttaaaaaactgtaggctgggtgcagtgactcactcctgtaatcccagcactttgggaggccaaggtgggtggattgcttgagtccaagggttcgagaccagctaggcaacatagcaaaatattagctaggtgtggtagctactcgggaggttgaggcaggagaattgcttgaacccaggaggcagaggttgcagtgagccaagatcatgccactgcactccagcctgggcaagagagctagattgtctcaaaaaaaaaaaaaagtaagttccaattactttgcagccaattattcttgctcttctatttgcaatagcagaagattgaaatagcctcctagatgtctgacagtggaatgggttcttttctttttcttttttggtagagatgagggtctcactatgtggccaggcaagccttgaactcctggcctcaagtgatcctcccgcctctggaggcaggaggtagggtacagtcccagactcaaagcactgggattacaggagtgaaccactgcgtgagcctggtttcttttctttcccctccctcccttccttccttccttccttccatccgtccttccttccttccctccttctctcctctttcactctacctctttcttttcttcttttttctggcttgttaaaacagaaatacataataattatagtgaaataaactagggtatttactgcagcagttagtaataatgaaatgttggaaaacaatctaatgttcatccgtagggaatatttaaaatatagtgtatttctgccgggcgcggtggctcacgcctgtaatcccagcactttgggaggccgaggcaggtggatcatgaggtcaggagatcgagaccacggtgaaaccctgtctctactaaaaatacaaaaaagttagccgggcttcgtggcgggcgcctgtagtcccagctactcgggaggctgaggcaggagaatggcttgaacccgggaggcggagcttgcagtgagcagaaatcgcgccactgcactccagcctgggcgacactgtgagactccatctcaaaaaaataaattaattaaaaataaataaataaataaaatatagtgtatttctggccgggcgcggtggctcactcatgtaatcccggcactttgggatgctgaggctggcagatcacaagatcaggagatcaagaccatcctggctaacgcggtgaaaccctgtctctattaaaaatacagaaattagctgggcatagtggcatgtgcctgtagtcccagctacttgtgaggctgagacaggagaatcgcttgaacctgggaggtggaggttgcagtgagctgagatcgagacactacgctccagcctgggtgacagagcaagactccgtctcaaaaaaaaaaaaaattatagtgtatgccatggaatattatgcaactgttatatatgtgtgtgtgttcccaaagcattgttcagtaacaaaggaaaagtgcaaaacactaaaatggatgaatacatgcttgtgtaaacacagacactgtcaggaatgtttgtctggaggtgatgggtatggagcctttttgtctgatatattgggtgtatcaagaatgccaggtcctgagcagttttttttttttttttttgagttggagtctcactctgttgcccaggctggagtgcagtggcacaatctctgctcactgcaacctccacctcctgggttgaagcgattctcgtgcctcagcctcccgagtagctgggattgtaggcgcccgccaccatgcccagctaattttttgtgtttttagtagagacggggtttcaccatgttggccaagctggtctcgaactcctgacctcaggtgatctgcctgcctcggccttccaaagtgctgggcttacaggcatgggccaccgtgcccagccgtttatatgtattaactcttaatcatcaaaacaaactatgtggtattaccataattatcgccatttatacaaagcaacagagggataaggagattaaggcacttgcccaagtgcaagaggtaggacaggaacccagagtcccgtgctggtagctgcttttctgtgcacttaacattatctcatttaattcttgcagtcacttcatgaagaaggtggcggtcctagggcattggagaagttatgtgcttgttcaaggtcatgcagctggaagatggtggtggtaggacaggaagtctgtagggcctgattctgcagccctctagtctatactcctttgctcctgtgtccctcatcccccctgcagaatgggcaccccgttacctttctgagccactgtgcgcagaaaagagagcatgttggccaggctggtctcgaactcctgacctcaagtgatcagcctgccttagcctcccaaagtcctgggattacaggcgtgaaccaccacgctcagcctctgaatactttgtactcaagccatttttcagtgctgtgtttgcagtgagcacacccgagggatgaagacacgtctccctgtgggaacctgggcttaccagggcccctagaggaggggaatctctcaagctcagagctctatggctgcggtgcaggcccactgtgtgcatggtgtcagtctgggcccttccatgttgcccccgtgggacttggggtaaggggaactgatgcaaacatcacgctgctgttgcttggtgtgagcaattaattcctgtggctctcacccaggagtctcatgtctttgggtcagacaaactcatcagcttgtagaaatggcacagtcccacgggcctgttagaatcttctattgtgcacatgttgctcttaaaatatacaaatcagttttgattttaaaaaattatttatttttttagtgataggagttttgctacgttgcccaggctggtttcaaactcttgggctcaggaggtcctcccactttggcctggactgccagcataatgtatcaccacacccgggactgattttcgtttttcaagaacaaaaaccaaaaacatacacaaaccgagagtcaaagcttgctaattagaggaaagtcaggaaatgggaaccattcaaagaagaaaatacccccacctcctactctcacctatccaaagacaattaggtgaatcccttagtagatatctttccagacggttttccatatagattcccatatctggccaggcgcggtggctcacacctgtaatcctagcgcttggggaggctgaggcggatggaccacctgaggtcaggagttcgagaccagcctgaccaacatggagaaacctcgtctctacgaaaaatacaaaattagccgggcacagtggtgcaagcctgtaatcccagctactcaggaggccgaggcaggagaattgcttgaacctaggaggcagacattgtgctgagccgagccaagatcatgccattgcactaaactccgccttaaaaaaaaaaaaaaagattcccacatctttactagtttgcagaaataagatcctagcatatgcagtgtgtaggaaccaccttggtttagccacgtctctgtgactgggggccactgtggtgacccccagctccccggacagagtcaagagctcaccagcctgcaaaggttttcacggcccccagccagactcgggggcttcctcttgccctgctacttcctgggagctctgagggcaggaaatggcgccactcagctcctggcctaacagcttggggaccacaaatgcaaaggaaaccaccctcccctcccacctcctcctctgcacccttgagttctcaggctcacattcccaccacccacctctgagcccagccctccctagcatcaccacttccatcccattcctcagccaagagccaggaatcctgattccagatcccacgcttccctgcctccctcaggtgagccccagacccccaggcaccccgctggcccctgaaggagcaggtgatggtgctgtcttcgcccagcagctgtgggagcaggcgggtggggcaggatggaggggtgggtggggtgggtggagccagggcccacttcctttccccttggggccctgtccttcccagtcttgccccagcctcgggaggtggtggagtgacctggccccagtgctgcgtccttatcagccgagccggtaagagggtgagacttggtggggtaggggcctcagtgggcctgggaatgtgcctgtggcttgaaaagactctgacaggttatgatgggaagagattgggagccattgggctgcacagggtcagggaaggccaggaggggctggtcactgctggaatctaagctgctgaggctggagggagcctcaggatggggctgatgggggagctgccagcatctgttcctctgtcatttctgataacagtaaaagccagcatggaaaaaaccgttaaaccgcaggttgggcctggccgttggcagggaagtgggcagaggggaggcccggccaggtcctccggcaactcccgcgtgttctgcttctccggctgcccacctgcaggtcccagctcttgctcctgcctgtttgcctggaaatggccacgcttctccttctccttggggtgctggtggtaagcccagacgctctggggagcacaacagcagtgcagacacccacctccggagagcctttggtctctactagcgagcccctgagctcaaagatgtacaccacttcaataacaagtgaccctaaggccgacagcactggggaccagacctcagccctacctccctcaacttccatcaatgagggatcccctctttggacttccattggtgccagcactggttcccctttacctgagccaacaacctaccaggaagtttccatcaagatgtcatcagtgccccaggaaacccctcatgcaaccagtcatcctgctgttcccataacagcaaactctctaggatcccacaccgtgacaggtggaaccataacaacgaactctccagaaacctccagtaggaccagtggagcccctgttaccacggcagctagctctctggagacctccagaggcacctctggaccccctcttaccatggcaactgtctctctggagacttccaaaggcacctctggaccccctgttaccatggcaactgactctctggagacctccactgggaccactggaccccctgttaccatgacaactggctctctggagccctccagcggggccagtggaccccaggtctctagcgtaaaactatctacaatgatgtctccaacgacctccaccaacgcaagcactgtgcccttccggaacccagatgagaactcacgaggcatgctgccagtggctgtgcttgtggccctgctggcggtcatagtcctcgtggctctgctcctgctgtggcgccggcggcagaagcggcggactggggccctcgtgctgagcagaggcggcaagcgtaacggggtggtggacgcctgggctgggccagcccaggtccctgaggagggggccgtgacagtgaccgtgggagggtccgggggcgacaagggctctgggttccccgatggggaggggtctagccgtcggcccacgctcaccactttctttggcagacggaagtctcgccagggctccctggcgatggaggagctgaagtctgggtcaggccccagcctcaaaggggaggaggagccactggtggccagtgaggatggggctgtggacgccccagctcctgatgagcccgaagggggagacggggctgccccttaagtgtcggtgaatagtgaggctggaggccggaatctcagccagcctccagcaccttccctctcaccatcccactgccccctcgctcccatgtttccacccggcaccctgatcctcacccgaatctcctttttttttttcttttgagacagagtttcgctttgtcgcccaggctggagtgcaatgcacgatctcagttcactgcaacctctgcctcctaagttcaggcgattctcctgcctcagcttcccgagtaactgagattacaggcacccaccaccatgcccagctgcttttttgtatttttggtagagatggggtttcaccatgttggctaggctggtctcaaactcctgacctcaggtgatctacctgcctcagcctcccaaagtgctgagattacagacatgagcctccgcgccttgcctcctcacccacctcttcactctgaatcctcatgaggcttctcagccctggatttcctgctgccatcctcacccagcacccacaactagcgcctgggcagggcagggctggcacctctcaacgtctgtggactgaatgaataaaccctcctcatccacccctatttatctccatcaccatttccccctctttcttgttcctggaaacggctgctgagtctccatcggccaaacttatctgccctgtgatttctttgacaattctccttttcccccagaacccaccctgggttgaccagagtctgggaagaaggacaagagaacccggcaaactccctcctaggattaactttgtaaagcacccttgccctgtagctgcaagggctgtggaacctgggcagcccgcaaccacctttagctctgggccccccaggccagcctggagcatggctgggtggggccaccagcccatgctctcaggcgggcctgtgatctttcccagggcacatggactgtaggctggccctggcccacaccaccacactctccccagccatggacagaggcagccagaggcctcacggtttctcctccgagtttctggctgggtgtagttctcagaaaccccagtgcctgcgtgtgtccactcgtgggtgtggtttgtgtgcaagagctgaggatttggcgatgcttgggaggggtagttgtgggtacagacggtgtgggggtgggaagtggtgcagagactgaagagggtcaacctgggcatgggggacacagggactgctgagaacgtgcgtgtcatctttgctctgatggggtggacatagcagaaaatctaactctgtctgtagccccatacagaatgccagggtgagcacagtggctggtgcctttaatcccagcactttggaaagttgaggcaggaggatcgcttgagcccaggagttcgagtctgaagtgagctgtgattgcaccactgcacttcagcctgggcaacagagtgagcccctgtctcaaaaaagaaaagaaaaagaaagccaggcttcatggaaagatcgtatgtgtgacccaaatatgagttcttcagctcagccatggtaatcccttccttgaagtctccatttctgcagtacacatgcatgtgcgctctctctctctctctctctctcacacacacacacacacacacacacacacgcgcgcgcgcgcgcgctctcctgcgaacagaggcagggggagaggggtttgccctggtctcggggactggtctggctggcgcttccccactgcacgtttccaggtttagtttgtctgtgtctcctcttccatcccaggggctgagccccttccatcctccaagaggaaccagtgagagtgagtgaaggaggggcctggagccagggacttcccctgtggggcctgggtggagaggggagaactcaatggtgctgcctttgagaccagcccaggctacagcccaggagcacacatgggccagggcagttggtatttcccgaggacaaagaggaaattttcaaagaggaagttgttgagttagagcttgcggtggctgagagcagacaggttgacctgcaaaaaaagacaggggaggcatgtgagtgtgacagccctgctctgtggcctgggcaggagatgggggaaagggtcaggtgggggatgggctcgtgcagtgggagaggagacggagggagggagcgggaaggggcttgcttagtgggtgggaagagctgagctcggatggaaccagcttctaccagccaggctgggcacccactgggctgcatctggtggccttttctgattgctatttggactcactgcagctgcagaatgacagaggccatgtccaaaatcccttagagacactgttgtcttagagttgttaaaataagagcccccatatcaggtttagaaaatactgtcaccgaacgaacgtcgctgtcctcagctccacctccctttcctttgacagatatggttgttttctaagccaggactggttttagtcaggtcctgggcgaatcctgaaaaaaagaggtagtacgggtaaggaaggcacccaacagggctttcacaatccagaaaatatcaaaatataagtgttaaaagagaggcacaggccgggtgcggtggctcacgcctgtaatctcagcactttgggaggccaaggtgggcagatcatgaggtcaggagtttgagaccagcctggccaatatgatgaaaccccgtttctactaaaaatacaaaagttagccaggcatggtggtgtgctcctgtaatcccagctacttaggaggctgaggccagagaattgcttgaaccctggagtcagaggttgcagtgagccgggatcatgccactgtactccaggctgggtgacaaagtgagactgtctcaaaaaataaaaataaataaaataaataaaagagaggcacaaacagtgttatgaatgcaccaaggaaaatggtgcattcataactctcaggtgaagcctaccaagccatgcgtgtgtgcacatatgtgtgtacgtgtgcatgtgcgtgcgtgcatgtgcgtgcgtgcatgtgcctgtgtgtgtatgtgtgcacatgtgtgtgcgcatgtgtgtgtgtgcgcgcatgtgtgtgtgcatgcatgttctcccatgcatgtgtactgtggcaagggagactttgaggaagagattccagtggctgagcagaagggctcgcattgccctggcgaaaggttggaaggcttcacctgagagtgtgtcgtggcctttgtcatatccactgcttgattcctttctttaaaaattatttttattgttttctacatatgagaaccaccacacctggctaatttttgtattttttgtagagatggggtttcaccatgttgtcccggctggtctcaaactcccgggcacaagagatccacctgcctcagcctcccaaaatgctgggactataggcatgagccactgcacccagccactgcttcattcctggtggctgctgtgcctggcatgttgcagatcctccatgaatatgcatttgaatgaatgaatgaatgaatgaatgaatgaatggagatgacgcctcagagattctttcttttgagatgaggtctcattctgtcacccagactagagggcagtggtgcaatcacagctcaccacagcctcaacctcctgggcctcccaagtagctgcgatcacaggtgtgcaccaacatgcccagctaatttttttttttaatttttaatttgtacagacagggtcttgctgtgttgcccaggctggtctcaaactcctgggctcaagtggtcctcccacctaagcttccccaaatactgggattataggtgtgagccactgtgcccaggcttgcctcagatatttgaaggctgggaaggattttgcaaagctgggaaaaggaaaaggcattcccagcagaggggatagcaggtggaaatacataattaaaaaaaaaaaacgtggagcagatccagcgcagtggctcatgcctgtaatcccagcactttgggaggcagagcagggaggattgcttgagtctaggagttcaagaccagcctgggtaacatagaaagaccctgtctctacaaaaacacaaaaaattagccaggcgtggtggtgcatgcctgtagtaccagctacttgagaagctgaggcaggaggactgcttgaagccaggagtttgagaccagcctgggcaacatagtgagaccccgtgtctacaaaaagtaaacatttatatatatattttttaaagtggagcagttcaatatagagtcttttttgaacaaacgtgaaatagatgtcttttttttttttttgagatggagttttcactcttgttacccaggctggagtgcaatggcgtgatcttggctcaccagaacctccgcctcctgggttcaaacaattctcctgcctcagcctcccaggtagctgggattacaggcatgcaccaccaaacccggataattttgtatttttagtagagatggggtttcaccatgttggtcaagctggtcttgaactcccgacctctgctgatccgtatgcctcggcctcccaaagtgctgggattacatgcgtgagccaccgtgcccgacaatagatgtcttttaattttctggaggaaaaagcaaagcaaaagaagcagtggatattttaagactaaaaaggaaaacaaaaaaaggagatagagcaggccagacgtggtggctcaacgtctgtaatcccagcactttgggaggccgaggcaggtggatcacctgaggtcaggagttcaagaccagcctgaccaacatggtgaaaccctgtttcaaaatacaaaaaattagctgggcgtggtggcgggcacctgtaatcccagctacttgggaggctgaggcaggagaatcccttgaacccaggaggtggaggttgcagtgagccgagatcacgccattgcactccagcctgggcgacaagtaaaaaactccatctcaaaaaaaaaaaaggagatagagcaaggaacagtaagaaaatagttgggtgcagtggctatgcggtggcactataggaggctgaggcgggcagatcacctgaggtcaggagttggagaccagcctgggcaacatagacccctatctctacaaaaaatttgaaatatgaaaaattagccaggtgtagtggtgtgcgcctgtggtaccagctactcaagaggcgaaggcagggaagattgcttgagcccaggagtttgaggctatagtgagctgtgatcatgccactgcactccagcctgggcaatagtgtgagactctgtctcaaaagaaagaacatggccaggcgtggtggctcacacctgtaatcccagcactttgggaggccgaggcagtcagatcatgaggccagtttgaaaccagcctggccaacatggtgaaaccctgtctctactaaaaatacaaaaattagccaggcgtggtggcatgcccccgtaatcccagctacttgggggtctgaggcagaagaattgcttgaaaccgggaggcagaggttgcagtgagccgagatcgtgtcattgcactctagtctgggcgacagagcaagactccgtcttggaaaaaaatttaaaaaaagaaaatataaaatatggtataagattaaatatattagttatgaaaataattgtaaatggcttattgaacttatagtcagtaaaaatcatgtttttgaaaattatgtaatgactttggaaaataccagcaatataatgttaagtggggaaaaaagcaagttactcctctgtaatacatatgattttagttttgtaataaaaattcccaaccatatatgcacttatagggaaacaaaggacccatcgcaaatgttttccatgctgatctccaaagtggtgagtttatgtgtgatttttattttgtttatgctcttctgtattttccgaatttcatacaataaatatctgttacttttacaatatgaaaaaatagtggtcaaaaaggtgttcaagggggtggcctgggggtgtctggtttgaggagagtggtaggggatgaggctgcaagtggaggttggagccatgctatgaaaagttcaagagtttgaattgagttctgaggtttgtttttgtttttgtttttgttttttgagacggagtctcaccctgtcacccaggctggagtgcagtggcacgggttcatgccattctcctgcctcagcctcctgagtagctggaaccacacgcgcccgccaccacaccaggctaatttttttgtatttttaggagagacagggtttcaccatgttagccaggatggtctcgatctcctgacctcgtgatccacctgcctcggcctcccaaagtgctgggattacaggcgtgagccacagtgctctgcgtgagccatagtgctctgctgagagtttgaattgcattctggaagtagtggtgaaatcaacacacctaagtctgctcttctcctctcttctagtccccagagtggtgagtagcatcgttctggtggcccaggcaaaacgccttaggaccaccgtgcagccccactctttccccattcctgctctccaggtgccaagtccctggctcttcttccaccgacccttgcatcccttccttctcttcagtcctcatcgcacctcaccgggatcctattgacacttcccctttgatttccttccgctctctgctagtgatggtcccagggacccttctaaaaggtcactgtgggctgggcacagtggctcacgcctgtaatcccaacactttgagaggctgaggtgggccaatcatctgaggtcaggagttcgagaccagcctggccaacatggtgaaaccccatctctactgaaagtacaaaaattagccgggcgtggtggtgtgcacctgtagtcccagctactcgggaggctgaggcgggggaattgttggtccccgggagatggaggttgcagtgagccaagatcgcgccgttgcactccagcctgggtgacagaatgagactccgtctcaaaaaaaaaaaaaaaagaaaaaagaaaaatagctgggcatcgtggcacacacctgtagttccagctactcaggaggatgaggtaggaagatcacttgagcccaagaggtccagactgcagcgagtcatgatcacaccactgcactccagcctgcgtggcaccctgtctcaaaatataataataataaaatttaaaaataaaataaaacgctgctctgtctaggtgatattcctctatccccaaggctgtcagggtggaaccctccttccttagcgtggcatataagcccctcgggacctggccctatctctcctctgaccacccctgcccggtcagcccttgttacagacagtctgtgctatccagccccatcaaattcctgttgctccctaaatatgccacacactttatttggaggagaggggtgaagaagggtagtttaacatgttcaaaatatttattttttccagacagtaaaataacattttttcctgttttgcaaaagttaattatcagcacattgaagattttccttttttttcttttctttttttttttttttttgagtcaaagtcttgctctgttccccaggctagagtgcagtagcgcgatctcggctccacctcccgggttcaagtgattatcctgtttcagcctcccgagtagctgggactacaagcacatgccaccatgcccagctaatttttgtatttttggtagagacggggtttcacaatgttggccaggctggtcttgaactcctgacctcaggtgattcacccgcctcaccctcccaaagtgttgggattacaggcatgagccactgcgcccggccagcagtcttaaataacagaattcacacacacacacacacacacacacacacacacacacacgcactgtattatatttcatcttatactttaaaatgtttccttttttttcctcaaaagtacacattaagatcatgtttacaaataaagccttgtcatccaaagtgaaaaatccagatggcaagatttggatggggaaggtcttgagaaatctgcgaatggagttcacttttgcagacaggaaatgggccctaatatatggttctaaggacattccatttctgaaaatgtacatttccacccgcttttcctctccttccttcctccctccctccctccctctctctctctctctctctctttctttctttctgacaaggtcttcctctgtcgctgacgctggagtgcaatggtgcgatctcggcccattgcaacctccgcctcctgggctcaagtgatcctcccccctcagcctcccaagtagctgggaccacaggcacacgccacggcacccagctaatttttgtattttttgtacagatgggttctcaccatgttgcctaggctgatcttgaactgctgggctcaagtgatcctcccgcctcagcctctcaaaagtgctgggattacaggcgtgagccaccgcacctggcctgcatccccatttctgacccttgaccatgttcaagtgggaaggggaagccggggaagggaggacgggctacctgagggctgcgggtagaggtgactcctgtgagctgtgagccctcagcccttgggcagagggaacagaacagaaacagaccccatctctgagccaccaagctcagactcgtgtggcaggagacagatcacacaacactatcaacaaaacaacacaggtcgcagtggctcacacctgtaatcccagcactttgggaagctgaggtgagaggattgcttaaccgcaggagttcgagaccagtctggccaacatagcgagaccccatctctcaaaaaaagaaaaaaattagctgggcctggtgatgcacacctgtagtcccagctacttgggaggctgaggtgggaggacagcttgaaccagagaggtcgaggctgcagtgagctatgattgtgccactgccactgcactctagtctgagcaatagagtgagaccctgtcttccaaaaaaaaaaaaaaaagagagagagagagagaagaatataatcaaaagtttctaaattcccaaagtagtaacaaaagcagacccaaacaaaagtagagagaaaatcttcgaaacttaaaaggctatttaggctaaggagcccacccagtggtgaccacctagttctgggaggtttggggcagggccattagacaatggaaactcaggttattttggagacaatcaacttgctcccaaaaatgagctgcaagcaggtgcctgtgtgctcagcccagtctggagctcagagcctgcctgccccactgcaccatcaccagcccagctgaaccagggtcccaggcaagccgtacaggctctgcgttggccttggagagaaccgccgactcccccgagttgcctgagctcggcctgaagccagccctccccacgctggctcacaataaatgccttgacttcccgccaactcttcctcaaccattaagattcagctcaactgtcacgggctctgtgcagctgccctcgctgccccaccccacgcagactttgtgttccttctccactcctgcagcaccccttgcgacagcatgaataacccggctgtagtgatgtgagggtgacactcatcaccagtgtgtgagcccctccaaggccacatgtcctctttgtgtttccagagcccagggcccagcatgcggtagctacctagtatatgtttactgaatggagggatgaataaattcatgcacaaagaatagttttatttatttatttatttttgagacagagtcttgcttctgacacccaggctgtagcgcagtggtgcgatcttggctcattgcaacctctgcctcccaggttcaagcaattctcctgtctcagcctcccaagtagctgggattacaggcatgcgcgccaccacgcccggctaattttctatttttagtagagacgaggtttcaacatgttggccaggctggtctcgaactcgcgacctcaggtgatctgcctgccttggtcttccaaagtgctgggattacaggtatgagccaccgcgcctggccttatttgtttattttcataaacaaatttctgttgcccaggctggtctcaaactcctggcctcaagtgatcctcctgcctcagcctcccaaactgttgggattacaggcacaagccacagtgcctggcccagttctgtcctttgagttgacctggtcatccaggaggatgttctgaggaagtgtgaaatgataatattattctagcccacgctggatacagtggcagtctggaaggtgaaagaggttgggtttgaaatagatttattggccaagtgcagtggctcacacctgtaatcccagcactttgggaggccgaggcaggagaattgcttcagcctttaaacatggcgaaaccctgtccctattaaaaataaaaaagttcgatgggcgtggtggcattcacctgtagtcccagctactcaggagggtgaggcaggagaatcacttcagccctataggttgaggctgctttgtgctgtgatcatgccaatgcacgctagcctgggtgacacagtgagaccctgtttcaaaaacaaaaacaaaaacagaatagaggcctggagcttgagagggaactcaggatagaagatatagatttaagagtcggctggatgcagtggctcaaggctgtaatcccagcactttgggaggctagggtgggtgtatcacttgaggtcaggagttcgagaccagcctgaacaacatggcgaaaccccatctctaccaaaaataacaaaaactagctgggcatggtggcatgcgcctgtaatcccagctacttgggaggctaaggcaggagaatcacttgaacccgggaggtggaggttgcagttagccgagattgtaccactggattccagcctgggtgacagagtgagactccctctcaaaaaataaaaataaaaataaataaataaataaataaataaatagtgatacagatagatagatacataaattatatcattcactgggtagattgagaagagagctgtagagagaatctgagtgtaatagtcagggcaggctaactgctgtaagaaacagtgcccccacatctcagcggtataactcaaaagaagttttttccttcttatgacagtcaattcctgacatctggagcatgacctttcacaacattattccgggacccagtctccttccatctagtggctctgtcatcctcctagggccttggagtggtctgcttttgaccagctaatgggaggggagaggcagaataggatcctgtgaagacttctagggtcaggtctggaaatatcttttgctcacactccattggccagaacaagactgcctcagtgcagaggaagctgggaaatgtagtttagtagggtacccagaaggaaaagggaaacagtctctgccacactgaagcaacaccaaaatctgagggttggatgtaggaagaagcacctgcaaaagatagaaaagagcctttaagaggatcacctgaagccaggagtttgagaccagcctgggcagcatagcaagatcctatctgtacaaaaaataaaaataaaaaattagcctagggtggaggcatgcacatacagtcccagcaactcaggaggcttggggccaggagtttgaggctgcagtgagctttgattgggccactgcactccacttaagcctgagtgacagagcaaaaccctgtatccaaaaaaaaaaaaattaaccaggagaaaaatgacatttggagatcctgtctctaaagaaaaaaaaagctcactgcatagctcactgcagcctcagaaacaggcccaggactgaatcaaggccagcaaggtgctggggtgataagcgagcccgactccagcctggccaacacggtgaaaccccttctctactaaaaatacacaaattagctgggcatggtggcagacgcctgtggttccagctactcaggaggctgaggtaggaggatcacttgagcctggggcgtggaggttgtagtgggccaagattgtgccactgcactccagcctgggtgacagagcaagaccctgtctcaaaaaaaaaaaaaaaaaaaaaagtgagctggaggatgaggcctccctaaattttgtgccttgggtgtctcgatccgtcacgccagccccagtcccggcagtcaggtgcggcagagaaagcaaagggagaaggctgggaagatgcaagtgaatttagcgactagcagtccctgtgagcaactgtagcaagaagggtttccaatgaagaaaggaaggccctgggccaggcgcggtggctcatgcctgtaatcccagctctttgggaggcagaggcgggtggatcacctgaggtcgggagctcaagactagcctgaccaacatagagaaaccccgtctctactgaaaaaaaatacaaaattagccgggtgtggtggcgcatgcctgtaatcccagctattcgggaggctgaggcaggagaatcgcttgaccccgggaagcggaggttgcagtgagtcgagatcacgccattgcgctccagcctcggcaacaagagcgaaactccatcaaaaaaaaaaaaaaaaggaagaaagaaaggccctggcagttcttggacaggaacttgcctgaagtcccagtcccggtgactggtggtttccccactttctggttcagaagctgggctctaagctgtctgtgcccttaaagttccttggaaagagggaagggaagggaagtggatattaggtgagttcctactctgtttcatttgcagagttttctcattgattctcagttggacccatgaggtagatgttatgccattacattttttttttctttagagacagggtctctctctgtcactcaggctggactgcagtggcacgatcacggctcactgcagctttgaactcctgggctcaagtgatcctcccatctcagcctacaggtgtgcaccactgtacttagctaatttctttttcttttttctttttttgggagagatgggatctctgtatgtctctatgatgcccacactggtctcaaactcctggcctcaagcgattctcctgccttggcctcccaaagcacagggattacaggcatgagtcgctgtgcccagcctgttatgccgggtttttttgttttgttttgttttttgagacagagtctcgctctgtcgcccaggagtacagtggcatgatcttggctcactgcaagctccacctcccgggttcacaccattctcctgcctcagcctcccgagtagctgggactacaggcgcccaccaccacacccggctaattttttggttttttagtagagacggggtttcaccatgttagctgggatggtctcgatctcctgacctcgtgatctgcctgcctcagcctcccaaagtgctgggattacagtcgtgaaccactgcatccggcctgttatgccgttttttaaattaattaataaatttatttatttatcttgagacagagtctcactctgtcacccaggctggagtgcagtggcatgatctcgactcactgcaacctccacctccggggttcaagtgagtctcatgcctcagcctcctgagcagctgggattacaggcggccgccaccatgcccggctaatttttgtatttttagtagagatggggtttcgccatgttggccaggctggtctcaaactcctgacctcaggtgatcaacctgcctctgcctcccaaagtgctgggattacaggcgtgagctcctgtgcccggccctgttatgccattttaaagctaaggaaactgaggcacagaaaaaggtaaaaaggtacttgagatcaaaaaggatggagttaggatttgaacccaggtccagggcccatgattttcccagcacaccatccaaaatgcctgcctgccctcaccagggagcacatgcttacattcacagccttggaccctgggttagggccaggagggctgggtgttgggtgagaacagggcctcgggctccttcactggctggggcagggcttctgagttccccatcagagcccctcctctgactttcagggcctgctgaggaatctgcaggcctggcagaggacaggagggaggcttggggagcctgggaagggccggctgacagcttgatgggccctccctccctccacagtcccacccccagcctggggcctctgggagccttggtcctgagcagccaacacaccagcccagacagctgcaagtcaccatggacgctgaaggtaaagggacactctctctgccatgtccctgcacccatccccccactgcctacccctgcccccaccctggcttgtctcagccccttgttgcctcctctggagtcatctctcctctggtcccgccatcgactcccttacctaccccatgtccctgcagccttgctcaacccccagaggccccttctcactcttctttctcctgtgttgagtccccaaggagctctggggaaggaaggggcttaagccctagaaaagggcagggtggcctggaggaggtggcgtctcctgggggcagtgggggccggaagtgggaggctggttgggggagcagcatggacttctgctctcgctggtagctcgggagaagcagagacaaagtcctgtcccttctgcagctgggtgggggagggggcttgagtcccgtgattccctgcctggagggagctgtatgcaaactgttggggtgatcagtcccaacccccaaccatgaagtccggtggcaacaaaggaatgagaaaagacaagttaagatttaaagcagccccagggggccagttgctaaagtgaaggctgcagagccctggttgcctgataatttattgagtacaatcttttgatctaagaagcagatggtacggggtgaaacggtgaaggtgggggtgtgcgcgtcatttgaaagatgtatagccgtggtggtttatgtgaatttcctttaagctcaaagcatatgtctaactactaagataatcttttttttttttttttttgagacggagtctcgctttcccccaggctggagtgcagtggcgtgatctcggctcactgcaagctccgcctcccgggttcatgccattctcctgcctcagcctcccgagtagctgggactacaggcgcccgccgccacgcctggctaattttttgtatttttagtagagacggggtttcaccatgttagccaggatggtctcatttcccaacctcgtgatccgcccgtctctgcctcccaaagtgctgggattacaggtgttagccaccgtgcccggccaactaagataatctttaacttattgggctgcagctggtgggagtgggttttacaaggagccaggatgtctggtcacattccaacgcttcaaggaagtgtttcagcccagagcattctgtgtaaagccgcagagcaggtcatgttcactggcctggggacacaatggcaataaggaggtgattctcctcagaggccccctatggtgttccataggtgtcctacacaggggtggctgactaaactggcgccccgtaaacccttccaccagcacaaacccaggggtccatgctctacgctcagaaggctccaccagggatggggctgtgtgaccatgggtgggtcctggcttctcagagtcccgttttcttccatctgtaaaatgacaataatagttccctgctctggcccgccacggtggctcacgcctgtaatcccagcactttgggaggctgaggtgggtggagcacttgaggtcaggtgtttgagaccagcctggccaacatggtgaaaccccgtctctactaaaagtacaaaaattagccgagtgtggtggtgcgcacctgtaatcccagctacatgggaggctgaggcaggagaattgcttgaaccccagtggcggaggttgcagtgagctgagaccaggcctcagcactccagcctgggcgacagagcgagactccatctcaaaaaaaaaggaaaataaatagttccctgctcagaaggttgtggggaggacagaggatgggaggcacaggtgcttagaccctcctccatgtttgaggtgcctgctggccccatacacccggtccctctggctccactgtggaaccagctctcaggggtcccatgcaggatgccacgccaaacacctttcaatctccattgtgtctttctcttttgaaacaacgccgacctggatgtgaatcctgactgccactcagcagcagtggaaaccctggcaagttttgtaacctgtagaagcccgtttccacatctggacaatggagttggtggcactggtctcacggggttgtaatgaagattaaataccttagcagatgtcaaggggtctcgacctgattccttcagagccaggattctttactgagggatcagggatgggctctgggggagttcatgaaccccagaatttgcaggtgaaattgtgtgtctttgtgagaacacggttacgcatttttctgggaaggagatccataattttcatcagatccagattctttttttttttttttttttttgagacagagtctcgccctgttgtccaggctggagtgcagtggcatgatcttggctcgctgcaacctctgcctcccgggttcaagcgattctcctgcctcagcctcacgagtagctgggactacaggcataaaccaccatgcccggctaatttttgtatttttagtagagatggggtgtcaccatgttggccaggctagcagatccagattctttttttttttttttcgagatggagtctgactctgtcaccaggctggagtgcagtggcaggatctcggctcactgcaaccttcacctcccaggttcaagtgattatcttgcctcagcctcacgagtagctgggactacacgtgcttcaggcacttgctgccatgtccagctaattttgtagttttagtagagacagggtttcaccatgttggccaggatggtctcgatctcttgaccttgtgatctgcctcctcggcctcccaaagtgctgggattacaggtgtgagccaccgcacccggcctcttttgttttttagacggggtcttgttctgtcacccaggctggttggtgtgcagtaacataatcatagctcactgtttgtagcctccaacttctgggctcaagtggtcctcctgcctcagcctgtggagtagctgggactgcaggcgtgtgccaccacacctggctaattaaaataaattttttttttttttagagatgggttcttgctgtgttgcccaggctggtctcaaactcccagcctcaagcgatcctccaacctcagcctcccaaaagtgttgggattacaggcatgagccaccgtgcctggctcaaatcttttcatatgtgaacatctcagcatgttttctttctttcttttttgagatggagtttcgctcttgttgcccagactggagtataatggcgtgatcttggctcactgcaacctctgcctcccaggttcaagtgattctcctgcctcactctcccaagtagctggggatacaggtgcccaccaccatgcccagctaatttttttgcatttttttttttagtagagatgggttttgccgtgctggccaggctggtcttgaactcctcacctcaggtgatccacccaccttggcctcccaaagtgctgggattacaggcgcaagtcactgcgcccagcctcatcatgtttttttcttaaaagataaagacttttctttttactacaaccacaatactattgtcaaaactaaactttaaaaatttccttggtgttatcaaacattcaatgtccagattccagtggtttcataaatagcctaatttgcttttagtttgtttgaattaggatctaagtaaaatctacactttgtgattggttagtatgttttaagagtctttgaaactttatttttttgattaaaaaatgtttaatttagagataggggtctcactatattgcacaggctggtctcaaatgccccaaagtgctgggattacaggtatgagccaccacacctgactgattctttttttttttttttgagatggaatctcactctgttgcccaggctggagtgcagtggcgcaacctcggctcactgcaacctccgcctcccagattcaagcgattctctcaccccagtctcccgagtagctgggattacaggcgtgcaccaccacacatggataaattttgtatttttttagtagagacagcgcttcaccatgttgtccaggctggtctcgaactcctgacctaaggtgatcttaggcccaccttggcctcccaaagtgctgggattacaggtgtgaccaccacgcccagccaatatgtggtcttatgagagcattggttcttttttttttttccctgaggcagggtctcaccctgttgcctaggccagagtgcagtagctccatcatagctcactgcagcctccaactcctggactcaagggatcctcccacttcagccttctgaatagctaggactacaggcgtgtgtcaccatgcccagctaatttttaaaattgtttttgtagagatgggttctcactatgctgcccaggctggtctcaaactcctggcctcaagcgatccttctgcctcggcctcccaaagtgttgggattacaggcatgagccaccgcccctggccgagcattgattcttgatcctcatgtgcatctgagtcacagagcagggtgggggctggctcttccccaacctggatccctggaaactacccccagagattctggttcactgggttggaatgggcctgagcatctgaaagtttgaaaagctccctgtgattctggtgtgcagcccaggcagaggccccactgtgtccacttctcttgaaaggagtggttcacaccaacacccccacttccctacctcccgtgcgctcctcgagcatgacaatgtggcttctgcccccgacacatggcacaaaaaccgctctggcacaggcctcacagttgctaagtgcagagccccatcctcagtcttccttctatttacttctgctcacctcccaaaaccctcttctccttcccaggtacccactcctgatgatgcttctctttttgttggacatgccctgtgggttctttatcttattattttattttagagaccgtggcttgctctgtcacccaggctggagtgcagtggtgcaatcacaggtcactgcagcctccaactcctggactcaagccgcagcctcccgagtagctggcgagtagctgggactacaggcgtgcacccccatgcccagctaactttttctttttttcttttgttttttgagacggagttttgctcttgttgcccaggctggagagcaatggcactatctcggcttactgcaacctctgcctcccaggttcaagcgattctcctgcctcagcctcctgagtagctgggatcacaggcgcccaccaccacgcctggctaatttttgtatttttagtagagacggggttttgctatgttggccccggagttcaatttttgtatttttagtagagacggggtttcaccgttttcaccaggatggtcttgatctcctgacctcgtgatcctcccgcctcggcctcccaaagcgctgggattacaggcgtgagccaccgcgcctggccacggcagcatctcttctgaactccagagccattccctaccaccctctgggcaccaccatccacatctcctgctgccgcctcagccttaacctctgcaaaaccaaatccgttctttctctcgagctctgcagaagctaagctgtttcaccaggccacgattcaggaaacgctttgggattcagcttctgttcttgtgaaatgggaagaatccctgtggtgagctccagatgagagcacaaaggggaacaggggtgcccgcggctggcacgccatggctggcacgccatggcactcagtggggtcaccgccccctcct

SEQ ID NO: 36829 - DNA, 87625 bp, Homo sapiens
gcagcctgaggcagagctcgggggctgtcggtggggaccttgcaggagggcaccccaagcccgcccggcccgcccaacccagcccctgcgcgcagcccgggccgagtaggaccccgcgcgcccctcgctatggcggcgccctcgcggctcctgatccgcgggggtcgcgtggtcaacgatgacttctcggaggtggccgacgtgctggtggaggacggcgtggtgcgggcactcgggcacgacctgctgcctcccgggggcgctcctgcggggctgcgggtcctcgacgccgccggcaagctcgtcctgcccggaggcatcgacacacacacgcacatgcagttccccttcatgggctcgcggtccatcgacgacttccaccagggcaccaaggtacccgccccgccgcgcccccgccccgcggtacccacggaggctcgggcagcctccccagtcgtcccggggtcctcagcagggccgcctcgcgcggcgcggcgccgaggagctgggtgggcgggaaggagcgcagccccggcgggtgtcagaggggactcagattctcttcgctggggtccctttcaggcgccccttctcggcggcagccgagcagccttggctcaaccagatgccctcgactcctcctttagtggttaatttgacgagtttaaggccatccccttaccctaatttctctataccgcttactccccaaatctccccgcaaccccattttgattggtgttctgtggaagtcgcaaatcttccatacattctttagaatctttttttaaagtaggcacttccagccatttctcccaaccatttcgacccatcctttatccccaaccaaaaccaaatgaaaaatccattcacctggtagttacagccttgactcaaagtgagcagtgtagcaggtaatgtgtctgagtaggctagatgcccaccgtgttcacgttcccgtcccctaccctctgcccccactcccacccccagtagaaaaaatatagccccgaccagggtttagaagagaaagtattccagaaatgatctcgcaacactcacacacaccaacgcagcctcgcagcaggctcttttctccatcccacttgcgctggggacacaacattcttgctgctggagtacccatagttttactgatgttgcaggagggtaatcagatcaccactccccaggtgaaggtaggcttgggtttctctagatacaaaggcctagaagtttgggtcaatgaaaggaaacttaaaccaaacttgtccaacctgtaggccgcatgcagcccaggacagctttgaatgcggcccaacacaaattcataaactttcttaaaacattatgagattttttttcttagttcattggctgtcgttagtgttagtatatttcatgtgtggcccaagacaagagaagccaaagattggacacccctgcaacatttccccaaagctcctcaacacaagatcaagagactaacagagcagctttacaggaacatagagtaaaaattctactctcagcacttgggctaaagtaaagcccacatcctccctaagtcctgtgttttgagctgccttgagagaaatggctccttccaaagtgaagatgtattgatatactaaaggccttggcttttcacttggaccataccttgatgtgtgaaacaagttgggctattaagtccagtgtatagtaggcttccttcctccctccctccttctctccatcactccctcccttctttctccccccactaccccctccacccctctctttctttctattcccatgttactgtggacaggctgacagtcttccaaagcagttttggtgatagctacttcattcatatactgatttctgacagttttgctctccttacacctccccctctccaagttccccaatcctctataattgactggaatgattaacagaaaaaaaggaaggcaggtagatttgacccagagagaaggatctgggcaggctgctcaaatcaccatttggaaagcttcttcctgattactaattatcaacctatatctttatgtcaataaagtcttttgtaggacagattgttgtatggtttgaaaattagcaaactttgttttgtttattcatttttcccttttgctaaaaagtaatatgcactgaatttgaatgaacttatttttccattttaaagaattttttagctatcaaaacaatatgtgattgtaggaaacaattggaaaaataataggaaaattaaaagaagcaaaacattaataatactctccctctcagtgacagccaatgttttggtgtattgcctttatgctttttagcatgctctattttacataatcgatatcatattgtgcatgtgtctgtgtgtgtacacctatatttaaaatgtcagaacttgcagttttcagtcatagtgcaagccctttctgttattacagacttatcattaacaaagtgctttgctgatggcagggcatcccattgaacactcccacctgcaaggtggggagctgctatttctgaccatgagttgcccactagcatcattctccctcttacagctgagcagtagctttcattctctttctgccatcagggttccagatgaagcagcaaagaagaggaagtggaatgctgtgggggaggggcattccctctctttctcaagattatctttgcgtgccccaaggtcctgggaagtggttcttggtcttctatcttttccttagccattctgggattctctagttcagagagatttataattcttaactgagaatgtaggtccttatggcgtatagtctgttgtcaacatctcaaaggatttatccaccagctgatcctctaagcatttctgtacttaaaggttgtgaaaacattaaacaaaaacatgttcttcatgagcttaggatcttaaacaaaaaatgatacggtcagagatattaaggtcaaaggtttagcaaataccaaattcctgttgaatattaaacagtacttacaaaggggctgtgttgcaatagtctagttcagagtcagttggttggatcccaagaggtaaccactcccaccccccgaaacagctgaggcttcataaagtgaaccagatggggaaatatagataaacataaacattacagtattgacctgaattctgaaagaaaggcattatagagttattttgtcttctttcctggcctttgcaataatccccaaagcaacgctggtgggtgtttgttttggggagctagagacaaagataggccttttgtaaatactggttgtatgatatgttaaacttgaaaaacatcttcctattatacctttaagtaacatctattttatcaagtacataccagccaatgccctaagttgtgcattatcttccaaaaatcccagatgccattgtctacttttttacaattgaggaaattgaagcttaagctacctgcctaaggttgtacacctagggctgtaactcactgagtggctcttcaaatttagtactgcctgaccccgtcgctaaagctgttacctattagtgtctgttcttttgaaaaaacatataatgttcagatttgtcagggtggcaagtgatagatgacagagccatataagttgcattttaatgcgaggcatcttttctcaaaaatagagcagagccgtctttagaaaagacagtaactcttcactttcctaaagctagaggcagttaaggttatcaaaataagtacacactgcaggtattcagtttataaggcatttgtataatacatacatttatagccatatcatttgtaagggtacagaaatggaccttaagtacagaaaaagcataaagtaaaaatgatatattatactttcaggaaatgggcccctaaagtttagaccaatagctgtttgcattctacatccagcaggctgatcatttataatacctgacaaatacaaaaggatattatttgtggtactctatttatcgatcactagattgtgatgggactcaattttaaaaatgaatatacattaactaaaggttatttattttgtaaatctaattcatgtcagagattggtttaaagcctataattgattagcttaattacaggtaaaagctttctgaagtaactaatggaaataatgttctgctttaaagaaatcatatttcattttgttggtctataccagatgtacagtggtcttcagataattcaatatctatgaggaaggacaatggaattttttattcaatgggtagtatgaattcaataaatttgaaagaatcgtgactttgcttttactacattctgtgataagagaatgaagtataagagtttggcaagttttcaaatatacataaatttgtattcagaggtgtatgcaggtcagagtgggtggagttgcactgaaaacccggtagtgtcagtagctggcaggaggaacatctttttaaaaattgggaaaccatgcaacacatttttctttttttcttttgttttttctttattgtaaaggacaaaaagttctcaaaattattgagaagggaaattacactttgctttgaaactttttggtaaaatgccattgtggggattacttacaaggcagtgtgtgattaagcaggtaagtgtgattaagcacaccacacatttagttgtatttatagagcttctgcaacttgtggaagagctgtgcttcaaaaaccctggttgcaaatcaaatccccttttctgttgcttgccagagctcccggctgggcttcaggagctgtgtgggctgattttgtgaccttaggcaagtaatttcctctctcaggattgtcagcattttcttgtctgtgaatgaggcaatggttagatgagcaattcaaaaagagttttttaagttataaaaacaatatatacttatcatccagaccttaaaaaaatgctggcacattatagtcactcaatatgcattagttaaatgaatcaactgctttttcaaaaaagaaaaatacagatgagtataaagaaaaataatatttaaatcacctataattttaacatttggctccctatccttctagatatttatttgttgggggaacgtgtaaacatttgtttccttctaccaaattgggcatactgattggagtcagccttgtttattaaacatttccccctgtccttaaataccactggagaatgtgattttgtggcctcattatcctctctgaggataatgatctctgagtctcggatctctctctccagcctgcatattccttaagcatcaggcctcaatttctgcctgtctctggatatcacaacctggatatcccagaagcacctcaaactcagcatgttccaaaccaaatgtgacctctccttcaagtttcaaactcatttttcttcctgtttcccaaactttgatggttcagctctcatcttctccatgatggacattttggtgatctccagtgtttatccactatatagcaatgctgtgacagacatccttatatgtaaattattgttcatattcttgatgattgcctcagaaatgatcccttagagtaaaatgcctgggccaatgagtattagacacatcttaaaggagtttaatacattcattcagactgctcttcagtttatgtgcccattatcattcccatttcactgtattcttgtcgatgatggataatgacattattttattttattttattttattttattttattttattttattttattgagacagggtctcactctctcacctgggctggaatgcagtggtgcaatccagctcacggcagcctcatcctcctgggctcaagcaatcctcccacctcaacctcccaagtagctgggactgcaggtgcacgccaccatgcccagctaatttttgtatttttttttttttttgtagagacagggtctcactatgttgcccaggctgatctcaaactcctgagctcaagtgatatactcacctcagcctcccaaagtgctgggattacaggtgtgagccactgtgcctggcctggataatgacttttaaaaaaatctatgtcaatttcagaggaaaaacgtagcacttcttactgtctttaaaagatcatctctttaataactggtgaggctgagctttgaacattcgtgttgtattagtagtttagatgctccagcttcaagggtttgtaattctgtggtttccttgaatggctgtttaatgattacaaacttaaccttcagactcatcagaggaagcacaaaaaaactcaaagattaactgaaaccacttgatgctaattaaagctttggttctgttaagggtgttgtgtattaggaatcctttcactgacttagattccaagacttgccttatttcagctttgatagtccatagttcatgcttttcacctccaccccttgttttctctctcacatgtctggcctgggtattttcaatgtctctattagtctgttctcacactgctataaagaagtatttgagactgggtaatttataaagaaaagaggttcaattgactcacagtttcacaggctgtacaggaggcatgaccggggaggcctcgggaaacttacaatcatgttagaaggtgaaggggaagcaagcacatattcacatggtggcaggagagagagcaaagggggaagtgctgcacccttttaaacaaccagatctcatgagaactcactcatgagatcgacaagggggaaatatgcccccatgattcaatcacctcccacatggtcactcccccaacattggggattacaattcaacttgagatttgggtggggacacagagccaaaccataaaatgtctgagagaggtagtctagaaatcaaggtttccatgatgcttctctcagggaggaaagtcttttcctttaccctcttatgtttagtaattgggggcctgcaaattaaactgacaaaagagagattcacaaaagaaaagacaaattaaaaaaattcacatacatatataggaattcacagaaaaatgtgactcaacgagggggctagatttggggggttatacaccatcttaacagaacaagggaaggcggagcaggcacttacaaaaaaacaacttcttaataggggatggtcacagggagaaaagacacataggaaaacaaatgacttttagaaaagataaatgggcccttagaaggagatatgggacatatgacagttttgtgacagtgtctatttaggtatggtgtcagcttccaagtctctagtgataagtcaatcttccctggttgtgaaactcctagagaggggatttatgataattgaggtctttggggaggctttgctttatagcagatttgggacttaaggaaaaacaaaaacaaacaaacaaaaaaacacctattctcaaatatctggagctcaaaataatatttatgctacagtggtatattctagagtctcaactgccatctaatatggaataatcccaaactaaggatttttcaagctggctgttaggttccattaattcagtcaacaagtatttcttggaaacccactaagtgccaggcattgtggctggtgcagaggttatagagatgaaaaccatggtatttgttctcagcggtaaacagactagaggtatatgggtctctaatctgtctggactttgataataaattttatatagtaagtttgggctttatagactttgctttgatgattgtgacaaatttttagtaaacatgtgaggtcagtgacatctggcattttccctgttgctgagtcatcaatcacagtggcctgcatcacctggctgtgtttctgacctgcttacttggctgacaagtgagcctgggcaactggccaccatctacacctcaacactgctttgtgctttcttctcacacgtcaagtaacaagttgagaaaggacacttcaattttttctgttatgtttcattgcatctaacagggagactgtattatatagtgatagtcatggatgagttcctgagcctgaggatcttttcacacagaaaagaccttaacattcacctgaaagtaaaacaaaatgtaatcatttttagaagtcaagaaagtatttgaggcatagatacagaaataaactaaaattgtgtttgttaaaagtcttagttaacactgctttggtaatgaactttggaaaaactgagcattcagccttcagatgtggtctgcattgacactccatattaacatgttcatagaaggatctaggaaactacagggccaggactagcaatatttttgggaaatgacatttcacactaacacgcaacttacacagctttcccagtttgctattggaaaagtgaaccatcataattattccatctcgtgacttttagggaaattcactggtccttctcttcctttccccttcaaacatttagagaatattcatgtgccaggtactgtaatgggcacagaatatacagagatgaaccaacattgattaaatcagaatctctggggaatggggtaaacgctttctatatgattcctgcatgatccagggctaagaattgcttggactcagcacaggaatgggtagaggagggaagaacatgaatgatgtctctctctgaaatgggaaagtgctcaggtctcctaagagaggcagggacagtgtcagtggagtggagtgaatgagttgagagggaatagctcaatagacagctttggagaaagctaaagttcaggtcatgcaggaccttatgggttgggcaacaattgttttttctccatcttaagagcaaagagaagtcaataaaagattggaagtggcagatatggctgggcagacatatagtaggtatacctcctaccttggagttgtgttcacattgttgctctgaggattttctggggactgaactccggttgctcacagtggtaacctactcattaacacaccctctttatggccctcttcctttctgttttccctcccttctcatttcttcactgtgctagtccagtgggaagacgaaggtggcaccgggcagtagaggtgaagacgcaggagtagagaggctcctggagttcatagaagacagcctccagggtcttgttgatggattggatttggggatacagggaagaagagaagtaggtgtcaagagtaactcttaagtttctggtgggttggatgatagtgtgattaatattccaaacttagggaggcaagaagccaagcatggacaggaatgtgcaagacatctttacaaagctgagtgtgcttcttgatttgggacagacgttgggaccatgaaacttgtttttgtaggtttcagtgattgtgagagagctagaaattcagccacgaacttttctcattaaggctcaaacataccgttgggtttctttttgttttacttgggtggtgcaggttctgtgatggattttagtgaaacaaagtcacttgttttaggataagcttagaaataagaatttggtggcaccataaaagggaagaaaatgcatttggatacagtagtgtaccctgaatcacagtttcaatttctccagttacctgaggtcaactgtagtccaaaaaacttaagtggaaaattccagaaataaacaatcataagttttaaattgtacaacgtcctgagtagtgtgatgaaacctcaagacatcctgctccatcctgcctgggactgggacgtgagtcctccctatgtccagcacattcatgctatagacgctccctgcccgtcagtcacttagtagttggctcggttatcaggtcaactgttgcaatattgcagtgcttgtggccacccacaagtcacccttattttacttcataatggccccaaagtgcaagagtgatgctggctaattgttctattttttattagttattgctgttagtctcttactgtgcccagtaataaattaaactttatcacaggtatgtacatataggaaaaaacatagcatatgtagggttcaatactatcctcagtttcaggcatccactggaggtcttggaatgtatccctcttggataagggataactcctgtactttcagtaatgatttacaatggaatattcttaaacaaaatcttgtgtaatattatgacccactgttagagtttatctcaatttctgttccactgcatttcttctggaagcagtgtgggctcccctgtcccccaaaagagttttttagataaactggaaggtttacaaggaagaacagtgaaagtaattaggagctgaaataattgatttgtgagccaggttagaaaagctaaatccattttgtttggctaactgacaaataaaaatggaaataagtcaatcaggaataaaagcaaaggaaataactaggcttcatgtagctatctgagagaaattggccccagccatcctttcccattcaatacagcttctccaaactcattcccagtctggggttgaggagagggagataagaatggggataagaaacagaacaagaagaaacaaaagataagtggttgttcctctcctgtctctttcctgctcctagttaattaggaaggtggagcatttgtgatcaaccctcatttaagagctttcaaattgtagccccgagaattttcatttgctttagttttagaagagtggccctttgactatcatatcttcagtctggtaagaagaccatcaacagctctgtctatttaatttatacaccatttatggtcatgtgtcacttaatagcaggaatacattctgagaaatgtgtcattaggcaaatttgtggttgtgagaccatcatagtgtgtacttacacaaacctagatggtatagcctactacacgcctaggctatatgctatggcctgtggctcctcggctacaaacctgttcagtagttactctactgaataccataggcaatgacaataataactgtgtatctaaacattgctaaacatagaaaaggtacagtacaaatatggtactgtgatcttatggggccaccgtcatacatgtggtactgtcattgatcaaaacaccattatggtacatggctgtacatatatatgccctgtgtcatatatttatatgtaaaatatttatttttcatataaaattatgattttaatagaaagtttagcaaatattgaaaataaaattgaagtaggggaaaattaaaatgacctggaattataccacctagaaccagccactgtaaacattttgtcttggctcagtgtggttttgtgttcgtgcagagtgttggtatgttccgaagcatgttattgtggctcatgttgtcatgtctggcttctcgctccctggccatttcggccagtctcgggacctctatggcatcctctaataggtcactcctacattttctcctagtcttgtatgctgtttggaaacaggtctgtatgtcttcctgtctgcaaatgccaccaggtggacacgtgcccaagcacctcactctcaggatgttccccacttcattcacgtccctcctaagtgcagatcatgctcctcctctgtccactcgcctgccatcgtctcactcatcctagtcaaatcagctcacctgactcccttcgcaactgaaaacaatcattgccctgttttcctcctctgggaccaccactttatatggtccccagtcaccttaattctgccctttaacattttctgctgagctgctacctcttccccccagatcttcttcctcagagcgtctcttcatgcagttcacgtttcccagaggctcaggctctagggcctgatgactcagattccaaccctgccattgctccttgctggctatgagactttggccaagttattgacggttctgtattaagtttttttttctttattttactttaagttctgggatacatgtgcagaatgtacaggtttgttacataggtatacatgtgccatggtggtttgctgcacccatcagcccgtcatctgggttttctgtattcagtattcaccaccctaaaatggagttaaccatagtacctactgtggagctcttgagatggttaaaatatgcaaaacattggaatagttcctagagcatcatggtgcacaaaaacagcatcacagcacttgctgtgagtcagatatcattatacttaattggaaacttccacgtgtaggtcctaatcctgattgaaatccaagccgtctctaatctctgagttgatctttctctcctctgaattcccagtcatcttttctctgtacctcttctagggagcttagcaaattttacctccctttagcaatttttatactactgtttattttaaaagtagacttgctacctgttattacaatctaactattttatatttatttattcatatttctgcttctcctataaacaccctgagggcagaatcattgcctaattatttgtgtgatctcccactcccttcactacatacagtggcttggatgtggtagaacttttctggttttgtggagatagaatccacctacaatacaattcggccatttaaagtgtataggacaatggcttttagtatgttcacagaattgtgcaagcatcaccacaatcaattgtagaatactttttgttttgtttgtttgttttgagatggagtttcactcttgtcacccaggctggagtgcaatggcatgatctcggctcaccgcaacctctgcctcatgggttcaagcaattctcctgcctcagcctccctagtagctgggattataggcacccgccaccatgcccagctaatttttgtatttttagtagagatggggtttcaccatgttggccaggcttgtcttgaactcctgacctcaggtgatccacctgcttcaggttcccaaagtgctgggattacaggcgtcagccaccatgcccagccagaacacttttgatacccccaaaagaaacaccataccctttagctatcaccttggactctcctcatcccacccagccccagacaaccactattccacttgctctatggatttgcctcttctggacatttcatataaatagaatcacacaatatattatctttgtgactagcttttctcacttagcatcatattttcaaacttcacccatgtcatagcgtatgtcagtacttcatttccttttatggtaaaatactatcccattgtatgaatctattagattttatttatccattcatgagtcgatggacatttgtattgtttctactttttggctaccatggatcatgctgctgtgaatattcatgtgcaagtctttacgagaacatgttttcatttctcttggctataggcctaggagtggaattgcttggtcttgtggtaactctatctttaactgtgagaggaactccaaattgttttccaaagtggctgtaccattttgcattcccaccagctgtgtatctagtttctccacatcctgcgtgtggtagattttaatagggaaagaatacaaagaatagttctttaagcttgattttctagttcagtagatgctaaaagaggactttcttctaatgctttaattaacagcagattctattagaaaaatgtccttcatcctcaagggatgtcttgtcatactgggaagacacttttagaaggaagaaggtaagaagattaatctgtattcaaataaaaatacaaagcctgaggaatttttttcctagtattttcattacatcaatagggatttcttaagaaatgcaaatatgtattgttttgccacagataaggcagtgttatttaaaggtggagacaacatacaggatcctgtataaaaagtgaaatttttgagagcaaaaagaattggagtggggccaagtaagttaaggaaaaataaaaatctattgaagtaagcaagaaaagtgggagtagaatagagctggcatatcaggtaggacatgagggcatccggtgtatctggaagctgttgggggagggtggtgggggccggaaagagagactgaggcactgccccctcctgtgttgtaacatgaccacatttctggtgatgaggtaacacgatatagggaagatggaaaaattcctaatcctgaaatagtagtgctcaacccataaagcacttaccatgaatcaaactctgtactaagcactttatttttatttatttgtttatttttgagacagggtctctctctgttgcccaggctggcatgcagtggtgcaatcatagctcactgcagcctcaaactcccgggctcaagtggtccttccatctcagtctaccaagtagctaggactgcaggcgcatgccaccatgcctggctaattttacatttttgtagagacggggttttcaccatgttgcccaggctagtcttgaactcctgggctcaagctctcctcccgtctcagcctcctagagtgctgagattacaggcatggccaaggcgcctggacctaagcactctgtatacattacttcagtttaatcctcctatcaagcctatggtttaggtacaattgtcctcactttgcagatggcgaattaaaggccacagaggttaagaaattgctgagattaccacagcgaataagtgttgatgctgagctttgtaccctggtgtccgtgagcctcccaggtccgtggtctaagccactgtgcaacatccctcctgtctctgttttcttcacctacattgtttgaatacaacaattaaaaacaattaaccatcttgtgattttagtttaaatgaaattgatttaaataattagtcaaaggcatgtgatttagtaacagtttttaaattagtagtgatgtaatgtaatataatgtgctaaggggtatattgcaagttgaggcagaatgcagggatttatagaccatgttatgaagattccagtttgtgcagaggcagggagaagcactcagttttcatctttggagtcaagtggttacatttttgctttggaaatatctctctcgttgcaatgaggggtttgtattggagggagtgggagatgaagatcaatcaggactcttacaatagtcaagatgaggaatgagatggatctgaactaagaccagggtggtagcagtggacagaaggacaggtgcaaatctaagaaagataaaggggtcaccatttggtttctgggaatggaggcaagaccggaaccatgtaagtctcccaggattctgagagtaccacagggcagttagagatacagttcatcaggatggattctaataaaatggaattttataataatgaatatcacttctcaagaaaaaatatgtgcattttttccacttttccattttgatttttctttacaatcctcactctgttttctttgagtcaaatccattttcatcttatcagatatgacattctttttgcagaagcaattccagcaggtttaatactttaaacttaatttatgaaaagtctattcatgcccttctgggtcatttaaacaggcagcatctttttgcaatttcctggacccatcgagtttgcccaagtgcttacaaatgcacattgttcaagatgataaatgacttaactaggaaattgatagctaatttgttgaaaacctcttatgattccaggctgctctctcaggaggcaccaccatgattattgatttcgccattcctcagaaaggtggctccctcattgaggccttcgagacctggcgaagctgggctgatcccaaagtttgctgcgactacagccttcatgtggcagtgacgtggtggagtgaccaggtaaagcacctggatttcaatgtgttcccattgtcctcttgtcctcactctgcacaagagcaagaaactggtgacattgattgcttcctagacaacaggaggacagaactggcaggaagacttttcattgcatattcttttgtatcttttgaatttttaattctgtgaagtattaccaattttaaaaactaaattaaaaaaatcatataaagacaataggataaatcttttatgctcattcataacagcttctcctaatatttaatcaatgaatcatcaatgctttaagtgtaatgtttaatatactgatttctctttttcttaaattcaatatcccccgaatcttttaaacagtattttcccacaggttagaacttcaataaaaaatgtttaatttctcaaaaataaaatcaaggaaattctaaatttagaattctctagaactagaagcctgccttcccactcatgagccttctttagagaggaagggacaggcctggactgtttccagagtcttctccaagctgtatcttgaccgagtgatcttcctactctgctaatgttaccacacctggtcagatgatttcataatagagcttaaaacaaccttccatgtccactaattgcccaggccatggcagaaataacatgatttagatagaaaagacagttctgagagatgttaaaatatgttgatttcctcccacataaatgtgtgtgtgaattttggaagaaacttttacttggaatttaaattgcaacatgtttttccacattgcacttaattcagcaatctttttaccagaaagagttcaccattaggacattatttgagtatcttataatctcacatcccccacaaactcgggctttagacagcaagttaatctaaaacaaataatcaatctttaacaggtagttcagcaaacataatagcaaggtttatagtccacagctaacgttagtttttctccaaaaatgccatttttagtgatgcatctgaactcttatgcttttaggatcgtccctccttttcttcccttccctcccctcccttctcttcttcttttccctccctccctcccttcctcccttccttctttcttttcttctcttccctccctcccttccttccttctcttcattttcctattctcctattttataagatggagcaaaggtgatggtgtttgtccttatcagtgcttctcacactttagtatacaaagagtcacctggtaaaccttgctaaaatgcagattgcagattctgttcaggggggttattcgtttgctagggctgctgtaaccctagcaaacagaatgtacgacaaacagaatggcttaaacaacagacatttactgcctcacagttgtggaggccagaagtctgagatttaggtgtcagcagggttggttccttctgagggctctgagggagaacctgttcctttcctctctcctaacttctggaagtttgctgacaacctttggcattccttgtcttgtagaagcatcatcccaatctctgccttcatcttcatatgatgttctccccgtggaggtctgcatcccagtttccacttgatataagggcagcagttacattggataaagcgcacatgctcgtgtcctcatcttaactaattacatctgcaaggactctatttccaaacaaggggttaggacttcaacatatgaatttttggctcacccaagtcaacccatagcagtaggttaggagcaggtgggacctgagattctgcatttctagcaagcaaccaggtgacgctgctgatgctggttcagttgccacacttttggaggaggaaggctgaagctaatatgcttgcaagttgtataatgagattcttccatggatgtggatggcagggatgattaatgagggctcttctactcagggagcaaaagatatttcatgtaagcaatgcagatcataatcccctttggaagcccattatgtgaatatgctaacaatgtttcaagcatttttttttctgactataaaactaatgtactcattgtaaaaaattagaaactgttagggggaacaaatgaggtgcactgtcccatgttctgtcccttgctgttgtcacttaacctaacttggagcacattccatcacttgtccactctcaatattttggtgcttttttctagattaattaagtagcaattaatttattcaataaatagttattgagtgggcactatgcaccaggcactgttctaggatacagcagtggacaagccttacaaggccccttctctcatggggctgaaatcctggtggggccgacaggtgatcagcaagtaaggactgctatgccgggtgataagcaccatcaagaaaagggagggacatttccaagggaataaacagtggtagcaatgagtaaattcacgtgtaatattatcattcttaaactttgctgactcaatagaattacgctgctttattttgcactttttagttagtaggaaatttcttgcatgtgtttttagtcatttattactccatgaattgttgccaacatttttcaacatgtttttcttatcaagttgaaagaacttttattagctaagagcaataatcctatgcttgttacacttttcattgtgtgtgtgtgtatgtgtgggtgggtgggtgtgggtgtgttttaacatatagaagttcaaacagtcttatttggtcaaatctatgagtttttcctttggaatttttgatccttattgagacttgaatctgacctacaaaagcaattattgaggctgggcgcggaggctcatgcctgtaattccagcactttgggaggccaaggagggcagatgacttgaggtcgggaatgcaagaccagcctggccaacatggtgaaaccccatccctactaaaaatacaaaaattagctgggcatggtggtgcacgcctgtaatcccagctactcaggaggctgaggcaggagaatcacttgaatctgggaggtggaggttgcagtgaaccaagatcatgccactgcactccagcctgggcaacagagcaagactctgtctcaaaaaaaaaaaaaaaaagagcaattgttgcgatagctttgatactaacttgcccctgacccctggcaaccctgaaggcctctgagcttccaacggatccagagtggagtctccagctgtcacctcctaggagctgccaatgggtcccatgccaccacggctggctctacagctaaaccatgagtttgtgctttcttgggcatgcccgggtccatctgcatcttctactttctccttctaagaactccacccatggctttcagattggaacctgaatccttacctcacattaacgttcattcctgctggatccatgattgcttctgttgctgccaacatggcttcaaggtcattttttagaataatttcctcaaatcgggagatagatgcagagaattttacatccaagtacagaaataaagcactttgggaaaagctattcactttttcatgatttaaaagtatgagagcagcagcagtttatcagatgaaatggggtataacctgggaaaaagatcaaggccttaattgcatttttgtggaactaaactattgtccttattttccttattttacttagttctcttccgaatgcaacgttttagagaaggttgaaattatcatttaaattagagtaacatattgttgttatggttgctgcttccttttaggttaaagaagaaatgaaaatccttgtgcaagataaaggtgttaactctttcaagatgtttatggcctataaagatctgtacatggtgacagacctggagctgtacgaagccttctctcggtgcaaggaaattggagcaattgcccaggtccatgcggaaaatggagacttaattgcagaggtacgcatttgcattccaaagcttctacagaaatgacagcagccataacataaggtgaagatgattgggcctacataggtaaactcatttaatgcattggaagatgagaaatccagaaatggattttccgtggctcggaaacggattttctgtggctcagaaactcccaactccatttccttgagtccctgctctcagctttatgcaggtggtatatgcactagaatgaggatttcccctttgcaaaccagctcttagatctcaaacatgtgcagttatgaaaacacaaatacttttctttgtgtcctccagcatacttttggctttgttgttgtttttcagaagcttaggctgctggttcagaataccaaagcgtggtcaacatcagtgtcatctgatgacttaagcagtgtattaggtagctgtttaaagccctgctcttttcagaaactggatattaaaatgtgctctggaggaaactagatgatatttatttctcatgttagtcccattattaatgcctgaaggatacaccatctgcaagatttaaagagctgtctcttgccctttatattagctgactttttttttaatctccttaggctcagctcccattaaagtgagtgagattgaggctcagtggccacaaggcagagaggaataatgagaagggagcgtgagctgtaaaaacaaaacaaaacaaaaaacagaccagggtttaaattggacttctgctttatagtttcatgacaacaggaagtatttttaccactctaagtctggactgcatgctctttttgtaaggaagaaataacattttgaagaagaaagataacaggtccaataccatttagtgggttggattggggagcaagtgaagaggattattccgtaataaaagtaaaactgattacatagtatgacagtgagtcacttcaacaaggatccacagtatttttattttgtttgtctgaatcaatattgtcttaaatatagatattgcttttcaaagaatgtgattagaaataacttcatatctttttcaccttttctttttaaatttttttatttttgtggggtacatagtagtgtatatatttatgaggtgcatgagatattttgatacaagcttgcaatgcataagaatcacatcatggaaaattgggtatccatcccctcaagcatttaccctttgtgttacaaacaatccaattatattattttagttattttaaatggtgcaattattttttatttgttgttattattattattttttgagatggagtcccgctctgttgcctaggctggagtgcagtggtgcgatctcagctcactgccagctccacctcccgggttcacaccattctcctgcctcagcctcccgagtagctgggactacaggtgcccgccaccacgcccggctaattgtttgtatttttagtagagacagggtttccccgtgttagccaggatggtctcgatctcctgaccttgtgatctgcccacctcagcctcccaaagtgctcggattacaggcgtgagccaccgcgcccggccaaaaggtgcaattattgactatagtgcccctgttgtgctatcaagtactagatcttattcattctttctttttttttgttttacacacaaaccatccctaccttcccccctctccccaccgccatccctccccactaaccttcccagcctctagtaaccatccttctattctgtatctccatgagtttaattgttttaatttttagatcccacaaataagtgagaacatgcaatgtttgtctttctgtgtctggcttatttcatttagcataatgacctccagttccatccatgttgttgcaaatgactggatctcattcttttttatggcagaatagtactcccttgtgtatatgtaacacattttctttatctattcatctgctgatgggcacttaggttgcttccagatcttggctgtagtgaacagtgcagcaacaaatatgggaatgcaggtatatctctttgatatactgattttcctttcttttgcatatatgtccagcagtggggttgctggatcatatggtagctctgtttttagtcttttgaagaacttccaaactattctccagagcagttttattaatttaccttcccaccaacagcgtacataggttcccttttctccacatccttaccagcaattgttattgcctgtctttttaatataagccattttaactggggtgagatgatatctcagtgtagttttgatgtgcatttctctgatgatcagtgatgttgagcaccttttcatatgcctgtttgccatttgtatgtcttctttgaagaaatctctattcaaatcttttgcccatttttaaatcagattattaactttttttcctgtagagttgttttagttttgtatatattctgcttcttaatcccctgtcagatgggtagtttgcaaatattttttcccattttgtgggttgtttcttcactttgttgattgtttcctctgctatgcagaagctttttaacttgatgtcatcccatttgtccatttttgctttggttgcttgtgcttgctttttccccttttcaataaaaaaaagtgatggtaaaatatgcatatggaaaattaacttatatgattagaatatcaaaattatttttaccaaatatacatgttatatatatatgtgttatagatatatttacacaaatatgttcatatacacacacacacagacacacacacacccctatacctaacagatcaaaagcctggcattgcatttaatttatgataaaataatgatatctgtcattagtaaaccttccttgcacatatacacattcctgctgtctttttagggagcaaagaagatgttggctctggggataacaggccctgagggccacgagctgtgccgcccagaggcagtggaggcagaggccacgctgagagccatcaccatagccagcgctgtgaactgtcctctctacattgtgcatgtgatgagcaagtctgcagctaaggtgatagcggatgcaaggagagatggtaattctcgaatgtaacctcacttagaactcagtgttagctgaagagaaaagtccacgtctgtagcctctgcttcagtttaggagaaagtgcatgtggatttccactacttttcttcctccctttttattagcctcctggtttcatttatccttatgtgtgtctgttttccaccacttttgttcatcttcatccttgcctctctaccttcatgttttatttgttatttcttctccatccttgcgaccccaggacatttcctttagccacatgcccccacactcaatgccactagcagccacttttaaatatgatagctaaatgcaaagctctccggtttttgtttgtttgttttgtgatggagtctcactttgtcgcccaggctggagtgcaatggtgtgatctcagctcactgcaacctccgccttctgggttcaagtgattctcctgcctcagcctcctgagtagctggaattacaggtgagcaccaccacacccagctaaattttatatttttagtagagacggggtttcaccatgttggccaggctagtctcaaactcctgacctctaatcatccacccgcctcagccttccaaagtgctgggattacaggtgtgagccaccatgcctagccctctttcgttaattttgaagaagcttccctatctcttaggcagctccactacccttcccactacctgaatcagggcagtgcaaggcacctagtacatgctcaataaatttcttttgaattgaattgattcatctgacagccacttggatgttggagcaattgaagcaattatccaaatggtatttttatgatggttattttaagattttaaaatctaagttatttttaccccaaactgcctaattgcctcagttctctggttcagcctagtatgttcagcctagtatgtaaatactcatcttaaaggaaagagaaaatctcctatttttgataagcactgggcaaagaaatgatttcactcttttgccaatactggtagagaaaggaggaaaaataaataaggtgcattttactcaaagactttagtcccatggtagcttctgtcatctcaattttaggaatgcagataatcagagacagtgttataattcaaccttgctgtttttgtttgttttttattaaaacaggctgtatttttgtaagattcattataaaaataatgggtctcactctgttgcccaggctggagtgcagtggtacaatcttggctcactgaagtctctaacttccaagtgatcctcccatctcagtctcccaagtagctgggaccacaggcatgtgccaccatgcccagctaatttttaaactttttgtagagacagggtctcgccatgttgcccaggttagtcttgaactcctgggctcaagccatcctctcaccttggcctcccaaaatgttgggattacaagcatgacccgctgcatggttttggcatgtatataattgataccaaaacaaattttgtcaaaatttcttcttgttgcattaaggttcagtaatgattttgtgcaagctgtgtgcacttttaaaatgtaatccatcaacatcttgccttaagtgtaggcttatttcacctaggatttaataatatcttactaaccaaccatttctgattgctactctcgcatgtaaaagaatttcgccccttaaaaaagaaaatataagtactgcgattttaaagttataggtttttcccaccagatggtgctgttgccaacgctatgagatgagtcggtctataattatttcctttgttaagtcgtgtaccgggtccataatgtcagaatattatttaaggaacagtgaaatcagcagaaattttcacttctaacccaccttcaagctccaattttgactgttctgtcaggaagcagtttcttgatcttgggtatttgttttgcattgggatagaattccattaggagcaaagtaaaagtctagggagggttttagaatacagaacataggcagaaaactagtaaatacagacattttaattttattgtaaattattttaaaattcaatattatttcttgtatctgtaaaatatttacatggcccaagagtcaaaattatatataaaaatgttcaatgaagttttacttgccttctctagctccttcttcccatacagtataagtaatgatttttattaatttatttctggcctatctttaccatgtttctctttaccaaataagaatatagtccttctttcctacataaaaggtagcatactatacaccttgtctacacattgcttttttttccacttgaaaatatgttctgaaggtcagcccacattagatacagagattttcctcattcttttttgtaagtgcagggtatgctactgtatttattcaacaagtcccctattgatggacatctgggttgtttccaatctttagctgtttcaagagaaaccacagtgatggccttacgcatatgccatttcaatttgtgaaagacacattagttctggaggtcagaagcctgaaatgggtctcaccaggccacagtcaaggtgtctgcagggctgcatccctttctgaggtcctaggaagcccttgccaggcccctccaattacttggctcgtggccccttcctccatcttcggcaccagccacaatgggttgagatcttctcacatcacattattttgacctctttgcctctctctttcactttaagggccccttatattaagcctaccgattaattcaggataatctccccatttcaagggccttaatttaatcatatctattaatccctttgccatgtaaagtaacatattcacaggctatggggattaagatgtggacatctgctgggctccatctttctgcccaccacaaaatgggtatcttgagggtagattcctagaagtgggattgctggttcaaattgcatatgtaatttttgggacattgctcatattttccccaaggaattgtaaacatgaaatatttaaaatacctccctaaacgttgtagttgagtcagacttactgtgacagtataatacttgtgaaaataccctcatgcgcagttgtcaaagaggcaaaattgcttcagaataaaatagtttgaaagatttcctaccccatgcatgtgaccaaggcatgggatcaagcaggggcccaaagaggaagcgttggacataaactgtgcccagctgttcacatggtgactgcatcagcaaaccaaaggacagatccctgggtagtactgtgggacaagagctgttggaccacactgaccttttacagaagatgctgtctgtactcatttattatctaacatcatttctaaatgtaaaagagcaagatagatgtaaataagaaatcattcagttttacacatttatactatgaaaatctcccatctgtaaataccattgccagcccattcttttttttgttttttgttttatgttttttttttgagacaggttctcactctgtcacccaggctggagtgcagtgtcgcgatcttggctcactgcaacctccatctcctgggttcaagcgcttctcctgcctcagcctctcgagtagctgggattacaggctcccactactatgcccagctaatttttttgtatttttagtagagacagggtttcaccatgttggccagactggtcgaggtggctcatgcctgtaaccccagcactttgggaggccggggcgggtggatcacctgacgtcaggagcccattctgtcttcaagggccttgactctcacagtgtggtccctagaatgcagcctccacattgctccttagacatgcagagccttggggcccatccagattccctgaatcagaaagtgcatttataactagaatcccaggtgattcatatgcatatgaaagcctgagaatcacggctccaggaggcacaaaggagatccaattattgattgcttcattgtggtagcctagaaatataatgctattaaatttgattttattgttcaattgccagctctatatccagaagagcgggatagtaatgataacaactaacagcttgttgagtgcttaatatgtgcctggcacatagtagtattttaatctcttttatcttatttcaggttttactatatttttatcttatcaatgtgttttaatacacattgtcttttaaaaaattgtcataataatgcttcatgctcaattttaccactcttttgtgactgatgaaattgaggcttgggagagattggtgaattaagccaaagatcactttattagtaagtgctaaacttggaattcaagtccaagtctatgtgaccccaaagcccaaactttttctgtcactctccactgtgttaaaggagaaattgatctgaagttgggaaaacctggatatcaagtttgtatttaatgggtttggggtttatttatttatttttagagacagagtctctctgtcacccaggctagagtgcagtagcacagtcttagctaactgccacctcaagctcctgtgctcagatgatcctcccaacctcagatcccaagtagctgcgactactcatgtaagccaccacacccagccaatttttaaaatttttttgtagaaatgaagtctccatttgttgttcaagctggtcttgaactcctggcctcaggcgatcttcctgcctcagcttcccacagcactgggattacaggagcgagctaccacgacccgctggctttggtgttttaaaatttgtaattgtaattggtttttgggttttggcattacatttacattttttatttaagacgttatcattttgctatttttatcattattaaaagattaattttgggggtggaaatgatgaagtattaaatggaaagtaagtatcttctatctccctcagctcattctttagagccagtgattttaaacttatctatctttagtttttggtggtgacctctaaaatcctaaactataagtttgtagtgatttgtaacttttgacagtatcacttgactctcaactatgaaaaatgaatgacttagttcctgtaaacttctcacgtcctgagttttgtcagtaataaatgtcacttcaaatgatatatttaattttacgtgttttattttacctgttttaggtattcctttttttttttttatttaagaggcaggatctcacaggagatcttgcagtggcaagaacacaggtcactgtagcctcaatttcctgggctcaagcaatcttcctgcctcagcctccagggtggctgggactataggcatgcaccactgtacatggctaatttttaaatttcttgtagagtcgggatttcaccatgttgcccaggctggtctcaggctaacctcccaccatggcctcccacagagctgggattagagctgtgagccaccacgcccagcctgacatctcttctctacaggctgaagaagaaacttagaggccctaagtgctctctctctctctgcctcctccagatgtctaccagctgtattattatctttacacagactctgtaactctaattaggtcttccatgctttgtctataggttaagtctaaaatttagaactgtcacagggtaaaattatggaaatattcttctctgtagaaacaattagtgagaagagaacttcagagaaatttatagcactaacttgcagtgcaagttagtgttattcaaattgactctcagagaagcaatttccaagtgtcaaggtcaagtgagttttcttcattccagtaggactcaaaagcatgccttattttagtttgctacatatttagaccattattgtcttgcaaagtttctcgtttctcctgacatttttccaattagctctttttaaaataggttgagaaaagaaatatatgccttctttaccatatcatgaagagttctagcttcttcatcatactttctattgaatagaatcagctctacttgcagagattctttgtgggaggagaatctgctgactttccctttcatttttgatagctgcttgctaagcctgcagtagagatgtcattctgggataatgaggttggatatactgattcctggtttccatatctccctttttcttgaattactttgaagattttcaggtaatttttaaggaaaagtgtgtaaaaggtaaattttctgattccttgtcttcacgcttactgggtgatttgaatgggcatggaattcttggttctgaaatatttccttctgaattatgaaggcacagtttccttctctgctggcatccagtgttactgaggaacaggaaaaccctatacaatttcttgtcttcttatcacaaacttttcattatctgtaagatttttatactttctcttcattttagatgtccagaaatttcattgagactattactggaaaggagttccagtccagaccccaatagagggttcttggatcttgctcaagaaataatttagttgagtccataaagtacagtgaaagcaactttattagagaagtaaagaaacaaaagcatggctactccatagacagagcagccccaggggctgctgattgggtatttctatggttaatttttgaatatctgctaaataaggggtggattattcatgagtttttcaggaaaggggcagggaattcctggaactgagagttcctcatttttttaggccatattgtgtaatttccagatgttggcatggcatttataaactgtcatagcattggtgggagagtcttttagctaatatattttagctaatacattataattagtatataatgagcagtgaggatgaccagaggtcactctagttgtcattttggttttggtgggttttggccagcttctttaccacatcctgtttctgcagcccaggagatttcagcctcattttacccagcccctcttcaagatggagttgctctggttggaacacctctgacaaggctatatttagtagtaggccttttaaaaattcacctgcatgttcagagggctttatcaatctgacgactgagctttgattctgaaaatgtttcttctgtattttcctccatattcatgtcctctgttttcttttcctgggactccatcataatcctccatgtcttttaactattttcacctttttaaaaagatatttgaatttttgctatacattttaggaaatatttttgtttactttttcctgcccttctaataaacttgtgtcttggtaatcacacctctatttccaagaaaacgttcttgttctctaagcgctctttttttccatggttccgtattctttttaatgtttttctttcaatagatgcattactttctttttaaaaataatttggtactttatttgtttttttatttatttttatataaagacatagtcttactatgttgcccagcctggtctcgaactcctgggctcaagtgatccttctgcctcagctgcccaaagtattgggattacaggcatgaaccattgggctcagcttatcttcttaatttaagagtactaatgaagatttttttttaattctcttctgtttcctgggttactctgtttctttctagttcaatttttcagggttttgttttgttttgttttagatggagtctcactctgttgcctaggctggcacaatctcggctcactgcaaccttcttctcccaggttcaagtgattctcctgcctcagcctcccaagtagctgggattacaggtgcccaccaccatgcccagctaatttttgtatttttagtagagacagggtttcgccatgttggccaggctggtcttgaactcctgacctcaggtgatccgcccacctctgcctcccacagtgctgggattataggcatgagccactgtgcctggccaatttttcagtttttaaaactcctggtcttcttttttgtgtgtgcgtgtgctgtttgtgttttcttcaaaagtctggtgatccttggctgtccgtatgttgacgggacagttcagttggtcagtgtgggaacgggcatggatttcctcttccaccaagcgtgtctgtttcctgaacttgctgtgtgaatgcacatggggcatagtcactggacagcttcagtttaaggtgcagggacctcaatctagcatcaacaccacctaagaagctttatttcccagcagaggtaagggtgagtgttgacagacccagacctcctcttcccctccccttcactgccctttctgccccaggaggaaagctcttcatgactccctctactccttcaggttaggctgtcactccccctaacttttctttatgaattattgccatcccatctgctttccacattcctaaaatctaccaaaaccccggtcagccatgatccttctttcaaccccagtacagctctggattctttcccttttgtctgtcttcaccaggatttttttgtgaactgggaaagaagaggtgggcaatattcagtgcatccaaagcctgagatttctttttgctcatgcttgatattttcttttagcattctgcaataaaaagtgaaaagcaggttacagaaataagaaaactttcaagtccaagccatcaaaagtggtgtcacctttgacagtttgcaaagaatgcccatttcatgcttaagtattttttcatccaagttgagtaactattaggctggtgcaaaagtaattgtggtttttgccattactttcaatgggaaaaaccacagttacttttgcaccagcctaataaaactagattagttctcatccacccttcttgtgagaagacacttttgcagagatgaggcaagggaatccggcatttctccctaaagcgttatccttttcttccagaagcagagtttgtctcccttgctccatagcccaagtgtgaagttgaacaaacaagttgtcattgtgtttcatgtggacagtccagtctgccagcccctgacttctatcacccacttcagtccagtttttgtccgaagaatgtatgtgtcaatgtgtgtcattggcttcagtgaccctttttaaattttggtctgagtagctatacatgttctttttctgccacagtgttggcatatgggatcattaatggctttttaggaaatgcattgttcacttcacctttgtacttcccagtagaacctgtaggctcatgaattcactacctttctgtgatttgtttagaatggtgacaatttctcaaagcaatttaacttgatgccctaattgctatgtatctggcgttgtttctcatttatgactgaaattgtcaatgcactgctttgctgttgttttggtttacagttaaacttgttttagcttgtcttaataaagtttacgtctattttaaatccatgttcctttctttagggtaaaaatatgatgctcatttgaacgtaacaaatattttccttatatttttcataaacaacaaagttcttggatgccaagcgcatgctaggtactgtgctctaggcattagatttgctaagatgattaagacaatttcagatctcaagcagctcacagtaaactgggctagattgtggttgtttaatgtgtttgtatatttgattgttgtttatttgatttgatttcgtttggttttggttttgcttatagttttacttaataggcatatctttgtaaaataaaaagttctcttgcagagaggtgtaaaccaaaaataaaattctaaggccccttaaccatctgaatggacccctcctctcagtcagggcattccaaagttaacccgaaaatctgtttcaggccatgcggggaagggagggttggacatgcctcattatgtcctcctcccttttggaattcaggaaaggctgaccagcatttaacatcaacacagaccttaagtctaataaaaaccatttacaatttattctctctgaagcctgctacctggaggcttcatctgcatgataaaactttggtctccaccgccccttatcataatccaaacatttctttctatcgataataactttttcaaccaattgccaatcagaaaatttgacatctacctataaccaggaagcccccactttgagctgtcctgcctttctgtccagaacaatgtatagcttacatgtatttgattgatgtcttgtatctccctaaaatgtataaaactagactgtgccccaaccaccttgggcacatgttctcaagatctcctgagggctgtgtcataggccattggttactcatatttgccttagaatgaatctcttcaaatattttacagagtttgactctttttgtcaacagaggctttggaattcctattttccattttatgtaaactctgtctcccatatattcctcttgtgttttaaaagatgcggagaaaaatctacacagtggcccctctcttcccaagtagtcacgctgagtgctgcttggcaatgttgaacaagaatacaccaaatttcatttactcatgtgcaatgaactgatgcttaggcactagtgctgtaggaagaatcgatgtgcaactgagtcaaggtgattttgagtctcaagtttcctttcttctcttttttttggaaaaagagtcgcgttctgttgcccaggctggagttcagtggcatgaccttggctcactgcaccctctaccttttgggttcaagtgattctcatgcctcagcctcccaagtagctgggactacaggtgtgcactgtcatacctggataattttttgtatttttagtagagatggggtttcaccatgttagccaggctgcctttcttctttcttgcatatgaacatcagaacactccattgtcctttaaatttagaacaagataatttacattatatccaattgcatagcagttaaaagctagccattaaaaaaatagaatcgtgtggctatcaggaaactaacgtttgtggagtgtatgaattttctatggctgccgttgcaaagtgccacagactgggccgcttaaacaacaggaatttattttctcacagttctggagtttttaagtccaaaaccaaggtgacaacagggttgaacagggttggctccttctgagagctgtggaggaaggatgtgttctaggcttttcttcttggcttatagatggccatcttcttcctgtgtcttcacgttatcttcccctctatgtgtccaaatttcctcttcgtataagaaccacagtgttattgaattagggcccaccctaatgacctcactttaaattcactacctccataaagatcctttttccaaatacagttacattctgaggtaccagggttagaacttcaacatgtggatttgggcagaggacacaattcagcccataacatgaaatgtctccagggtcccaggaagattctgggtactttcataaacattaatttatttgactttcacaaaattgccacactagagggacactatgatcccatttcacagatgagaaaaacagactaagaacaatgacttaccttgtacaatgtcaccagctaaaaagtagcaaaagcaggatttgaacctaaatctgtatgatccattctaccaagctgcttctatgtatttgccttctcaattcttttcttcctttgtaaatgtaatgttttgaatcaaaataaagtccaggaaagtttggctgtatccttttggctaggaagatttatttctatgaatatgtttggcctcctatttagtggccagggcttttggtcctggatgcctatgctttttctgtgcatctttcaaccttctctagcagatctcaggactcaatatttagcgttgcttgcagatccagacaaggtgttaacatctgctctatcaccgtcatctaataaatgggttgtctggtcagtggagagtttggattggtttgatctgcttcattactgggaaatcttgagtatctctcaaagggtaaaactcctttaagtgggagattgcatcataaagggcagaatcttttgtttgtttgggtttgagccaaaaaatggagaaataaggagagaacatctatgggtagagacgatacaacctaatgtgaagcttgctaagacagtgggaggagattaatgatgaagatgttcctttctcctaagagttgttgaaaccctccagttgtgaatgtaatcaggatagtaccaggctgaagacagatagagcactcttcattgccaaccagctaagtgtagtaaatgaaaccagtaaatgaaattggaaaaatgctcagccacatccacaaacagcctgtggttgacttaaacatttagaaatacatgctctttcccaagtaataaaaaatggcacttttcctagtaacatagtgcatatgatatgatattataatactatgactgtaattctggctgtacaacttagtgccagtgtgtgttgagcacattagtctcattgaacatcaattttttcatctgtcaaaccagcatgaaggcggctatgaaggtcaaatgagattgtatttgggagccttgcaaactatagaatggtatgcatgtgttagctatttttattgttattttatttttagcccaaatctaacacaacccataattatgctgaattatccagtttgattatccaatttatggattatccaggcctcctgttttccttcccctttttagttcttgcatgctttttagtcctttgaaaatgccttagaaatagtgaaataggaaatagaatatgcagttaggaatttttactttttaaattttattttggatattaacagatactagatggggagaaagttgaaaatagcccagttaacgaagagtttgttgtatataccactaaagtggcctgtcacattttaaaggagctaagcccttccaaggaaattacctgtcatctggtttcaaaacagtcctggcagactcccggtagatgctgacacttttaatttttcctgagtgctgttaaaattgcagaacttttggaaccatattcccgtatcaccttgatgggccaagtgattgaatagaacatgtgataaggatctttcctcaatgataaagcaccatggaaaatcctcagtcagcgacttgtaaagtgattgcagatcaagtctctgagttttcattgtccaagcatctgtaagacgttcccttggaataggaaggtctcttcatacttgcaaataaaatatcgtgtccatcttcccagttctccagtagatagtacattacctcttcattcactaaaaacgattgggcatattctatatttagaaagagttgctaatggtgtttctccttttctggggatagggcagtaagaatccgaatggagatgggattcatccagtagggtatgtcacggaagcaaagtaacttagccatggctaagtccctgggggataacttttattgatacttggttacttaagaattgaagttcttaggcttcaataagccttgctttcatggtttttcaaattcctaagctagctagtggaagatggctagtttgaagaaggatctatgaaataatagggtgctgtgttccaatttgatatgactcaggcaactggcggccatctactgtcagtactctctgaggaaatcgttaatttcagttatatatcaggattttaactaaaactcagcatctgatgaaccagagtgaactaatttggtatgccagcatctctctactgtgcactctccttaatgattgcctgaatttgatcaggttgatgccaacaaacctattattctgacaaatgctaatcagagataggattctgattttaatttcaaattcactgtgcactattaacttttctaacattgtacgcttttttttttgatggcctcatttgcatgatttttaaaatacgcatttctggctaagactttattatctgagtgttctttcatttaatacacgttttttgaggagttctttttttcaagggcatgaaaagattatcaattgatttgcagcagagatatgctgtggttgaattccatatgacctaactaataattatctgtcatcagggtagtaaagcataaaagttagaaccactggagtcaaattctgggttcaaattctaccttctccacaccacatagactgtatgtaatgtaaatgtagagaaattattactccatagctttattttcatctttttatggagataacaatagcatttatctggtagggttttggagaaggtttcattagaatggctcttgtaccagccagctttttctaggttatatggccataaaaatggatctaaaatatgaatagcttatacttacagaagtttatttctcattcatatttatgttcatcatggatttttaaatcctgtccacaaaagtaaattatagtttgggattctgctaaactgtagatattaccctctgctaggggagaaaagattaatatttatgtgtttgtcatatggtcctcttaagaataaaattaaagtgatgaatgcttcttttaatctttccagggaaggtggtctatggtgaacccatagcagccagtcttggcacagatggcactcactactggaataaagaatggcaccatgcagcccaccatgtcatgggtccacctttgcgaccagacccctcaacacccgacttcctcatgaatctgttggctaagtaatcattttgcagatgactgggaagtgtattgccaaaagaaggtttgggtagaagggagctcgtcctcccatctggatcctccactaacctcccagtattctcttctacttgacctgtcaggtcctgggtacccctcacctgcagagcaaaaaacattgacttaattatgctgtgatatgttgtcaaagcctttcctagactctcagaaatcagatcgttttcactgaaactttactcttttctgacttttttcatctcttgttgcccaaacccagggctcttcattacaccttactttttatcagaatattgttgaatttttttctatgctgatataatatgggaactaggttaaccctgttactttctgggaacatatgatcatttttcttgaaaattctaccattcttgggccagatgcagtggctcatgcttgtaatcccagcactttgggaggctgaggtgggcggatcacatgaggccaggagtttgagacaagcctggtgaacatggcaaatccccatctctactaaaaatacaaaaattggctgggcgtggtggcttatgcctgtaatcccagttactcgggaggctgaggcacgagaatcacttgaacccaggaggcagaggttgcagtgagcagagatagtgccactgcactccaacctgagtgacagagcaagactctgtctcgaaaaaaaaaagaaaagagaaaagaaaattctatccttcatggacatcccgacactccccattcacagatactcagtctcaagctaagagtttttcatgacagaccgtacaagagttcacttacccattcttttcagcttccttcctccttcatgattcagcatccccaagattactcacaagtcaaagcaggattcctgtccctggtaatatcagcatcgccagccagtctcaccctctgttcatcccagtgtggccgtgtggctagggactgccccggagggcctgccctccattcatgaggatcaccatggtgatgtctttgtggatgcagcattctgctcacaaggagttttctctcacatatttgctggtgattctgaagttatcttcatcaagtacatgtgactattcatttctagatgagaaatggagtctcggacaagctcatatcacagagctagttaagtgatggagctgagcttagaactcaggtttcctaacccatcttggatcatgcttccgatcagtgtgtcctctgaaagtgcttcctagaatagagacaggagagggatgaaatatgttcttgaaaaaactgctcattctccattggatttttctgacttcaattgagaagggagccaggagattaggaaaggttatggcagtttcctcctaacatattctgtatactcaccccatcactctcgtgttttttcttttacagtgatgatctaaccacaacagggactgataactgcactttcaacacctgccagaaagctcttgggaaggatgattttaccaagatccccaatggggtgaatggtgttgaagatcggatgtccgtaatatgggaaaaaggcgtggtgggtttcacaggttccagccttgctttgcctagttcttcagccaggatcctgcccatttgaggaccagagtggcacaaattttcatagagaagctttttgattgtttttactagggaggatactaggaatgcaatactatcacctcgaccaccattccatccctcagtatagcatcagcaaagaaataatcttctctgcatagtttattttagtttagacgatgcatcgcactattttgcggagacattagaggatgaattaagattgcatacaaagagggttattcttcaattctctgaaatggcatagcccttctgcttgatttctcatgctcttgaattccagtgcgtcatgtgtcattggcacgaatgcttgaaatgataaaaaatacacgaaggggcagggtgcagtggctcacacctgtaatcccagcactttgggaggccaaggcaggtggatcacttgaggtcaggagttcaagaccaacctggctaacatggtgaaaccccatctctactaaaaatacaaaagttagccgggcatggtggcacgtggctgtaatcccagctactcaggaggctgaggcaggagaattgcttgaacttgtgaggcagaggttgtggtgagtcaagatggcaccattgcactctagcctggggcaacacagtgagactccatcacaaaaaaaaaaaaatacacgaagcgtattcgttatgctcatacctcctttccatgaaatctttgttgatgtcagttctttttttttttttttttttgagacggagtctcactctgttgcccggactggagtgcagtggtgcaatcttggctcactgcaacctccacctcctgggttcaagtgattctcctgcctcagcctcccaagtagctgggattacagatgtgcaccaccatgactggcaaatttttgtatttttaatagagagggggtttcaccatgttggccaggctggtttcaaactcctgacctcaggtgatccacccgccttcgcctcccgaagtgttgggattgacaggcgtgagccaccgtgcccagcctgatgtcacttcttaaagaatccttggatatcatgtttttaaaattgctatatgaagtcacaaaagtaataatttaaagtctggaaaaaaatttaaatgtccatgactacaaaacttctccctgaggacggagaagaatcacatgactaaatgtctatgtgttaacttgtccagccagttgacatgtggagctgtgaagactagcagaggggacttgcctggttagacttctggtccccagtgtcatgcccttttcacccatctcctaggatgcctccctcaaatgacacattaattatatctcacacttcagaatcctcttcaattgcttttaccctacacataccacctacttctaactctaatgaattattcaccaagtcttgtcaattttgtttccaaagggcctccttatttctttcttcgttgctaccattctagttggaggctcatattttgtttggacctttgcagtaatctcacagctggtccccatctccagagtctcacttgctacagtgtattctttactccagtacaagaactcttgttctgtactgagaacagctgacaatgcttttattattatttttacaatattatagagggaggataggttttgaatgggagttctcatttagaaataaagttctgtttgtgctattgttctctcaaaaaccctttacttgcctccattacttattggatgatagttgaatcattaacttacaattagatcttcaaaacatctctatagcctcatcttctgctgattattttcctcaccccccttcctccaccctaactctaaccatcccagatgacttctcttcacttagattttcttgataaaagttcaagcttccacttgaacttctgttttacaatgaatatctttattatagcagattttcataatctatatagttccctggtatataaatggctttacagtgactgaatagttcttaataatatatagaaaaccatgtcattttatgaaacattaatatggtttacttatgggaatattactttcagggcatggttcttagtcatttttaaggcaagcattgtttgataattaaataaacctttagtaccctcttaccatataaatagggataaacccctaacactttccaattttattttagaggagccacacccctctgaattctgtccacattaaaatctcttgcaatagactatccataattgttggttcatgtaaaacttcaattgcataaaattgaacctcttgagttgtttttttatcttttcaaaaggattgcatctgggtgtggtggcttatgcctgtaatcctaacactttggggaggctaaggcaggtggattgcctcggcctcccgaagtgttaggattacagttccagaccagcctgggcaacatggtgaaaccccatctctataaaaaattagccaggcatggtggggcataccccaccatgtagtcccagctattaggttggtgcaaaagtaattgcagtttttgccattaaaagtgatggcaaaacagattgctttcgcaccaacctaatgcttgggaggcagagtggggaggatcacctgagccaagggaggttaaagctgcagtgagccatgatcacaccactgcactccagcctgggcaacagagtgagaccatatctcgaaacaaaaaatttaaaaaaagcattgtcacctgattcaaaagtgttgtcacctatcctctataatattcttttaaaaataataaaagcattgccagctgatttaaaaatgttgtcagctgggtgcagtggctcacgcctgtaatcccaacactttgggaggccaaggagggtggatcacctgaggtcaggagttggagaccagcctggccaacatggtgaaaccccgtctctactaaatacagaaaattagccaggtgtggtggtgcatgcctgtaatcccagttacttacttgggaggctgaggcaggagaatcgcttgaacctgggagatggaggttgcagtgagccaagatcgcaccactgcactccagcctgggcaacgagagtgaaattccatctcaaaaaaaaaaaaaaaaagtgttgtcacctattctcactctataatattctatctaatgtctacatgattatctcataaatcttaggtctgtaataaataagtcagatcataaatgtggtattgtcaaactttaaaggagaatcgaaaataccattaccaaaatttagctgtcacctataacaatttttgtgattctaggatgaatgggaagaattagtgtggatgctaagtagtggggtttctgaaaagtcatcttcaggcttccatatgttaccccatcatctccatcattggcattatgactgtttaatacttaccagcatcctcagatgctctacaatataagaaattaggtgcagttctgtttgtttaagagatgcaagtcttgtcattttatcgataggatactttttagtatttgatcattagaatgattctttgaattgctttacagcatagtggtaaaatggatgaaaacagatttgtggcagttaccagcacaaatgcagccaaaatttttaatctctatccaagaaaaggaagaatagctgtaggatcagatgctgacattgttatttgggacccaaaaggcacaaggtaagtctaagttcttgtattccttggcttcattgtggagaaaatgcactaacttgcacagaaataatgctttggcattaatcagccgcttctccttagatgacttctttagctgtgctcaggtattttgatcctgtacacaagataaaggttttgatgtgcaaatattcctttgtttttcttggcatagaggatgtagaagttgtgttgcattctctgacaatggatctgtatataaaaccaatatgaatttaccacttcagtgcctggcaaatgcccgagttcacatggaagaaaggtaaagcgtgatgaaggaaataaaaggcttagtttgaaaagggttgaattgaaaactcaaaataattacagcctttttaaagctttcagatagaaaaattccagcacaaaggatgtcactttcagttagccaaattttccagttgagttcatcttcagcctatcattcctagtagattccagctttttgtttccaatttccataattctatgttaatattgcaagtctggcaaattccaccaactcaggaaagcagtcaatagagactggagctctgttattgtctccttataggacgttagtacaggcaacacctgcagcctgatttgtgtttttcataaattttgcagtcgtagtggagaaaatcccattaaatgctttaataatctgtatgtatgtgcacttgcgtggacttctgcctcctcgtacaggcatttgttcaaagtctgttagggtttttattgtagtaagaaaaagtctacggtttcttgggctaatattgtcacaaaggcccagcttcaattgaagtgctcctgggttacctttgggaaaacgatgatcatttgaaacactaaggtaccatcactataagcctaaaaacaagccccagatattcctataggaaatccttgtttttttccacttgacactctctgggcacccactgttcccactcagggaccagttcacatggttggcaggccgtagtcatagcaagcaagcagccttcagttaaacacttcagcatatcacctcatcactggttaagatccatgcaatgccataaagggtggtatacacatcttactcacataagtatcttaagataacaacaagacatggttcaaggtctttcttatgttaataaggaactattgcccatttaaggactaaatatctggttgcatacaaaataattacatgcaaaatgaagacaagtaaaaccaaatgtaggcagcttctctacaaagctagaaaaattgtgcttggaaaggcaatggaaaaaaaattgcttggattttgcttgttctgtggctgaattgagcatgctgtgtttagagaactcctgatatttaaaatatcactctacagcgggctgctgtacacccagcaggggcctgcccagggccatcttggctgtaattcaaacaatttaggctgcttcaagggctgggaccaggcagaccttttgaaataacttgtggcttaaggagattgtgagctttaatctgaaatcctagaaattttcaaaagggagaaaactattctgtaaagaaatatttctgaaaaatggtgtttttgaagcataacatcagggagcatcatactaatgttaatcatcagtaataatctgtacgtcacagctctcgtgggtttttaaaatgttttggtgccttaaatgtaattttaccaggaaagacaaatattgattaccttatgacaatgagaaaacggtagctgtacaaccgtgtaagtgacaggtttgctatgagaaccctgacctagtgactttgacttcataaattcagatgtttcttcatgagattcagtaccaggctgtctgatagcaaagcagagcactttataattttcttgatttttcatattccatgttgtcttccaatcaggtgggccaataactaaaagcatttttggatttgatttcattctctgtcattctttatcaaaggtgagggaaaaaatgaaaatactttattgtgtggtgagactcttcagtctaattcttaataatatggagaatctcaggaggccatttgatgtgcttcttcttttgaatcctacacctgagtatctccaacagggcccagcctggggagccctcgtctgccgttttaatttctagggatgacaccagctcaggggtagagcattgtcttccctagacaactggacaaagagagatgacctgaacctaaggttgtgaataattcacttgctttatttaccacatattgctgcttggaggatatttataggctgtgattatgtctctttgagtcacgttttagactatataaatttagaccactttctcacaagttttgctactgatttctataacattgtcttgcccttcctttcctattcagttgtttcagaatagcacataaagatccagatgtgtagattttttttaaaagatctatatatattacctgcttaatttccctcatttctagtctaagaataactaacttaaggtcaaactaaaaagctcctatgtttttacatttctttctattgctttctctcataagttctttcacatttcttttttgtttgtttgtttgtttgagacggagtctcgctttgtcgcccaggctggagtgcagtggtgtgatctcggctcactgcaagctccgcctcccaggttcacgccattctcctgcctcagcctccctagtagctgggactacaggcggccgccactacgcccggctaatttttttgtattttttgtagagatggggtttcaccgtgttagccaggatgatctcggtctcctgacctcgtgatccgcccgtctcggcctcccaaagtgctgggattacaggcatgagccaccgcgcccagctgttttgcatttttgtatgatttccatccttcactttatgaaggacattatttatcacattaatgatcaaatatatttatcacaataatgataatagaaaattaaatatttacatttttgtatgtgtgtcttttgggagaaagatacatattctgcattatcttactagtatgaagccttctttatctatgtctgctgattgtgtacacctcggtgccagacataaggaaaaccagcataggccccagagcctgatgtgtaagttctggtcccagatccatcgaaggccatttaaagtctctgaaaatccactctttcatatgtaaaatgtgatcattaagaattgttatgcctacctcataaagttttggttagaatcacatgagatacatgtgaaaatgctttgtcaactaagaacgtgttacacaaagacaagatatgtattattatggttattttctatttctctagtttgactagtttcattctttgcaggacattttcatttttagatgttcttagctattttgcctgtggtgatcagaaggcagatgaaccatggggttctatttctctgactctagatccttttaaaaagctggtgacctttttgtctttcttttcttgttttatcgtttttttttttttttttgaaaagtggaaaaatattctcagggtatattgaattgattgagcctcccttggatttctttgacttatttgacttactctatatcttgcttctttactcctctaatttaacattttcctctaaaccatcatcagaatgtttttgcactatcattattcatttttttcagttacagaatgtgggaaaaaggagagaagggggctgttgaagaggaggcttcatagaataatgaatctggaagaattcaaggagaaagcgtgtttgttgtggttcacgttaaaagagagagatcgttgcagaaactgtatgctgagcccttgtctgggtcgatcacagcaccagctttctctattcttggcctggttgttatgagaaagttgctcatctgggctggctgttcccgaccaaaatttatgctgatgacctcaactaggacctttctgaagtgcaataatatttttagccttttctaactgtccatgaatcatccatagctttccactgtccttagacactacccctaccatcgtcactgtctgcctcttctcaccttgcagcccgagttctactgaatccagaaaacccacttacaatcctgtaccacaatctgtcttccttttctttctcattaatattcttgagtctagttccatttttaaaaataaatgttttattttagaatattttagatttacagaaaagttacaaagatagtacaagacactcctatgtaccccacagctggttgccactattattatcttacattagtatggtacacttgtcacaattaatgatccaatattgatatgctattattaactagaatccatgctttatcatatttccttagtttttgcctgttttttcccttccgggatttaatattacatttagtggtcatgtgtccttaggctcccctgacttgtgacaatttctctgactctgtttttgatgaccatgacagttttgaggaatatcgatcaggtattttgtagaatggcctctgttgtgattttcctgatgtttttctaattataagcttcgggttgtgggtttgcgggaggaagatcacaaaagtaaagaaccattttcatcaaaagacatacggtgagcacgacttaccactactggtgttgacctggatgaactggctgaggtcgtacttgccaagtttctccaccatacagctgttttccccacccctttccatgttgtattttctggaaggaagtcaccatgtacagcccatacttaaggagtgaggagttatgctctcgatttttgttttaattgatcctatttgacgtgggccagttcggttcagcatagagaagaagcacaataaatgttgaacaggtgagtgagaaggatgcagccttccacacggcatggaagattggcaggactaagaaacagcataaaggaaaattagaaagattttattcagcactggctatggtgagaggaaaagtaagaatagcatcttcccatttcatgctttttacttactgcatgtgatcaatacatgactgtgttagaagaatgaatggataaagatgaatttaagtagaaaagattttccaaggagaggaggaagaactgtctcgctggtcttattttctttaagtgccccttcattttttaggttggagcaacgagtttgttaagcagagctcttagagagatgaaatgaagccaaaagagtcacctttgtgtgttccttcattcacaaattcactctgcacaggagcacctcggcaagccgcaggctgagggtcaagcttatacaacagccacaccctgcctttaagaagctgacagtctaggagaggagaggagatgtaaagtcaaatattctcagcctaagaagggatgggttaagaatatcacacgagaggcagaaacaagatgccttagaaattcaaagaagaaagatcattgtggagttagagcagtcatcgacatgaaatcgtacgagagaggtgagtagataacgtggccctgtgagtcaagactaaacatggaggtgagataaaccaaggcattgacagggggttctaggaggaagcagttaaggctggggattgcactacagagagaacagcttcaggctgtagaaggaaatgagaaggtgaagaggttgtggctgtctccacttttaattgtgtttatcacagacagaggcaattttaaatagagttcaccttgtagagaagtgttatttaatcaaatgaataaatgaatatatctatacggtttttttttcttcttgcaatgaaggcctcccttttaaattttacgtgcctgattttaacattaaatgcaggctggtaatgtgcaggatttttgtctcacaccattagatgttggcccaaattttcctacaaaatttccttaaacagttttagcaaaaataattgcccagccgtcttgttagtatctaacaggaaagcaacatgcattgcaccctagatgctgaagggggcgcccgcagcccgagcactgagctaggctggctccagccaggccattcgagctgctggttatgcaagaacaagccagcctctggagaacggatgcatttgctaaagatttttggcttcatggtacatagatgttttcgtttttaaaattcttgttacttattaatggcatgtagacgtaagtatgcttgccacacaatctgtagccttaaaaatggaccacgttaaagttaccaggggagaccagtggaaagaaaagcagggcagccatgcttattttttccttttaaatctgtaaaaagtgagatgattccaaggtgaggaatttgacatatggtgatggatggcgagagagaattgggagtgggcgtagtagggaaggtttggacatcctgatgaaagattacctaagacgtcactagcctgtaaaaagttcctgcaaaaatcaactgcaatagctcttctgtgtcattgcacaataaagaacaaactgcatttagtgtaaagggagcattcacctttttcggaaataaagagcctgctgtattcagcctgacagctcattgaactggtgtctattgcttatgacggaagtatgtgtcctactgcttcactacttgggtcaaagtttcaaatttaaggacgttttccatatctgaatgtctgacccatttctgtagaagatcttggtacttagagtcaggagaagaaatcaggaacatgcttttcatgtgatgtaaagacagaatcttgtggtgtcatgtggtcaagacagagatcagccaaattggccaacttgttaaaaatcttattagagagagtgacatgtcagttacttgcaagcccatagctgcagcagtaagtcatgttctggcaatttaaaaccatcctcggagcttcagttctttggtattcattaaatagcacttagttactatggtaactgtcccttttcagtatttatgagctacaggatatctcacagaatctcaagcacacaaacacacagctaacacattgtgtgtactggaacatttaatgaagacttctagctggaccgtattctgccgagcagacatattttcatttattattttttaactcaattatggcaggctttgaccttgaatacaccattcttgaaagcattgtgccatctttcttgcttaatttccttccttttctcattgaagatagagataaatgaatttaactttatattcagtgaagagtaatggcttgcggcttatgatggtgcccttctggattctagagggggccttttgtgtgaaataaagcgggggaagaatgactgtcatccttgggtagtagggattgtagggcgtggggagggagaagaaaggaggagtcaggtaccctttggcaaagagtgatggttatggcttattaggatagctacatcaccagtgactgtttcacagaagctatgaagcattttcccttgaagttgcacattgtgtatcctctgactaatttgtgcgttataatcctcctcctcttcctcaaagaaagcgtgcacacacacacacacacactcacatgcacatcagcacagcagcctgtgttcctgctcataacagttgatcggcctaaagatgctgcttttcatgcctgtttctaagagtgtctgtcactaacgcgcccgccactccccacacccacaagcatcccagtgtgcattgtgtgggtcttgtcatgggtgcataagtggaaatgaatatgatttatgccatgatttgtcactgtgatgtcttgtaacacaatatcagggctgtaccatggtgtcagggctgctggctgaggtggttcaggttgtgcttttgcaaagttacaggggcactcttcacatcatagttaccacagatatatgtggatagataggtagctagatatagatacaggtagtaactatgccagttttctagcatatgatagcaaagcaccttgaggaacaaatatctgttgctaatccacacaaaatcaaacctgccatctgggctattgggggggagcagtaccatagagtgaagagaaaggctttggtgataaattcctagtctgccacttatgagctgggtgtgaccttgggtatatcatttaatttttctgaatttcaatttttttatttgcaaaatgggcatgatgatgatatttatttcctagctttgttgtgagttttaaggtagcatcataagatgcttggaacatagttagtgttcagtagcagttggcatgtagtaggtagtcagttagtggtaatagatagtagtagtaggtggtcagtttgtgaaatgagtgggagctcttattagctatagctgtgagtcagaaatctttgtataatgacttaattcagacaggaccaaaagatactataattatatttcatataaaaactctgtctcccaggtttcttgcacacctttaattttcaccactaaatttcagaatgactaaaattaagaagcttggatggattattttggctaagatagcccgagcctccagaactgacaccttttaaaaattattagcagtgaaactgttcaaacaaacctcctaagattcattttgtggccttcagaagacatttgctttaaaaaaaaaaaaaagtctgggctatgcatgaaaaaaagctaacattgttgattacatatgcatacaattttaaccactctttattccaagttgtttatttaaacatatttttatgcaactgaacctttcaagtgaactagaaatgatttctagggactttactactaataactgcattttcccccaaattataaaagaaaagcagcttagaaatgaatcacagtaacccattctatcactgatcatttggcttggccagagtaagcagtttattttcagcattagcattgggcaaaaaataagcaccaagcgaggctgtgtgaaaggcataggctttcctaactaagcacctgctgtatttttcttcctacctgacatagattctatgtttttatatctttgacatttgcttgtattatttacaactgtatccctaggtttaagcacagctccaggtatatatagaagctcaatagtcatttgttgagtgaagaaaccagatactaatggacaaatgtgtgatttaacatttttgtctgaactttatctgcccatggaactggttcaagagccgtgttttacattcttcccccctttgaattaaaaagaagagaattctcagcacttctgtcttcttccccaaagcagtgcttgacaaagatgcattccagagacagtggctagttagtgtcaccagacctgttcgtgaatgtggtttacaccaggtcagatccttctgtgggtcaaacaacactgttttttggactcagactcatctctaattctggccagttattttaaaattatggccatcggttatggaggaaacagaggacagagtgaaaatggctgaaaagaaatttaatatcagtatctgaaaagaatcccagggtccttatatgcttattgtacagcaaagaaccttgtcttcctataaaggccttagaagaaatcacctataaaagtggtcccctccctctagaagactacagtggaagtctatttggaggcagtgagtaattcaaggaagggcctgcattttaatggcctgaccaaaacaccaaaaaacttaagttgatttactattttttttttaagagcagaggttctcaaagcatggtttctggactagcaacatcaacatcatctgggaatttttcagaaatgccaactctcagaccctaccccagagctgctgcctcaaaaactcctgtagttggttccagcaatctaggttttcccaagccctccagcggcttctgatacacactcaagtttgagaaacactggtttagagtcataaaattagataacactttggaactaaaaaagtccaattagcgcccccaaatggagttctctatacctttgcttgattgctgctagtttcagggaacttactacctaaccaaacagtccttttctttctgggatgcctgtaattatgaggacattcttcttctggttgcattaaaattatctcctcttagaccttcacatgtttagcctttggaattatgcagaatatatctacattctcatatgatagtcctttcatttattcattcaaatgtttgaagaaagttactggctcccagtaagccttcccatcaccagatatggattcccaggttcttcaccagatccttaggcccatgagtagcaaaatcccaatcacctgacctctcctgtatccacccttctcttgacacacacttgtccatgtcctgcaaacatgtgagtcccagaactagacatgttcctgcctgtaataccatcagagcaggaatatctgaggctgattagttttataattaaatgcagaactttgcaattttttaaaataacattttccttgaatacaccttgtacatccaaaacagtaattgtgagcaattgcatgaggtttgaatatcttaccacatttattcagtgagtaattaaaaaacttatattgggtcttctctgatgtttatgttaaaatgactaggattatagtaaatggctggtttctgtgttttaagtctctttgagtagacagtaacttacaacgtccataatttttttaaaaagtacaatatttaatataaacaaaaggtacaaagagtactatagctaacacttgtgtattaaccttcccaggcctgtctccttcctcatctcaacaactacccaatttggtgtttatcatttccatgcatttctttctatttactatatatatataggtgcatttctaaggcatgactatatatttacataatatatattatatataatttttgtgtattcttagcttcatatgaattgtactatatgtattgtgcaactttctcaacattataattgttagatttatctatgttgaaatgtggtttttttattttcactgctttatactattatgctttatgaatataccataattgatgatatattcttttgctggtggacattcaggttgtttgcaatttttcactatttcagacactgtatgtctttgtatatatgtgtgagagtttctctggggcattcatctatcccctggtttgttttatatgaaatgctctcacattttctcaatagaaacgtataaatttatgggcctttgcaactaaatgcagaaattcccatttctctctcttatgcttttatcttgttccacattcatttattcagccattacaaaccatatcttgggccctaccatgtgccagagacatagtaggtggtggagacaaagtgattaggcataatcccattctttaccagggtggtaagggcatggccagcagagaagtggtggcttttgctttttgccccagttgtcttttgaattgtgattctgatggtccaggtactagctctcactgccagagtaagcccaccaatcagacagtgggttctctgaccagatctaccacaccagagccacagaaacaaagctggtgggccctgcaaccctggcaggggtgggcctggagctggaatatgaatgggggaggaagtgaagacaacaaagctccagaccccttccagtcccctgaggcgacacagccgaatattcacctatttggtgacttgagtctgcacgtatttcatcattctaaccgcacacacaatgcttgaaatatataatattggcacccacccaagacacacgcacatagacatataactgtttcctattaatcagtacctctctttatagccacattttcacaaacattcgcattggcccttgattttctgagctcatcacatagaagctaagatctgtgaatctgaggttagtgctttctttctgtgctccagggcaacagattgcgcattctgtccttggttacaagtgtgcacttggcaggagcgtggcctgcatccctgcaaatctgccaacgctcctggacatcggtttcaagcatatcctgctggcagtggggcttctttgaacaccagcagtcagttgacttctaagtttaaaagatttcatgtacctgcagaacacttccttggtgccctccccaaaaagtggcctgtgcaacccagagagcacatgggaaggagagtcagagtacattaggtttatttcacaactgcagctgcagtcacattaaacttattgcctaatttcctttgtctaacttgatttctctttggctgggaggcaaatagattgatatttttttttatgctgaggttatgttgcctgaagaaaattttccattggttcactatgcctgcctttagtccagtaaatggggccgcgtgctgtctgggcaaggaagggcctccccagatgtgctcttgaggccagctgtctgcgtggaggaggcacctcctggaaggggtaacaggggctgcccctcccatgaggggtattgctgagcatttgtgctgggctctcagctcatttctctggctgtcttctaataaatagctttgttttattttttcctttcctgtgaagtccttttctccctatgttttctctatcattttgtatatttgcaatgctctttccctctccaaaatttcttaaaggtggtttcttcacgtttttgttatattttcttcccgtgagccctccactatcatcctgtgctatgattgtgcccttttcttctcaccagagaagggaaatgttcttactttgctctcagttctgtcctcctaccaggcatttatttaagagagctaagtttctggaggcagaataatgagaaggcaatttacccacaagaaaaacaaatggagcctttatctgtgtagaaggattgctgaattcctcacatggtggaggcgagggggatgaggacaatgttaatcagttatctgaaaacatatattgattgcatgttcattgtgtgtaagaaatgtgtgagaaattactgagtactgagggagacataaatataaggtgtaatacctgtcatcagagaggttgcattttggtaagacaaagatataaacatagtgaaggataactaagttttggaagagaaaaatatcagctcaacacatcagtaccagagatgaaggaggtctcacgtgctggtctccttgacaaaggagtagtccaaataattgtcctaagttgaggtcgtctgtgaagacttcacagatgactggtttgggcttgggaaggggctttgcactaaccgaatccttggaggtggctctggacaggtggatggggacagtaaagccatccagatggtggagtcaggggcaaatgaggaaaatgggaaagatacagtcgtgggataataaaaactggagaatgagagaggggtcaggatgggaaggagttgaagatgagatttgtccttgtcagactgccaagggctttgaatgttaggtgaagtatagcagattttatgtgaggcagcatgagctattgaatgtctttgagtgagggtttgagttgatccaaatctgtgcttcccaatttgcctggcaccagtagaaaatggtgttatttgtagagtacatggctgtaaagagaaggggctttggagatggggaggaggatgtagcaaaaccaactcaccctggtttgcctgggactttcccagttttagcactgaaactcccatgtccttggaagcgctctcagtttaagcctaagctgtgaatgtcactctaggaggttgcttttggtcaaaggtgttggcctaggatctctacacctacctggtcaccctagagtctgagggttttagtcttgtgtctaggcctgtcggctggggaaatctgactaaatcgtattttagggtgatgagtgtgtaggatggattggactcacagagaatggtcaggaggctattgtaggagtctggccggaggggataagtcaagatgaaagcaaacaaaatgaaggcctggaaaatgggggaaaaaaggagttaatttaggttggtgaaaaattggaaatggactgaaagagaggagtcagaagtgacttcaaaataactgcagccttgctcatgtatgaaccaagcatttatcgagtgccagctggatgcaatacattgtactcaaagttgagtgaaaaaattattaccctaagggaacttaggatctaattagacagataaggaacaccccaagtaactcaaataactataatacaaggtaaaagattaggcccaatggttaagggacatggcatttagagccaaattaggcaactgtatttaaatcttaactgtgccagtactggctgcaggaccttgggcaagttactcccctcttcgaggctctttcctccccagtaaaatgtagatatgataataattgtagcaacttttggggcttgttgagaagagttaatgcctttaatatggtgcctggcatatagtagaactttaaaaaccattaatatcatgatcatgtatcaagtgataaagcactagagagttatacagtagtagggagataccaaagtaaatgacttttataatgtgggattctaggaaaaaaagcttagaaaaattcaactatcccaaatttcagtttgttttgtcaatcacagtttcatccttgtttatacatttcctgtcctgcatatttagtttgtatttttttaagattttttaaattttatttaattaattaatttatttctctgtcacccaggctggagtacagtggcacgatcttggctcactgcaatctctgcctccctagttcaagcaattgtcctgcctcagcctcctgagtagctggaattacaggcgtgcaccaccacgcccagctaatttttgtactcttagtagagacggggtttcactatgttggccaggctggtcttgaactcctgacctcaagtgatccgcccacctcggcctcccaaagtgctgggattataggcatgagccactgtgcccggccctgcacatttagtttgtgactggcatgttggtgaggcacagtggtaaccacaattttagtagaatgccccttagacatttaattgtacagtgccattaaacatgtgtggccgggcacagtggctcacacctgtaatcccagcactttgggatcacgaggtcaggagttcaaaactagcctggccaacatggtgaaacctcgtctctactaaaaatacaaaaattagctgagagtggtggccggcgcctgtaatccgagctacctgggaggctgaggcaggagaatcatttaaacctgggaggcagaggttgcagtgagccaagatcatgccattgtattccagcctgggcaacaagagtgaaactctatctcaaaaaaaaaaaacaaacaaaaaaacatgtttggaggatccaaatgtattttagaatcctttgattttaaaggcactctgtctgacagcatggactagtggcctcaaggaatgactctgtatataatttttttaatgttaggtccttaatttagatttcatagtaatgggtaatttaaagctttaaaattttttgctatttgaaaacttaaaaccaaatttcttgtttttccgttgaatggattactaaaagaaaattactgtttcaaagggtacaatcttttgatacagcacaatctcttgctcttccttttatttttgctacttttgcaggtaaaaattgttacctttcagctatgaataacatacatttgagcaataaggaaattgaacactttttcatgtttattagtcattgaggtttttttcttatggagaaatatctattcatgccctttgttcatgtttcttttggtaacataatattatttgtgtctttatttaaatggtctgtcacatttcttgcaaaatccctaaggcttttttgagaaataaatgctacagttacatgaaagtgttttgtataaactgtaaggtactacaagcatgttactattattgaaacattgactttgttcactaaggtatgtcagaatcatatttataacaaagagattcttccaaatgcagaaatagcatggctagggtgtgagctcagatttttatctttgttcactgctgtatccccagcacctagaaccgtgcctggcacggagtaggtgatcaataaatgcatgtaaaatgaatgagtgtatgataaacccattgaatggtagggattttctacattcttccaccaagatgactttttttttttcttcctgtcttaagccagaagtgaaaagggttgtgtatagttcgtgggctagagctatggaattgtggtcttaagattctggacataggaaacccatttattagaacctaactttctttatggtaatattttaagcctagttagtatattattctccctcatttaagagagaaaccagagacaagaagagtttaatgatccaagaatgattttcaacaatgataaaagactaagttgtagttttgtttttaatatagcagtgtttccaattcctaaaatatggcaaacgttgttttcttctcctctcatgcctcatttgttgtttttctgttacctatgagaataaattgtatgcatggcctaaaagaaaacatgacaacttgccttcaatggattcattttttggttgcctatttttgggtaaaggttttgtatagaagtttctgctaatgagtataatctcctatgtagacctaaattccactactcacaggtacatggtaccgtccttttttctaatgttttcctgttctgtttttatccctaatcatcctacctcctgttatgttttccttttaaagtactttagtatttctggaagaagaggggttaaaattttatataaatgtgcatttagctctagacttgtgttctggatggatcacttatagtgagagacactatacagtggttaagcacttactatttgagtcatatacactgtgaggtgagttacctggcttctctgagcctctattgctccatttataagtatgaaaaaactctgcttccatagggttaaataaaataatgaggattgaataaaataatgtatgaaaaacttctcacatagggtttagtagcatgcagtaaatggaagctccaatggaatacttttccttattagcatcgtattcataatagatggccttggccatggcttccaaccactgaagtgctattagtaaatgtaagaaaaatgaagtgaaaatgtcaagggtgaatgcttttggaagcaaaacgatcaggaaactattccagaagtaacccagccaggatatattagtcagggttcaatcagaaaagtagatccacttggatgtctgtgtgtgtgtatgtgtgtgtgtgtgtttatacatatgcatatgtgtgcatatatacgtgcatagatatacacatacacatccatatgtatgacttgaccttccacactcatagggactggactctctgcaaggctactgccttcatgtctgatgctggagtctgcaggccagagggcaagtggtcaggaagggaagatggaggtgaagtgggaagagcaaggaccaggtcgaaccccaaccatgagctggagccccacagggaaagatgaagacctgagcccgttcttgtttgcctttgccctgggtatgtggtgtgggtggctgcttttggtcatgaggccaaactcacacacctggcccaggagttggagcaggtgaaggaggatccgggggaaggtggagcattgcaaacctgaccacattctcacactacgagatgagtcagcaggtatcatgtgtgcaaaatggctgctgcgtcacttccaccctccaccagagctctaggtatagatgccatcatcagtgcaggtaaccattttaaggagaaaacaacagaggttcagagaggttaaatcatttgtcccggttcacacatctggaaaggacagagttgggattcagagcaggcctggttgactgcagtatctagacttttaaccactgcagagcttacagcctcttagaagggcaggcaaggaggggccatttacagcacaggggttcatacttggtctctggagcctgactgcccaggtttgtaatctgtccctccacttactgacggtgtaacccagggggagttacttcactttggtttgcttcaattcccttgtctgtcaaaggggaatgattataatacctatatcaaaggctgagagttgatatatgtgaattctttgcaacagtgcccagagttttaagcaccccatgaacttggctgagcaagtcagcagatcccggagcatctggctgtggcgggcagctcatcatgccctcctgggcgctgctcccctccaccccctccagcatggatgtcctcaggcgtgctccctggtgaagctgagtcagtttcgaggtctgcagttctgcagcttttcagcatcaccgccttggactcagccttgtgcctgctccaggcagacagaggtgatgttacagtgactacattagcgccagctgattgtgcttcctagaagcagacaccttttagattggccaaagctcaaaccatacaacttagttgctaattgggaccctgaggctgagcttctagctctgacagagcctccaagatgctttatttcaggagtgtcaatgaaatgttagcatgcaccaccactggaagagatgattagctgtcaccaagttctcacccagatggaaagtagataattactattaaaattccagtgtaggtaattgtttgaatgagtgaagagtatagtgctttcatcctttgagcagggggtgaacactgatggctggagtactggggcaggagaatagagtggggtcagcgtcaacctgctaagtttgatttctggccctgctgactcaggacaagttactcaagctctctaagtctctgttttctcatctgttaaatggaaatacaaaggtggattgttgagagattcaatgaggcaatgtacctgaaagtactcggaatacagagatgcttcatggatagtggccacacccgacactgtggggacagtcattcgtgtccctctgccactgcaacttttagtggtcacttttttttccccatcccttttgttctcgctccttttaggtccttgcctgtcgtttttttttcttatttgtggctctctcacaccaagttttaggtcttccaattactcttcagagccttgtgttgttattgttgctttttgtttgtttgtttgtttgtttttgccactagagatattcagagcaggggaagagcaaactttttgtaaagagccacatagtactttctttttggctttgtgggccatatggactctgttgctagtactcaactctgctgttgtagtgcaaaagcagcaacaaataatatgtaaatgaatgtgactgtgtttcaataaaactttatttacaatgcaggctatgggccagatttggcctgcgggccatggtttgccaacctctggtttagaaatttgaggtcagactcctgtcattgaatatccaaggtcatctcttcagatggacatcctgatctccagttcacaccaaggagcctttgatgcctggaagcctttttgccttatttttccacggcacagtcttcagacagtgaagcatgaagttactttgttattcacaactgttactttgtttactcatttaagtttagaagattctaaacaaattccacttaaacacttagatcataagtggcttcatcaattcaaaaccaactgatggttttgagcagtgagcattaggtaaaacttcctagccttggcagaaatatataagcttagtactagtacagtgagcattgcatggttactgactgattgtctcaggtcacttccaaaacagcttacagaccctgcgttgaggttcaaatgagctgggaaccctttttactacatagatctgagttcaagatctagtttttccatgtgccaactgtgtcttaggcaatctcattcagccttagtgttctcatccataaaatagggataataataataataatagtattgatatcataggttcattgtgaggattaaagataaggctttaatgcctagctcagagcaaagaggccataaatatttgttatgcctattataagaacatgtttgtggtggctttggagtttctgagtgccccttcagctgtgacttgggaacagaatcaaaggcacttatgtttctgtttgccttgttaccttctcaggaaagctggaggccaggtcttgattcttaggattgcagaacttgaagttctctctgacttttaaaggagtgcttcagcccatttttgtggatttcacacaattctttagcattctggatttcatggttgtctggcttgactgtagactttccttctctcttttactaacatacctcactccctggttgtcagaaagttattttccagtgtcaaactacatttcctctgtcagcatttatgcttactcactcttttcatttccctcagtagggatggagggaaaataggtcatcttcttcctttcaaaaaaaagagttaagtttagaagtcccccagacatttctgttatccagcttctcttttccaacccttaaattgagagccctccttcctgtcttcccttcacagtctagccattctgttactggcggcagagatccttgctcccagagctcccaagatggtggcaggctgcttccaagatggtggcaggctgcttccaagatggtggcaagcctcgtgttctctgacctggggttcttggcctcacggattccaaggaatggaatcttgggccatgcagtgagtgttatagctctattagaagccatgggtcatggaagggaaccatggaacccagtgactagtgttcagcttgattagggtgaacccgggcactcagctgtgcaggaatacccgatcaggagcagcaatgggagccttgctggatcaggagtacagtggacaccctgccagatctggagagatggaagtcagcagtaggtctgtgagggtggcaaacagcagtggtggacggcaacaaacacggaccagaagagagtgcagttgcaagatttaatagagtgaaaacagagctcccatacaaagagaggggaaccaaagagggtagccattgccggcttgaatgcttgggtttatatcccgatcattgtccctcacgctgtgctctcaggcgatagatgattggctatttctttacctcctttatgcctaattagcattttagtgagctctctttactacctgattggtcgggtgtgagctaagttgtaagccccatgtttaaaggtggatgtgatcaccttcccagctaggcttagggattcttagttggcctaggaaatccagctagtcctgtctcttaattcctttttcttcctaaaatatggagctagaactgaacataccaataagtccctggcctattgtgtactttcgggaaggatgttgtgtgagttttacccagtgtatttctatataggaaactgacatcttttcctgctcaagttgtcctcatagtctgtcaagcaatgtcagcttgccaaagacaacacagcttcctgggaaggatgacaataaaattataagaccaagtccacacatcaccccagaaagttatttctaactctcaccagtattcaggctaatagcctagctttccaaaagctaataatcgtaccttacctataagtacttatctgtttaatattcataagacatacatcctagtatcatgctagcttggctgattcacattcagttcctgttccttaaagacactaaattatttttagtttcccactttctaaaaactaccgtatagaacaaggaatatttatgctaagtggaaatccagaaatttgctaataacttatttgcagataaacaaatacatatataaaatacctctgtttgctcagtactgtgtgaggcataggaggtgaaggacatggtacctacatacaaggtcagcttgctcatgtctaaatccaatttatctcaccatgacctacatcaccatccatgacctatattacatacctccaaggacaaaatagcagagtgaactttattcctttaagtcaatgcttggggagcatttttataaacctgcattaagtattttgtcatctactgagcaccggtagagttccaagttattgtccaatttagatttaataacgtggctgaagcaattcccattttctcttctgcaggaggcgggtgtagaagtctcaatagagggtggaagattgatgggtgcagtgagtggcaactttgcttaataatgacaatgtacttgaagcagcaccatttagcatttccagagatgtggctgctttgctccccatttatataacttgtcacatctaagaaactgacagaagaggtagtttgaaatagacagaacacacacttagaaaaagtcttctatggtgattacatcaagaatgactggtcaattttggcttaaggaattcttaatagcatcctaaatcctttactgctaaacagaaaacagaccaagaaacatcatggagtatgaaacaagctgcttcctatttattttctggtggattaagaatgttttcatcaaccgcatgctttccaggtagcttcccataaagctttcgaggggcagtattgtctagtggttaagagcacaacctctgaagcgaaaggcccaggcttatctcatatgtcatatttatatctcagctacatgaacttactagctgtgtaaactggggtgagtgttattaatctttctgtgcctcatcatccttatctagcccatgggaataataataataataataataataataataataataatacctacctcataggaagatgtcatgattattattgtttcacactgaatacataaggcatcacacaacacaatgtagagagatgaggtatatttttaaagatgccactaataatcctgacatgattctattaactttttttgtttctcatggcaacctggtaagaatctatctgttccaaggccaaagtgcctgagtgggagagaatataacagaatacctaaaacaagtcatttatctggggttggggagacccacattactctaggaaattctcttcctctccacaatgctccttctgaatgcatatgggtggtgttgctatctcctgcaggctctgcttcagtgattttctcatctgtaagagcacgcggctctttgacagaaagctatttgcaaagggacagaatgtttttctgcagctgtgatgtgagtggtatcaaagttattggctaagttggaaaatagcttaatgttttcagggcttctgcttccatatctgcttctgccttggagatgtgtataattgggactcagtaagacaaccttgacacccctctgcagcaagatgtgcctctttcatacaggcttaaagtgagcttgacaaagagtagcttttgccttggggcagagtgaccatggagaacatcatttctgtgaatctgctaatgagtcagcggccaggaactcagcctcactccctagatggtcaggcttccatcattctgtatccttcctgttgctgccagagcaggccaaaatcctagctgtccaatcagtcattagagagaatgtatttctcacaattgccactctcttgagctgctttgcgtttggtaaatttgaaaactatttagtaatgaatcttgaagctctttgcttttgcctacaaatgtagtgataacatctccccacatctgcatctgttctgcaggaagatttagttgaaaagatcttcttggttctttttgagtctcaggccttttgaactctgcctcagaaacatccatgggctcttcattaagggaattattctccagaggacaaggtgtctatcagtcagggactttggttgcaaaccctggtaactaacctgtgctcacttcagtaaaaacacactctgtgggaaggccatggggagctcacagatggaaggcacagtccctgctccagcttggaatggttggagcccagggtgaccccaggcagcttgcagcaggaattggtctgagctcagggatgtaccctccaaccacttttaattatttttgtcaccatgcaaaatattctaaattcctgggaaagagaatgcaattgcccatctcttggttagggaaaagcagacaaccatgcctaagggtcttgtcagattatctccaaagcaggaaagtagtttctttcttttttttttttttttttttttttgagacggagtcttgctgtctcccaggctggagtgcagtggtgcgatctcggctcactgcaagctccgcctcccaggttcacgccattctcctgcctcagcctcccaagtacctgggactacaggtgcccgccaccacacctggctaattttttgtatttttagtagagacggggtttcaccatgttagccaggatggtctcaatctcctgatctcgtgatccacccacctcggcctcccaaagtgctgggattacaggcgtgagcaaccgcacgcagctgcaggaaagtagtttcttaaagaaaaactggggtgctgacaccagaagatgggagaatggatgtcaaggggccaaaccacagttcttgttctcctgcatgtctcaggatgggatagtgtgtggggcccacttaaaagcttaaatatgctgcaaaagatacatgatgcctgctccaaatatctcagtgtcacagcaccctatgacaatagcgtattagtccattggctgaatatcttagagcctggatgtgggttttcttggtttttttttgttgttgttttttttttttttttttttgagatggagtctcactctgttgcccaggctggagttcagtggtaccatcttggctcactgcaacctccaccccccaggttcaactgattctcctgcttcagcctcctgagtagctgggattacagctatgtaccaccatgccctgctaacttttgtatttttagtagagacagggtttcaccatgttggccaggctggtctcgaactcctgacctcaagtgatctgcccgcctcagcttcccaaagtgctgggattacaggcgtgagccaccatgcctggcctgttttcttgctttcttccaagattatctcccagccttcaaagcatggcctgctcatcagatgacatgaggcccatcagctctgcaggggaggttatgtgagtctgactttggccttcacacctgcacctcagctgcttcaggagaagccactttgggcaagttacaagaacctgggggatgtttcattacagtgaaataaaggcatagggtgagttttgaaaggatgggtctgttcccatgtgctatatgacaatggccctagatgggtgttaagatactgtgctaaacactcacctctctccagggcctctcttagggacaatgcctggagggcagttgggttcagccttcacattcaagaaaggcctcaaatttgtgtttttcaaattatcacaaaagcagatttttctaaaagttccatagatacattgcaagaattgaaagaaaaagctgtgtcaggcagggttcttagctgcaatcaagagaaattcactctaaatagttaaacaaaaagggaatgtatcaaaggatactgggtggctcatagactctccaggagggctagaggagcaagctgagaggctgagcagccaggactgatgccccaggcatcccacagggcatcggagagctctgctcctgctcctaggcacagatactgcagatcacctcactgcagtggagctcagatcctgctgctagaatctctgtcacagctggccctaaacccaggattgacccatctctaccctccacatggattcctgtggtagctgcttcctgtgtcaccaacttgccaggcaaagtctggtactagggcatcattttgaaggagcccaggtcacatgcctgggccctagctgcaaagaagtctgggaagacatgtttttggcttctgccatggggagaattccccagaggaagtgtgttcaaaggaatgacagatgtccttacaaagatgtgtgactctgaacttgcgtttgttccaataatggaccacatctcccaaactgcacaacaaatgcatagattttaaacactgtttggtagtgatctgataaatcacgtgatgatattgcattgtatttttatgtttaaaactgtctataattaaatattgaaaatgtaccacaatttttaaaactttctgatggcagggttacaaatataacagtattctcaaaagttggaagtggtttctgcctctcacaagttcattcaatattaaactatgtgaaccttgggcaagttgtgaaacggcactatttcagcattatcatcttggaaatggagtaataatactgagctgtgtgcttattacagttggtaatattaaaattgccaagtatttataggtattagtgaacaagtatttcatataagctaagatgccactaagaatgatagttataacaattttacttatttattcattactaatcaacctgtacagcatgctagaaatgttgggtacccaacaaaaatgggctggatgtttacctctcatttacttcagtgttctgttcccaaaacacagtcatgtcccagaagacagtggaggcaggaatttaaaccaacctgactaaacaggaggacaatcatgcaatcttttaatttgatcatcacataaatgtttataaagcacctagcatgtgctgaagctaaaccaacctagtctctgtcttaaagtgtgtaccaagtaggaaaagagagccttgtcaagagatcaatgtgataccttcagataatgctaaacgacggaggaaaatgttcagtttcaccccatgtcgtcagggtcagcttctagggaccagggttcttgggtggagttttagggcagggagaagggcagaagtgaggagggcctttagggaaaagacaacttcatgtgcaaggattcagaagtgtgaaagctcctaagattggagaattacagcttcagctggaaggaaaaagttgggtgacaaatgacaccctgtcagacaccttccaatgtgaaagtggaagcacattccttttgctgctggtgatagtgcctcaaatttacattttgtgttaatatgacttcatttacataatgacttaatataaagaatctcttagatgttgtctaattgtcctctttctcttgctaaccccaagtctgagaaagtcaacataatgacctttttttttttttttggtatgaggcaaagaaatctgatttgatattttgctgtgtcaacctcattttaagatcacaacttacatcaaggaaacagtataacaagaacactgaagatacctggaatctgccatcttccttttcttagccacaaaaaaagctactttgtatattccctcttgtatttgcccacatgcatatatatttttctggtagacataatgtacatactctctatcaccagtttttccattgatattacataattgtcagggtttttgcttcccagagtatttttaattctagtctttcataaatgcctaatattctataggatagactttggaaaatagttatgcttcagtttttaaatagtttaggcaacattgtaatgacaatatttgtgtataaagattatttcttctgttagatgttttccctaagagcttcagtaactcttaagaatttcttttttcctcccattcatgtacttcaaataaccatttcagcacaaatttttaattcattttactttcttcatatagcaaccttactaatgcatcagtccaaaaatcttctttatatagtatgctgtaatacaatcccaagagtccctcccatcaatataactgtgatgtgtaggaatgcagcagcccaggctatggaaatatttggcagattataatggccataaaaagtcttttcaccctaaaggtttgaagcccctctctattgtttcctagctttattttctttgagtttgtatctttcatcaccataattcatcataactcattctatacttagtattcctttaaataattttcttgtttcagtgatgttatttaccacttgattaatacccctccatccttcttaatgtttgaaattattgtgtatttgtacccgcctcctgcttcttggtgattctttgacatttctttatatcaataagttggttcctaaggtcactgaaagctctttttttttttttgctgcagcatacacttaaaatatgacccagcaatttcactcctgggtatttacattagagaaatattcatgcaaaacaggtacctgaatgtttataacagttctattcatattcatcaaaaaactatttagaaacaacccaaatggccttcagtgggtgaatgtatagcactgcggtatgtccatacagtggaatactatgcagcaacaaaaaaggagctattgatacacaaaacaaattggatgaatctcaaaggattgatgtggaattagataagtcagtcatactctatgattctacttatatgacagtcttgaaaagagaaaactatagtgatgaagaatagatcagtggttgccaggtgttagggattgggggagggcgtgactacagagggatagtatgagtctagggtagtggtatcactgttctgtgtcttaattgttgtgatggtaacacaaatctatgtatgtgtaaacattcatagaaatgtgcaccagaaggtcatttttattgtaaatttaaaaaatataaaaagatccaagtttccaaccaggtgcagtgactcatgcccgtaatcccaacactttggaaagccaaggtgggtggattgcttgagccttggagtttgagaccatcctgggtgacatggctaaaccctgtctctaccaaaaacaatataaaaattagctgggtgtggtggcacgtgcctgtagtgccagctacttgggaggctgaggtgggaggatcgcttgaactgaggaggtagagattgcagtgagctatggtcacaccactgtacttccagcctaggcaacaagagcaaaaccctgtctcaaaaactaaaaattaaaattaaaaaaaatcttagtttcatcaaagtggtcatatgtcctttggcaagtgatataacctttctaaatctcaatttatttttcctataaaatgtggaaaatactctctaccttggagaggcattctaaagatgaaataagatgttataaacgatctccctgacatactagatgctcctctttctcttttccatggcagctatttctcactgagagcagtttattttttattattatcatcaccatgcttttttacagctatttggctcttaggtaacagcctggagccactgagggtttcaagcaggaaagtgacatgatctgatcttcatttttaaaagacaatttgagcagctttgtggagagtggtaaggaatgcaggagggtaagaattgaaacaaagaagccagtaagaagtgttggggttgtccaggtgagagatgacggtatagactccagtgggagccatggagtggggagaggagaagcggggggtttattttgggagaaggtagaacaaagaagcttgatgctggttgaggggtgaggaaagatagatggtgatgtcatttactgagatgagaactcaagggaggagcaaacttgagtgggtgggttgtggtcagcattacaagtcaagaattctgtctgagcatgttgggattggaaaccaagtaagcagttagaccaaggaacaggccagtgttatcttgttcattactaggactgcagcacacagcagcgggggcttcctcatcagcccttccaaataaggctgggggaactttgagctgctcctccttagactcactcagccttgacgatttttaaaaaatttatctctttaatccattcctgagagggattgtagaaccttctaccagaatttagagtatgctattattctaagtgaagtaactcaggaatggaaaaccaaacattgtatgttctcactcataagtgggagcaaagctatgaggatgcaaaggcataagaatagcaccatggactttggggactcagcgggaaagggtgggaaggggtgagggataaaagactatacattgggttcagcgtacactgtttgggtgatgggtgcaccaaaatctcacaaatcaccactaaagaacttactcacgtaaccaaataccacctgttccccaaaagcctatggaaataaaacattttaaagaaaaaaaggactcagattatgctcatattagtcactgctgccagatttttttcttttccatttaatgagatttaaggaaaggaggcatgtagcattttcaaatacccagcctgaaagtcatcaatcgtattatgtaggattgaaaagtattaataaactactgagaatgatgacaaatgtatgacacagaatatgctaagagattatattccaacgtattttattatttctgttatcttcaaatttctagttttgctacagacaatgaaagaaattccatacatacttttccttgataactaccaagtccaatttgataactaccaaatagctatttcctttgggaaggcaggaacgggcatgggatttgggaaggggtattgaagaagcccccattgtatctataaaaagttaaaatttcatagagctggatatagggtcagtgtgttcatcagtcatctgcgtttaaaaatattttataatttaaaaatgaaaaaatgtgttgttaacatataaataaaaataattttaaaatctgaacataaaagacaatgccctccttccactcactccaccctcattaatcaccttaaagagtgatctcttgggtttttctctcagaaaaatgtaattactttgtaatgaaatgttaatgttatgttctattcttaaagttacttgttacagtgatgaagctatgacttaatagagttgctaagttttcttctaagtcattcttcttttaatattttatatttatcaagtgagctggtgatgatccagaacttttttgttgttttcacaaatataggactatctcagcaaaaactcatcatcaggctgttaacttcaacattttcgagggcatggtttgccacggggtgccccttgtgactatttcaagaggcaaagtggtatatgaagccggagtgttcagtgtcacggcaggagatgggaagtttattcctcgaaaaccatttgctgaatatatttacaaacgaataaagcagcgagaccgggtgagtgtgccacagtgggatactgccacaagtcggactgtctcctgcttctggatgtctggctggttattgttggtagtagtggtgttgacacatcacacttggtttaatgtattcctggggtgtcaggattgatatgagagattagagatgccagtttttagataaaggatcattattggatgcacgcatttccccttgcagactgataggtcagttcgggatttccagattgtggggtaatctggtgggggcttttggcaattgtgttagtcagggtcctccaagaggcagacaccaagatggataaaggtgtatgagttttattaggggaaacacctgtgaaagaaactaggaggtggctggaaaagattgggagagccctcagattgcaagttaagtctgaaaccagtaaagaaaagaaagagataaaatgggtaggagcatcctggaacaccctacagtctaggggaggctgaaaaaggccgtcagggagtccttgagccaagtctcagatctcccagctacaggccaggcccagtcattggctgagagccactgtgggaggtgtgacctctgtgtaaaagtgtaatgaagttcagaggtcagcagcagccccttgaaaaaatgtgctcccattagttgaagatctgcaaggtcagtttttatgaccaccagagcaatggtggagttttgggctggagaagacctaaattctctcttgccctcgccaccatttcctagctgtgttgccttgagcaagtttctcgatcctccttgggctcaattccctcatctggaaaatgacaacaatgtttccttcctaacaaattgtgacactcaaatgggtttttttttaaatgaaaggcatggcccaaagcagtagctcaccacacctgtaatcccagccctttgagaggcagaggtgggagaatcacttgaggccaggagtttgagaacagcctggacaacagagtgagaccccatctctacaaaaaatttaaaaataaaaaataattagccagccataccagtgcactccagcctgggcaacaggttggtaggaggtcaataaatgtcacttttgtctctttgctttccccttttgatgaccaaatctctatcaaagacccctgttattataaaagagatattggggctttcacacaagttttgtttagttcacacagagtttgaaatagttttaaaattttactacaccaaatacactaaaatatttgagaattttagatttaaaaaatctaaatttctggatatgggggccggggaggcaaccctgtgtcctcaatcccacatgggtccaatgggccagagctagatggcaggcccctagctaggaggtatttctggttttcacccagaaggcttcacacattacttgcctggccatgtagatggtagtgtttgccacccttggactagttctaaggcttctccctcttctttccatttttcaaatgtacctctccttttccagagctctctggctgtttttttgattcaattcatttggatcttgtagaggctttggtttctcctttaatgtcttatgaaaaatttttacttgtggattctcagagtccattatgcaagatttatccatttttaaacacttcctaaggctttgattaggtaaacaagttttctcacgtgctttaaattctcagaaaactgcagttctttatatgctgtatttatatgctcagtcaaaataggtggtttaaggttacagttaatatttctggggagttagtttataaatgttaacattaatgggtgacaagtaggtggtaactataagaatcctaggatcctcggtgtttctgaagatgtatgtgataaataacagcagcactaacatttagtgagtgcttactgaatgcaagacacactgctaaggtctctgtcactataataaccctgggagggagggaggtatttttttcacttaaaattagagaactggccaggtgtggtggttcacacctgtaatcctagcagtttgggaggctgaggcaaacagattgcctgagctcagtagttcaagaccagcctgggcaacatggcaaaaccccatctctactaaaaatgcaaaaaattagttgggcgtggcagcgcacccctgtagtcccagctacttaggaggctgaggcacgagaatagcttgaacctgggaggtggaggttgcagtgagccaagatcacaccactgcactccagcctgggcgacagagtgagactctgtcttaaaaaaaaaaaaaaaagttaaagagaactgaagcttcaagaaattaagaaatttgtccaagtcacacaagcaagtgtatggcagagccaggacataaaccctgcttatatgattccaaaaactttatccttaagtaataatagatgctgtaaattataaacattgagttaaatgaagtaatgaaggataagttactcagcgtttgttttgtaaagtctctcaaggaaaaaattaagttggaggcactgatggcagctgctgcattcatgagactgtagcagtaatctaggagatgaacatagagggtggatttaggatattataaagtagtaaaatcaatagaactggatgatagattatgtgacgcctgaagtggatccaaggtagggccaatcttggcatcagttccagttgcttccagaaggggcgctagactaacagggaaccctgatagaccatatttaaatgcttggctttgccttagtcttcttgtagagaaaacgttttgaggcagcagagatcatcaaatcactggtttcatcagttctcctttgcaaattgttttgtgatttttttggcagaattaatgccaactgaaatttttatgagttcactatcaattctgtgaattattttagtttcttagtatttttttctggtatcaaatttttaggcattttagtgcatcattgttttaaaaataccaataaatgatagttatcatgtgctgttttgagcactatctgccaagctctgtactaagtggtttatattcattattttacttaatccataaagcaagccaagtggtaggtattattgttcccattttacagaatagaaagctgagtctcagtaggattaagtaactttccctaggttaagcattaagtaaacctaagagccaggatttgtgataaggtctttttgattcccactgtaccactggacctctgtagagacaaaaaaaaaaaaataaaaggaagaaaatagtcatgaaacccaaatcatggagaaatgccttattcaaaaaatgttggtgtggaaaagatattaaataaaatggataaaatgaaatgaggtttgggaactgtctggagatggttccctatggcattaggcaaagacaacttacaggataaaaatatcacatgaaggttaagaaaaagaatcataaaaactctagatttttaaattcacatgaggttatcaaagtccttgctttggttttcatttcaaatattcagatttctttgtgagtggggataagagtttgagggcaagcaggaatagcaaatgctatttctttgcttatctgttgtccctaccaagaaaattaatcacttcctattctggactcccaaagcacagagtacagagtcacatcagcatttgtcagtccctgaactcagctggtctcctggctagagttagttccttcagagcagcatcttattcttttttgccagtacttggtacataggtggcatctggtaaatgaataaactgcacacagaaggagcaaaagctatagtttcagagatgcgtagaaggaaatttaactaaatttacccagcagattacccctgccttatttcaaatagtgggattatcttgtgagagcttgatttttatctatgattttattgcataataataaaatttgtcaacaccataccatgcagctattactgttactggatcttttgggaaatttcaaaggaaagagaagacgtttttatctgatttgacagctttggagaattgttaatttatgtattttaaaatgtagacagctgatcctaagggaaaatattgaatcagaagataagccatcaaactttatttgataaatataacataatagaatatatttcaacttcaacttcatataaaagttgtttaaggaaagaaaagcaaaagaaaagagggaggggaaaaatgtaagagcaacttggatgttcaagagaatcctgactgagcaaaactacatattattaattgtttacaaaaaatatatagctctttaagttaaaatggattacgtttcttgaatttttgtgtgtttagagtgttataagttccaacaaaatgtgaaagtacagacatttgttaagtcatctgtttttctctttttttttcagtaatagggaaccccaaccttttctggaaaatcaggatcacattgcattttatagagaaacaggaatagcttcatggagtgatgtatggtttcagaatactgctgccaaagcttttaaactgggttgtatctttgcaatgataagcataatttgccttgtagataagataaaattgagtggatggctgctttggtccttgagatgggtattctccatttctgaaataaccatttgtcaatgtctttctcaaggtggtagctcagagaaaataatttaagacatatcacttgccatataatcctaatttcttcaggttaatcactaccaatacaaggtaatacacatgctggagttggctcattttggctcacaagagacatatgtacgcatctgtgcccaactcttcattcagtggtgtcagtttggtagcttgaaaacagccagagaaggagtatttacaccacagaaataggcaggtgctttaagttagggctttaaggatggtgaggaaaaaggaaggtagagatagttgttaatatttaccaacacatcactacacacaggacactttctaagtactctttttcatgctttatctaatcaatcaacatccgttcagtaaatatttattgatcaccagttatgttccaagcacactttaattctttcaacaacccttggaggtaagtagtgatattcctatttcatatattaagaaatagaggctcagggagctcacatagttaccaagtggcagtgttgggactcaaacccaggtttgtctacctccaaagccaatccctttaacttgtatcactgcagtatcctaaccataaactttaatccctactcaaacaaatagccacccattcccccatccttatgatatcgctccctcagtctcccctctgcacagagggttcacttcctctcggactggcaaatttaccagaggagccagccctgaaatgagacagcccagctttgtagctcacagcattttgtttgtttgtttgtttatttatttatttattgcttcaaaatctttccctctcccactccagccaggatattttaaggattaaattgagatatttggtaaattgtaaacatcatcaaaatgccaatcttcattgttatagatcacctctgttgcacctagggctttctcatgtacaagtgattcacagagccctgggtagctcagttcaatgtgtgctgagtgccctctacattcaccaggccaggcgtggatttcattctcagggagtcactgttcatttggtctgcttgctgttgacccagcatctgctgtttggtatttggaagttctgttgtctttattgatattttagtatcttagcctccatgaacagcattcaatcattaatacctttgggattcttctctgttgatcttgctaatttcagaaaatctagcatccagccaggcgtggtggctcacacctgtaatcccagcactttgggatgctgaagcgggtggatcacctgaggtcaggagttcaagactagcctggccaacatggtgaaaccccctttctactaaaaatgcaaaaattagccgtgagtggtagtgcatgtctataatcccagtttcttgggaggctaaggcagaagaatcatttgaactcagaaggcggaggttgcagtgagctgagatcgtaccactgtactctagcctgagcagcagagtgaggctctgtctcaaaaaaataaataaataaataaaaagaaaaaaaaaaagaaaatctagcatcccagcacattccatcctcagcagtcaatatgattaaattttctttttcttttctttttttttttttaagagtctcactcagttgcccagactagagtgcagtgggatgatcttggctcactgcaacctccacctcctgggttcaagcaattctcctgcctcagcctcccaagtagctgggactacaggcgtaggccaccacacctggataatttttgtatttttagtagagacggggtttcaccatgttgaccaggctggtcttgaactcctgacctcaagtgatcagcctccctcagcctcccaaagtgcttggattataggtgtgagccaccatgcccagcccaatatgattaaatttactatcaacttatgtcttcctttttccttggtcatgtaaccaaaaggcatttctgcagttatgaaagtgtaatgataattggaattaatgtttatttatagaaccacaaattatataattttcatttctgtctctctattaatttgtcacaatgacaagtatcatcaaatactgagaactcaagttcaattctcatttaccaaagtaaaccaccgatgtcctgctaggtgaggtgccacctatgtcttttgtattacttattttttgtgcttgctgctataacagaatatctgaggctggttaatttataatgaacagacatttattggctgacatttcaggatgctatgaagtccaagaacgaggcgctggcatctagagagggccttcttgctgtgtcatcccatggaggaaggcatcacatggcagaagggcaaagagagaagaagggagagagccaaaggggccaaacttgtcattttataaggaatgcactcctaagataacagcattaatccattcataaaggcagagccctcatggcctaaccatctctcaaaagtctcacctcttaatactgttacaatggcaattaaattttaacatgagtttgagaggggacaaacattcaaaccacagcaacagcctctcatgtggttttaccctcaagccattttatttgattgtgataccatcaagatggaaagaattgctgtcaaggtgtgatcatctaatcttgaccagcatgtactggggggaaaaaataccataatcaaattagccttccaacagtgtgttctcaggacttgagtctcttgaagtattccttgagaaagttgtcaaataattttagatgatgttaccctcaggtgatacaattgcccaatatcataaaaagtttcaagaagtcctatagtcaagaaatctcccttcatttaataaatgtttgtagatcaccaggcaccattctagatgctgaggatataggcattaataagacagccagtctgatcacaaagagcttatattctacttgtttcaaactgtggttcatggtgcttaagttatagttgtgtttgagcaattttacacctctttgtgctgtagctaatgagcacaaaggagataaaggagtctggagatcaagagacatcaaagctggagataaaatttgggagccataacatatagatttaaaaccgtgagtcttaaggtcaccaaggaaactatattagagaagaaagggggcttaagatagagctctgggcccaccaaccttcagaggtggaggagaagagcaagcatcagtggagtctgagaaggctgaccagtgatgcaggaagaccatcaggagaacatggagtcccagaaggcgagaaaagaaacctgctgtctttgttcaatccagagtactctgtttcctcatcctggtttttctatgtgttttatgctgcataaatgtcctgtaagaattaggtatgcttttagccaggagaatagggatggagtctttattatcaccatattcatctgggatgccagagaaagaggctcactttattttgaccctgactgctagtgtcaactacatgcattaagcaatggctctgccatatgctggggtctgtgtcaggctgggcagttcctacttcggacagaggtttgccatcatcattagagagaaggaataagacaaggattgctaagagttggaggttaagtctacttagaaaacaaatgtgcagctgaacttctgaataacagcagtgatggtttcagattctgcagaaggagtgccatcacttttccattttgtcacagtgaacatctagtgatgtcctaaaacatgcccagagaacaatgccagaagtgacagacagcacaaagatgaagaaggcatgagtctagccatcatagagcttatgtaacccaattctaaggatgagcaaatattaaaaggttaaaagggctgagaggcttgagagtagaacttaagttgtctttgatttctgtcaacttatctatcaaaaggaaagactgtggagagtgagacagcacaggactcctgacaggaggctgcttgtttctgaggtggccgtgcacgcaggtgtggctcccatccatggccattctgagaggaaagcagacctggcccacccagagcctcagaggcaggcaagagagagagagggtgcaggttagacccagccagtcgggtcagagacatgtgatggtcagcgtgaccagggtgacaagccagacatggctggctccatgactgaacagccagaaagcagtttgtagacagccagccacagaaaaagtacagcccaggccaggctcagtggctcacgcctgtaatcccagcactttgggaaactgaggcaggtggatgacttgaggtcaggagttcaagaccagcctggccaagatggcgaaatcccgtctctactaaaaatacaaaaattagctggccatggtggtgtgtgcctgtaattccagctacttgggcggctgagatatgagaatcgtgtgcacataggaggtggagtttgcagtgagccaacattgtgccactgtgctccagcttgggtgatggagtgaaactctgtctcgaaaaaaaaaaaaaagtacagcctggagaacagataaatgatgcagcacaacaaaagagcctgacagaaacggagtcagcccacgccaggccaaaccacaaaaagaagaaagcaggcttagatgggaagcccccttcatagctccctccccaaaaatcccttctacccatatctattgagtgcttgttatgaagaaagagagcagcacaccggccctctgtctgctgggggagactgacgagtgaacagattattccagaaacctggggtaagcaagatagtggataggggacagagggccaaagcttcctagactgatgattagctgagctgagtgataaaagagaagtcagataattacacaaaaatgaaagcggcagcccagcccatgcaaaagcatggccctgaccggaagctaccaggaaggattctgatgtgcctggcctgggtggtgcctgctcccagagcctgcaagctgggttctggggaagcatcctctaggtgatagagcaggctgtagagcaagccctgttctgagtgaggaggacaggccctgtgtgtgatggccccacctgagccactggcatgggcagtcagttcccaagacggagtccaggacagacaaaaaatgaacagctgaaaagtgcaagtagtgtaggttcaaggaagtggtgtaggaagagggagacggaatgggatctgaggagggctgcacagcacacagtaggcggcacaaaagtctgctcagttaggtcacatgctccagaggcactcactgcaaaagagcctgaagattgaactgaaatataccatcggctttgctgagtatgaatgccaagaggagcagagagaagtcaagccctctaggtgataggcaggaacgagctgaaagaaggacataaatcttggtttgctcagacgggcctggattatacttacgttaattatgtttagtgcccttttcatgctaagaagtgtcctactttggatgataaattgtacagtcaccctaggtttaagtgatattcaggcagtctggcttggaaagtcaagtcaggagaagaaaaaaaaaaaaaaaaaacagggaccaaggacctgaaagggaggatgtggccagagagtggggtattagtgagtttaaggtttcagatgtggtggtccaaggtggtagaaatgggaggctggcccttcatttcctggtgtctgtgttcctcaagatgagaacagggctcaaagactgagtagacagtgagccaaaatggaagtccagcaaagcatttagacagatacagaaagtgagcagaggcttggcctggtgagggaagggcaggagtccccccatttcctgagcactcagtgcacacccgatgcagtgcttcaagttctgtggctgcaggagctgtgggccttgttctgtgttggatcctcggtgtttggtgtactctctggggctgtgtgagctcagtaaatatctgctgaatgaatgaagaaaatgctttggctctggaaattctccactatctgagagataggtttatttcccccatttcatggatgaggaagtaggcctggaggcattaattaacttgtcagtttcctatgcgtagtaaatggcaaatggagaattctaacttagatctgtctcacttcaaaggtcacactgttgatcactacaatgtattagtttgggtggtcaaaatgagacccacaataatttgttatttgtctgtgtgtatgtgtgtgtgtgtgtgtgtgtgtgtgtgtgtgatttcaaaactctgctcaagcactgacagctctcgctgaatccagcagagggttctgctgcatagtcggtcaccaacgaggtgagattctgtggaagatccataatgcacagagacaggaaagtggaaagcgtacccaattgctagaatctgaagcaactgctctgagagtgttaggagaggtacaaagaagcactgcaaactcaggtgagtaggactgaaactagaagaaaaggtcggatgttggaaaggacagcaggagacagttgtgggactcagaagggcgtgaggatatggcagaggccccagtgagtgtccctgggcctctgtctgaggcagattaatacccacaaaaagtgggacaatccagattctcaaggttgccaggaatttccgtgaaaggccaaggggatggggaggcacgtgataaatttataagattctttttttaaagctctcgcaattcataaagggagctacacttaactttgaactcaagaaaataaaccacaagagagaaatgaaatgttctctttcagacttgcacacctacccctgtggagcgtgcaccctataagggagaagtcgccacactgaaatccagagtgacaaaagaagatgccacagcagggaccaggaaacaggcccacccctgaagtgtgtgccatcggtaagggactgtaggcaagaaaagtcttcctgcatgacagcatatgaaattagcatctctcctcataagggttgaagagatcaaggtcagaggcttcacagtgatccaagactcaaggacaattgagccaagggaagattgatcaaagcagaacatttagataagccttccagattgtagaaggccttgggcttgctagagagtcattctttaagatgttaggaaacattcaatacagccttggataatcaactatgagcaagttgcactaaggaggctgataacatacagagggaactacttaagacagggagtataatttcatggtcaaaatttacaaatgaattaggaccttatctggagaaatgaatcttcatattgtaaatacaacggtgttctaaaatttagaataaatgaaaaatgaataaaatgttgctttaggggatataatccttcagaaaaattctttgatagtatctgattatttcacagttagttttgggaataatattacagatacagtcatttttgcaaaagtatttgagcacttcatcagttttctctgtcttttgacatgcagatctttcttttctgaagtgcctcgtatcatcatccttgtcaattttctttcttcagttgtcttctggtcctgctctctcagatcctcatttaacagcggctttgctgtaattttagcatctccctaatatcacttccactgacttcatgaaatctacatgttttgccagttttgcaattttgctaggctcttaatttttttttaacgtgtgatatcttttcagacagttcaacacgtggccatctgcacaagacttaaccccagaggttgacctaatggacctggttagacatttgtgttaatgagaggcacagtttgacaacggtctggttttctacatattcaggcactgcaccttttcacattttgacaacctcttattccctgcataaatcctgttcctgcagggatttggataatgagggcttgaatggcaaagccctctgtgctacatgccatgttctttcattattgaatgttgtgtctttaacaggactatctagcccaaagtctcaacatttttgtcattttcagacgaccagaattattcttctaatctaggatgattttgttaaaaattcagggaaagattagcaagagaaaggaatgcgattcaatgctataacatgctattaatgacatttataggagcaggattagtgtttactttgattatagcatttcttgggggttaggtttgaattctgcatctctttgtgagggagaatgttacagtgagttcctttcattctcttcaaaggtaaaaaaatcagaggaaaggaggctgccattcccttcacagccaaacattgtcaacccatggagaagcaggccttattcaactccctaggatcctttagaaaaaattcaccactataggcttctttgattttctttcagaagcaattgctgtctttctcactgtgtttttgttgctgcataagattgaaggtataaatttatattattgtgatggaaaggctgtgtggaaattcattgatgatactttaaaatgtcatctttgcttgtactagatttcttacttagaatttttaaaaatcattttcttgtttaaatagtttctttttttaaaaaaatggttacattagttttaaaatagctctgtgattttactttttattgtaattaataaacattgagatcttcattttatacctt

SEQ ID NO: 36830 - DNA, 41728 bp, Homo sapiens
gtgcggagtttggctgctccggggttagcaggtgagcctgcgatgcgcgggaagacgttccgctttgaaatgcagcgggatttggtgagtttcccgctgtctccagcggtgcgggtgaagctggtgtctgcggggttccagactgctgaggaactcctagaggtgaaaccctccgagcttagcaaaggtaacgactcctgatggcaagctgaggcacaccggccgccgtcagcgccgcctcagtcttcgttctctcgcctcggccttcagcccagtctccgttagattctgcttcctcccacgtccatgtttacagcgtgaaagagctcctcgactccacttacaagttgtctgaatggttaggagaactgtggtcgtgaaaacatttactaattgcttttcctctggcaatgcctgctgaatgctttgaggattgtctcatttaaccctcaacccgcttacgtagattattatattcagtatatggatgagagaactgatatcttggggagcttaggtaacttttcatgctaactgggttaggaaatactggagtcagaattggttgtctaatttttgctgttccaagatccaaggggtaagggttaaatttcagaaatgcaggattttgtgtaggactagagacactaagaatgagaaagagagtagaatccccggaatcttgaggaagcatagaaagaatattctcttacgtaattaactgaaacacccaaaacctcatattccagagcattgcagatgggaaccactgcatcctgagacatacaaatatgaggctggcggtggtcacttgttgtgcacatctctctatgacatgtctggacctgtgctattcactgaagaagatggaacagaattttaagttactgcccttactgatggaaaatacagaggtttcaattcgcctctaaagaataagtctcgtggacccagccttaactgtttaagtcataccgcgcgcagactgtgtcccccaagatttgatgggctcttttttcttcaacaagttggcttttcaaagaagaaatgtgagaccctgaataataatgatcactaacaactattgactactttagatggtcttgatattctaccaagctttttacatgtatcgtctcattcccattttatagacgaaaaaaatctgagcaaaaaagaaaaagtgaagtaacttgcccaaagtcatgcagtaagtggtgccaggatttacaaacccaggcaatctaattccagcattcaggctcttgataggattttcatttcctaaatgctgtcatcaccattgtcttttattagccccatatttatggctcatattcttatcagatcaagcactgatatatcaaactgataagtgatgtcatcctcaccattatttcttcaccagcttgttttgtaattgccattttcttttctcaggccacactgtcagatgggtgaaattgtgtagtcgaggaagcataaatgtattctttaaaatgcttgtgccttgaataattgttctcattagtttggagtgatacatgaattttttacatcagttatttccatgaaaagtttttattataaataatacatgcatatgtgcttcttaaagttgtaccttgttttaggcagttaaaacatctattttcattctcatctgaaaaataatttgtataccttatgagagcgagataattatggcttcataagaccaaaagggatagtaaaaatatggtaatagtgagtacatttttatttctgcttcctgagacacttgtaggtactcagaaatgctttagttgaattgtttctgaggtaataggtaattctttatgtgatgactaagaaaacgaatacctttattaagctgaatttttttttttttttttttgagacggagtctcgcactgtcatccaggctggaatgcagtggtgcgatccaggctggagtgcagtggtgcaggttcaagtgattgtcctgcctcagcctcccaagtagctggaattataacgcgtgccaccatgcccggctaatttttgtatttttagtagagacggagtttcaccatgttggccaggctggtcttcaactcctgacctcaggtgatctggctgcctcagcctcccaaagtactgggattttaggcatgagccactgtgtccggccaaactgaaaaattaaatggttgatagaatgttgcatttttatgtttctccactcctagcatcactgttgtctacaaattaataaagacaatcgattatcatgttacacttttaaatctctaaaattagggttctttttttcttattttactttcagaagttgggatatctaaagcagaagccttagaaactctgcaaattatcagaagagaatgtctcacaaataaaccaagatatgctggtacatctgagtcacacaagaagtgtacagcactggaacttcttgagcaggagcatacccagggcttcataatcaccttctgttcagcactagatgatattcttgggggtggagtgcccttaatgaaaacaacagaaatttgtggtgcaccaggtgttggaaaaacacaattatggtaaaataaagtgttctccttttaagggtgggtttaataacatattatgaaagtagtattttgtactatcgtcaggaaaccaaataagatatatatgtgctcttaattttaagtgtgtatgtgcattaaacaaaaattagcttactatttgtgttacttcattatcccttcttgataaatgtatgcaattattctgatgtgaaaaagtgtttcttttgcaaattgtactgcagtcataaggttaaacaggaagtttctgcgttattcattcctgagactatatttgaaagtcagatgtttgaaagtagatttatggctaggggtagtggctcatgcctataatcccagcactttgggaggccgaggcaggaggattgcttgagcccaggagtttgaggcctgcctgggcaacatagtgagacctcgtctctactaaaaatggaaaattagctgagtgtggtggcacatgcctgtggtcctagctacttgggaggctgaggcaggaggatagcttgagccggggaggtcaaaactgcagtgagccttaatcacatcactgggcagcagagtgagaccctatctcaaaaaaaaaagaggccggggatggtggctcacacctgtaatcccagcactttgggaggctgaggcgggtggatcacctgagatcaggagttcaagaccagcctagtcaacatggcgaaaccccatctctactaaaaataaaaaaattagccaggcatggtggttcacgcctatagtctcagctcctcgggaggctgaggcaggagaatcgcttgtacttgggaggtggaggttgcagtgagccgagatcatgccactgcactccagcttgggtgacagagcaagactctgtctcaaaagaaaaaaaaaaaaggtagatttatgtataataaggggctccattttgagaggcctggaaatgattaaaatattcttaattggctgggcgcagtggctgacgcttgtaatcccagcactttgggaggccaaggcaggcagatcatgaggtcaggagatcgagaccatcctggctaacacggtgaaaccccgtttctactaaaaaatacaaagaattagccgggcgtggtggcgggtgcttgtagtcctagctactcgggcagctgaggcaggagaatggcgtaaacctgggaggcggagcttgcagtgagcctggatcacgtcactgcactccagcctgggcgacagagcgagactccgtctcaaaacataaataaaataaaataaaatatccttaatcttggttttataggcatgccctccccgaatccagttgatttacatatagtcgattggttcacattatatctggagtcatgaagagttagacatttctgttgccttggggagtatatttacatttataaaactttagtgatacctaacttgtcattatctggagttcaaaaacactaccttagatcatcatcatgatttggttgtttgtcatctttctgttgacagtatgcagttggcagtagatgtgcagataccagaatgttttggaggagtggcaggtgaagcagtttttattgatacagagggaagttttatggttgatagagtggtagaccttgctactgcctgcattcagcaccttcagcttatagcagaaaaacacaagggagagggtaagttagtaaatgatcttctttttttctgtattaataaaagtaatttgcatttgtgcccatctgagacctcagcaacactccatttggaatgtgaagcctaattactggacagttaactagtgttaaactcttttactactgttacaaaatgagaaatgccacagcctggactggcttttttttgttccccttttatggccctcacttcttcctgtaggagctttgggacaaaacctatgtatgtatttcagtcatcatactccatcttatcaggtgtaagttaacggtgccggacaccttaatataagcaactgttgttaaatgctttccaatgtataaggacttccatattggttttccaaaaaccaaaggtagctttgaaaaccacgtctgaggccggatgcagtgctcatgcctgtaatcccagccctttgggaggccaaggcgggtggatcacgaggtcaggagttcaagaccagcctggccaacatgatgaaaccctatctgtactaaaaataccaaaattagccaggtgtgatggcacatgcctgtaatctcagctactaaggaggctgaggcaggagaatcacttgaactcaggagttggagattgcagtgagcccagattacgccactgcactccagcctaggcaacagagtgagactactctgtctcttaaaaaaaaaaaaaaaaaccaaaaaaaaaaaccacgtctgaaatgtttggattgttaagcagattgacttgggggctttgattatatagctgatttcataactgcactaattgttaaagtgtttgggaggtgttgttttggtgcttgttatgtgaaaataaagtgactgtaaaacgatttttttttttttgagacaaagtttcgcttttgctgcccaggctggagtgcagtggcacaatcttggctcactgcaacttccacctcctgggttcaagggattctcctgcctcagcctcccgagtagctggaattacaggcatgtgccaccacgcccagttaattttgtatttttagtacagacagggtttctccatgttgatcaggctggtctcaaactcctgacctcaggtgatcctcccgcctcagcctcccaaagtgctgggattacgggcgtgagccaccgcacccggccaatttttttttcttttttgagacagagtcttgctctgtggcccaggctagagtacagtggcgcgatctcggctcactgcagcctctgcctcccaggttcaagcaattctcctgccttagcctcctgagtagctggaattataggcatgtgttaccatgcccagctaattttttttttttttttttttttgagacagggtctcactctgtcgcccaggctagagtgtaatggcacaatctcggctcactgcaagctctgcctcctgggttcatgccattctcctgcctcagcctcccaagtagctgggactacaggcacccaccaccatgcccagctaattttttttgtatttttagtagagacagggtttcactatgttagccaggatggtctcgatctcctgacctcatgatctgcctgccttggcctcccaaagtgctgggattacaggcatgagccaccgcacccggccacacccagctaatttttgtattttttgtagagagggggtttcaccatataggcaagtcaggtcttgaactcctgacctcaggtgatctgcccacctcggcctcccaaagtgctgggattataggcgtgagccaccacgcccagccttaaacagttttttgaaagataatttataggccgggtgcagtgtctcattcctgtaaacccagcactttgggaggccgaggcgggcggatcacctgaagtcaggagccatggcgaaaccccgtctgtactaaaaatacaaaaaattagccgagcatggtggcaggtacctgtaatcccagctactcaggaggatgaggcaggagaatcgcttgaacccaggaggcggaggttgcagtgagccgagatcgtgccactgcactccattctgggcgacaaaagtgaaactccttctcaaaaaaaaaaaaggaaatttatattcaagttcttattctttcaattacttataaattaaatggcttatgggttgactgttttcttatttatttatttattttaagatggagttgcgctctgtcacccaggctggagtgcagtggcatgatctcagctcactgcaacctctgcctgctgggttcaagcaattctcctgcctcagcctcctgagtagctgggactacgggcatgtgccacaatgcccggctaattttttgtttttttagcagagatggagtttcaccatgctggccaggctggtctcgaactcctgaccttgtgatcttcccgcctcggcctcccaaagtgctgggattacaggcatgagctacagcgcccggcctattgttttctttttctttgttttatttattttttggatgtgcggtctttattctttccaataaaagttttaaaaaaaatgcttttcataagatttcctttaaatgagtatatttcctttaaatgagtgtagtcagctggatttttttttttcatggaggtactaagtgtcccatttcgctgatgaccagcatggttactgaaagccctttggaccctagcagaatatgccaccctgaaatatgccactttggcataaggattattttgagctgaaggcaattgaaaagaaacagataaatctgtctgcccttcctaaaaacaggacataaatgcacagaagagttccatcttccctctcttacaggaagacaaaagttaatcaccacagacaactttagaccattatcagcgtacataacaaattttactagctatcttttatctccagttagtttcaatatttgctgcctttagagacttagggtccttttcctttgtcttgttacttctctaaaaatttactgtaccttcgggacgataagctcaaatcttttttttttgagacagaatctggctctaccgcccgggctggagtgcagtggcgcaatcttggcttactgcgaccttcacctcccaggttcaagcgattctcctgactcagcctcctgagtagctgggagctgcgaatacaggcacgtgccaccatacctggctaatttttgtatttttagtagagacagagtttcatcatgttggccagactggtctcaaacttctgacctcaagtgatcctcctacgtcggcttccctaagtgctgggattatgagtgtgaacacctgtgcccagctccaaatctaaccaaacttttgagttactaatctctggactcccctgtgttgttacatgcactatgcacaattaataaactctttctcttgttaatccatcttttgtcagtccgatttacagggctccagccaagaaacctaagagggtggcaggaaaaggagtttttcttcccttataccttaaagctacctatttcacaatgtgtgtttgtaatagtgtcttaaaaccttactgtaactagagtaggtgtagcactaggatataaagtttttatttttattttaattaattaatttattttttaagatggggtctcagtccatcatccaggctggagtgcagtggcgcgatctgggctcactgcaagctctgcctcctgggttcacgccattctcctgcctcagcctcccaagtagctgggactacaggcacccgccaccacgcctggctgactttgtatttttagtagagatggggtttcaccatgttagccaggatggtctcgatctcctgacctcatgatctgcccacctcagcctcccaaagcgctgggattacaggcgtgagccaccacacctggcctaaagtttttaaatgattgatatgagattaaattgtcattgttttggtgaaaatttgactctgctaagtgtctatttgcaataggaaatgttttctattttaaaatatagcttcttgttttttcagtgttaatatttaagtacattttatttatttttaatattttactttttgtgaaacagggtctcactttgtcatccaggccggattgcagtggcatgatcacaattcactgcagccttgacctccctgggctcaggtgatcctctcacttcagccccccaagtagctggggctacaggtgggcactaccatgcccagctaattttttttgcattttttgtagagacggagtttcaccatgttgcccaggctggtcttgaactcacgggctcaagagatctgcgtgccttggcctcctaaagtgttagaattacaggcgtgagccaccacgcctggctaagtgcattttaaaatgcagtaactggccgggtgtggtgactcactgcctgtaatcccagcacttcgggaggcagaggcaggcagatcacgaggtcaggagatcgagaccatccttgctaacatggtgaaaccccgtctctactaaaaatacaaaaaattagcctggcatggtggcgggcgcctgtagtcccggctgctggggaggctgaggcaggagaatggcatgaacccaggaggcagagcttgcagtgagctgagatcacggcactgcactccagcctggaggacagagcaagactccgtctcaaaaaaatgaaaaagaaaaaatgcagtaactgattggtttctctctgaaatatgtgcaaaatcaaacttttttttttttctgagacagagtcttgctctgtcgcccaggctggagtgcagtggcgggatctcagctcactacaacctccgtctcccgggttcaagccagtctcctgcctcagcctcccgagtacctgggattacaggcatgcaccaccacaccaagctaatctttatatttttagtcgagatgtgttttaccatgttggccaggctggtcttgaactcctgacctagtgatccacccagcttcccaaagtgctgtgattacaagtgtgagccaccacgcccagcctcaaactgtttgttttaaacatccaatctaagaaagattttatataattgttgccagttaaatatcaaattatactatagcattcaagagaaaaaatgcttcatttgaacattttttctaactgtgttttatttttttgtttttttttttgagacagagttttcattctgtcacccaggttggagtacagtgccgctatcattgcttactgcagccttgacctcccaggctcaagcaatcctctcaccttaacctcctgagtagctacgaccagagttgcacaccatcacacctgactaatttctgtattttttgcagagatggggttttccatgttgcccaggctgccgttaactcttaatttgtagtcctatagaaaaaagcaagaaagagaaacttccattatgttacttctgttcaatgaagccagtgactagaaatatgaaaaggcaggcattaaaacactagttgtatatgtttataaataattttacatagcctaatatgtaaggaaacagtggaaaaatgtgaaaataatagatcaggtcgggtgtggtggttcatgcctgtaatcccaggcgtgaatttgggaagctgaggtgagcagatcacttgaggtcaggagttcaagaccggcctggccaacaaggtgaaaccccgtctctactaaaaatacaaaaattagctgggcatggtggcgagtgactgtaatcccagctactcaagaggctgaggcaggacagtcgcttgagcccaggaggcagaggttgcagtgtgccaagatcgcatcactgcactccagcctgggtgacagagtgagactttatctaaaaaaaaaaaaaaaaaatcaagtggctgggcacagtggtttatgcctgtaatcccagtgctttgggaggctggggcaggaggatcccttgagcctaggaattcgaggttgcagcgagctatgattgtgccactgtgctccagcctgggcgtcagagtgagaccttatctctaaacagattaagagagacatcaggtggggggcggcgacggatagcattaggagatatacctaatataaatgacgagttaatgggtacagcacaccaaaatggcacatgtatacatatgtaacctgcacgttgtgcacatgtaccctagaactttaattaaaagatcaggaattatgaactgtttatagtaattttgctataatttgtcatctttcagttaaagaattttgttatccaaaggagaacattttgttattaaaaagcattgtttttctacaattgccaatacatccaaacaggtaaaactaattaagagtgttttgttgtttcagaacaccgaaaagctttggaggatttcactcttgataatattctttctcatatttattattttcgctgtcgtgactacacagagttactggcacaagtttatcttcttccagatttcctttcagaacactcaaaggtatgagtcagactactgaaatgtaactaaccaagtattttttgaggtgtttgataagcatgaaaaaataaccagtacagtagcataaaatcaaagtcaaagccaattgagaaaatctcttccttccttgacctacaatttatttatatttatatttgttttgtgtatgtatatgtatatatagtttatgctcagagtaagaaattgaaataatatagaagtttcatttccagtaatagtggaatagctcctatcaaaccacattgtatagaaaggtatgaaatgaaaaataaaaacttccttgtgctactgttttctagtgcctctccccaaaggtgatcactattggccaggtgcagtggctcatacttgtaatcccagcacttagggaggccatggtgggaggatcatttgagcccagtagttcaaaaccagcctgggcaacatagtaagacattgtccccaccaaaaaaaaaattagccgtgtgtggtgtagctgtagtctcagctaccaagggctgggtggagcaggcctgaggtgggaggattgcttgagcccagcagttcaaggctacattgagctaccgtgccatcatgtatcacctttttttttttttttttttttttttttgggtagaaatggagtcaactcctggggttaagcgattctcccacctcagcctcccagagtgctgggattataggcatgagccactgtgcctggccctttaattttggtaaacattatcagtgacaaagattctccttgactgaacttggccccatcctgtctttggcctacccagtccagtcttagcaaagaatcctgctgtcagttcagagagattctctcacatttgatagtctgagcacctttgatacctgatcacgttcctcattccccacctttgatatttaaatccttggcttgcctttatttatttattttttattttttaatttgatggagtctggctctgtcgcccaggctggagtgcattggcgtgatcttggttcactgcaacctctgcttcccgggttaaggcaattctcctgcctcagcctcccaagtagctgggactacaggcatgcgccacaacgcctggctaatttttttttttttttatatttttggtagaaacagggttttgcatgttggccaggctgctcacctggctggcctgccattagtaagaatcctgttcggtcagtttagcaagaatttccctacccttgatgtctcactgttagtaattgttcatccactgaccccttcaccttgctcttggttgtgaatccccagttgtccttgtattctgatttgaacccagtctctctcccctattgtgatacccctattagaatagtcttgaatacagtctccttactgttttaagaagtgttagaataattttttcttgaacacatatcgcccttcagaaagactgcaccaatttctactcttactgacaatatatgagaatgcctattacccatcatcctgaccttttgaatatttttgccaagattctgcatggaaaatgccatctctttgttattttatttattttaattaattaattaattttttttttgagtcgcccagtctgactaacatggcaaaaccccgtctctacctaaaaatacaaaaattagcctggtgtgttggcatgcacctgtgatcccagctacttgggaggctgagacaggagaatcgcttgaacctgggaagcagaggttgcagtgtgctgagatcgtgacactgcactccagcctgggagacagagagactctgtctcaaaattaataaataaaaattaaataaataaatacaatagaaattaattttcttagagttctggagcctaaaagttcaagatcaaagttctagctgattcagtttctggcaagggctttcttcctggcttgcagacagccatcttttctctgtgtcctcatatgatagggaggaaaagaaggagagagtgaattccctggtgttttttcttttttttggggggggggtggagtttcgcttttgtcacccaggctggagtgcaatggcgtgatctcagctcactacaacctccacctcccggattcaagcgattctcctgcctcagcctccagagtagctgggactacaggcgcatgccaccacgcctggctaatttttgtatttttagtagagacagggtttccccatgttggccaagatgttctcgatctcctgatcttgtgatccgcccacctcggcctcccaaagtgctgggattacaggcgtgagccaccgtgcctgacccctaatatttcttcttacaaggacgctaatcatcttagattagggtcccatctttatgaacttatttgattacttccttagaagtcctttctccacatacattcacattggggtttagggattcaacatacgaattttaaggggacataattgagttcccagaagtttgcccctggccccttgcccccctaccccctacctgcccgccaaattcatgtttttcttgtatccattccatccacacagccccaaacgtcttaaccggttccatcatcaactctaaaagtcccaggcttcatctaaatattatctaaatcagagattggtgagactcaagttataattcatcctgaagtgaaattcccttccagctgtgaacgtttgaaatcaggcaagttatatgctttcaaaatacaatagtaggaaatgcataggatgaacattcccaaaaggattatgggtgcctagcaaggcaaatttcattggaccataaggctcaagaataatcctttgctggccaggcacggtggctcatgcctgtaatcccagcactttgggaggctgaggcaggcagatcacgaagtcaggagtttgagaccaccctggccaatatggtgaaaccctgtctctactaaaaatacaaaaattagccgggcatggtggtgcgtgcctgtagtcccagctactagggaggctgaggcagaagaatcacttcaacgcaggaggcagaggagattgcagtgacatgagatcatgccactgcactccagcctgagtgacagagtgagactccatctcaaaaaaataataataattaaaaaaagaatgatcctttgctttgatgctctgccttccaggcccactgcagtagcagaatcaccctactgctctgtggggtggccctgccccttcctctctctgcaagggccccaccctctgaaaccaaggacgacatagcattgccccctgggcttatggtaagagtgacagctctgaggatctgtgatcccctttggcaccattctttccttttcttgaggaatagggcacattcacagtcaagtagctcatggttttctcttgtggaatcaaggaagtccaacagccttcgttcattctttcccacttactctgtcctctttacttcaaactagcagtgtttctgctgttataatcccttatctatcactggcttctgctgagatggctgattaacatcatggataatctatttatagagtcattgttcaaccgtacctttggtcttctctctagagcaagctttcttatttttagcaatatggataggctgagaattttctacatctctaagttctggttccttcttgctgaacaattccttcttcaattcatctgtctcctctttcatttttactataagtggtctaggagaaaccaagccacttcctctacactttgcttagaaatctcctgagataaatagccaatttcatttctcacaagttttaccttccataaaatactagaacacagccaagttctttgccactttatactaagcaccagctttccttcagtttccagtaacttgttcctcatttctgtataaatcctcaccagaatagccgggcatggtggctcacacctgtaatcccagcactttgggaggctgaggtgggcggattgcctgaggtcaggagttcaagaccagtctggccaacatggtgaaaccccgtctctactaaaaatacaaaaaaattagctgggtgtggtggcgtgtgcctgttaatcccagctactagggagtctgaggcgggagaattgcttgaaccagggaggtggaggttgcagtgagccaagaacgcaccactgcactccagcctgggcaacagagcgagactccatctgaaaaaaaaaaaaagcctcaccagaattgcccttaatgtccatattttcagtatgtgcctcaaaactgttccagcctttgcttattacccaatttgaaaatcacttccacattttaggtatttgttatagtagtaccttgcttctctcactacctaacccaccatacctcatttcttgatactaaaatttgttgtggtcacctcaggctgccataacaaaaatactatagtctgagtggcttgaacaacagaaattttattttcttacagttctggagactagaagctcaagataaggttctggctgattggtctctggtgagagctctctccctggcatgtagatggccaccttcttgctgtgtcctcatggggaggaaggaggaagagtgagctctttggtgtcttttcttcaaggacactaatcctctcaaatcaggatgtcattctcatgacctaattttacgttaattactaccttagaggccctctctccaaatacagtcacactgggagatagggcttcaatttacgaatattggggggacacagcagtggtcatgtgtggagtcatgaaaaatcgaatcaacctgtgcacatattcccagctgacgttgaacaaggtcatgttctgcctttttatttcagctctctactgtaaacaagtgtccttttcacagtctttataatgccacttttttttgcatttttgtgctttttattagtgttcacctgttcttcatcacttcaaccagtttcattttcttataattatcggaaattaccttatttgtgtgtttgtttgcatattaatggtcccttactccactaaaacataacctccaagagagcagggaccttctctcttatttactatattcttctctcttatttactatatcatccccaatgcctggaacagtaaatagcatataggaaaggaggtgtcaattaatacttgctaaatgaagaaacaaatactctaaataaaacaacttacttaggcattgcttcataaaagcctcttgtttaatccaacccttactagatagaaaaaaacatagcattggagtcttttgtttgtttacatttgggttagtttccagattctttttgatttggggatcttaaggtttatatattggtttatttttctaacttcactgtttattttttgctttggggggggctttcttttgaaagggttttgctctgtcccccaggctggagtgcatggcagggtttcaccacgttggccaggctggtctcaaactcctgacctcgtgatccacctgcttcggcctcccaaagtgctgggattacagatgtgagccaccgcgcccagcctgaaggtttttttgttttttgttttttgttttaggaaacataaaaagaacccggaaggtaaaattggtatatttaattgacaaatgtgttgttttaccaagactttttctttaagccttttcagaatgttttacaaagactttaaatgtgctttttatcagtaaagactgtgtacagtggcaagttaaagaaaattataattattcctttttctttttgaattacttttttttttttttttttttgagacaaagtctcactctgtcgcccaggctggagtacagtggcgcaacctctgccaccagggttcaagagattctcctgcctcagcctcctgagtacctgggattacaggtgcctgccactgtgcctggctaatttttgtagttttagcagagatggggtttcaccatcttggccaggctggtcttgaactcctgacctcgtgatccacctgcctcggcctcccaaagtgctgggattacaggtgtgagccaccgcgcccagcctttgaattacttttttaaagttgagaaattatcaaagcagagtccgttttaacttttagtgattattgcagaaagcactggctgaacagctttgtaactttccaaaagaaagccatactttagacagttggaaataaagccctgggttttaaggttttttcctgtaatggactatggtttttccaatgctatgtttttttctatctagtaagggttggattaaagaagaggcttttatgaagcaatgtctaagtaagttgttttatttagagtatttgtttcttcatttagcaagtattaattgacacctcctttcctatatgctatttactgttccaggcattggggatgatatagtaaataagacagaagaatatagtaaataagagagaaggtccctgctctcttggagagagagagcatttttattattattattttatttttcgtaacaaatctaatattatctcttctgtatttaggttcgactagtgatagtggatggtattgcttttccatttcgtcatgacctagatgacctgtctcttcgtactcggttattaaatggcctagcccagcaaatgatcagccttgcaaataatcacagattagctgtaagtattaactagtgaagagagttttataacaaagtcaagactgtataaaatgttaatgtctagaaatgtcaaaatagcgtttgcctgacaaataatatagacatgcagttttgagtaaagttacgtttggttggtttccattaaaaaattctggtcataagtgtcagttttcctggaaaataacaagcataattaatggactttgtggttgagcgcggtagctcgtgcctgtaatcccagcactttgggaggccgaggcaggtggatcatgaggtcaggagtttgagaccaccctcgccaacatggtgaaaccctgtctctactaaaaaaaaaaaaaaaaaaaaaaaaccaaaaattagcccggtgtggtggcatgcccctgtaatcccacctactcgggaggctgaggtaggagaatcacttgaacccaggaggcggaggttacagtgggtggagaacgcgccatcacactccagcctgggcagcagcaagactccgtctcaaggcaaaaaaaaaaaaaaaggactttgtttgataaagaaatgccacctttgttaattgcagtgtcttctttgtttaaatatactttggatgtttttcaggttaactcttccaacatccctggttttcttctcctttgagtctttgattattatgtggtatgtaatcacagattcagatggattgaaacataaccggtgtaaacaacctagatgctttgaggtagagctaaataactcttgaagatttgaaatgtgaggagagaagtaaatatcggctcagaagggaagagatttttttttttaaagttttacctcactcctctttaactgcttgtttgccattacttcccaccctgaatccacatcccaccactgacacaaatacacacatttgtctgggagtaagatgtaaggtcaaactgcttaacttgatttctttgtctttaccttaattagagagaccttagcacatacctgtaatacatcataagtaaataaagaacttcctcagtaaagtcattttaaagcatacttttttctttgaatttccaattttttttgccatatgctgaaaagcatagtgccctgtgtttgaattactttttgcttaaattaattgtaatttagccttttgttaatatcagtgaagagcctccagtagggggcactcaagactaataggttgcatagttccttatgtttttaacagaaatagcttcaccttttccgactaaaaaagcaatccaaacaataacatcaaatagtaggtagtgtttaagaagagtgatgtaaatataaacgtcctaacatggaagaagatatatacatatatgttattgagtgaagaaatttaagttgtatataaaatatatttaatgttacctcagtttagagaaaacttataattatatgtatgcatttatatttgtatatatgaagagaaagatctgaaaggaccaaaacattaacagtggctacttcttttttatttttttggagacagaatcttactgaagtgcagtggtacaatcagggctcgccacagcctcgacatctcgggctcaagtgatcctgccacctcagcctccctagtagctgagactagaggcacatgccaccatgcccggctaatttttgtatttttttttttgtagagatggggtttcaccatgttgcccagctggtcagaaggcggaggttgggctcaagcgatcatctgccggcctcagcctcctaaagtactaggattacatgcataagccactgtgcccagacttggcttcttcaaaggatgggattttgtagggttagggacacactttccctctcttactttataatttctttgcttgaaggttttttttcccaattaacatatatataacatgtatggcttttgataatgtattttataattttaaggccagatgtggtaactcacacctgtaatcccagcacttttggaaggccaaagtgggaggaccgcctgaagccaggagtttgagaccagcctgaacaacaaagcttgaccccatctctaaaaaaaaaaatacataaaataagaataattggccgggcacggcggctcacatctgtaatgccagcactttgggagactgaggtgggcggatcatgaggtcaggagttcgagaccagcctgaccaacatggtgaaaccccatctctactaaaaatacaaaaaatagtcaggcgtggtggcatgcctgtaatcccagctactcaggaggctgaggcaggggaatcatttgaacccagaaggcggaggttgcagtgagccaagattgcgccactgcactccatcctgggcgagagagcaacactccatctcaaaaaaaaaaaaaaaaaaaaagaaattttaagttatgtatgctttttgtaaaagaaaaaaaaagttctaaacaataaaaaatgtaggaagcgattattcattactcagagattgtgtaaatattgttgtctggtgtaaatatttttgcagacttcatgcatatacaaacttacgttttagaaaatgaggtcataggccaggtgtggtggctcacgcctgtaatcccagcactttgggaggccaaggcgggcagatcacgaggtcaggagatcgagaccatcctggctaacacggtgaaaccccatctctactaaaaatacaaaaaagtagctaggcttgatggcgggcgcctgtaatttcagctactcgggaggctgaggcaggagaatggcatgaacccgggaggcggagcttgcagtgagctgagatacgccactgcactccagcctgggcgacagagcaagactccgtctcaaaaaaaaaagaaaatgaggtcatgccaccgcagtggctcacgcctgtaatcccagcactttgggaggccaaggtgggaggatcacttgagcccatgagtttgagaccagcctgggaaatatagtgagacttcatcgctacaaatttttaaaaaaatcttagccaagcatagtggcatgcacctatagttctagctacttaagcggctgaggtgggagtattgcttgaggctgggaggcaaaggttgcagtgagctgagatcgcaccactgcactccagcctaggcagcagagcaagaccctgtcttcaaaaacacaaaaagaaatgaaaatgaggtcatattatacatgctattatgcaaagcagttttctgtttttcacttaatatattgtgaacatctttccatgtatactactttttttttccatgtacactacttataagtctgctttacactaacagctgcatagtattttgctgtatgactgtagcataggttttttttgtatttgtatttgtttttgggttttcttttttatgagacagggtctcgctctgtcatccaggctagagtgcagtggcatgatcttggttcactgtagcctcaatctcctgggcttaagcaatcctttcacctcagcctcttgagtaactgagaccacaggcacacaccaccacacccagccaatttttaaattttttgtagaggctgggcacggtggctcacacctataacccaccactgtgggaggccagggcaagcagatcacttgaggtcaggagttcaagaccagccttgccaacatggtgaaaccttgtctctactaataatacaaaaattagccaggtgtgttggtgctcacctgtagtcctagctacttgggaggctgaggcaggagaatcacttgaactcgggaggtggaggttgcagtgagccaagatcacactgttgcactccagcctgggagacacagtgagactctagctccaaaataaataaataaataagttttttgtagagatgaggtctcactatgttgcctaggctgttcttgaactcctgggcttaagggatccatctgcttcagccttccataggcatgagccactgtgcccaccctgtagcgtagtttttttaaccacctccttattgatggtctctctcttttttttttttctgttttagatagagtcttcctctctcacccaggttggagtacagtgtcacactcttggctcactgcagcctccacctcccaggttccagagcttctcattccacagtctcccgaatagctgggattacaggcgtgcaccaccacacctggctaatttttgtatttttagtagagatggggtttcaccatgttggccaggctggtctcaaactcctgacctcaagtgatcgaccctcctcggcctcccaaagtgctgggattacaggtgtgagccaccacagctagtctagaataaatttcttaaagtgaaaatattaagccaaaggaatcgatttttgaacattttgttttatgttataaaattaccctcagaaactatgctccaaagtatgtctctacagcaatgaatgggaactcttgttttcccatatctttaccaactttgggtaccagtcttttatttatttatttatatctttgagacggagtctcgctctgtcgcccaggttggagtgccatggcgcgatcttggctcactgcaacctgtgcctcctgggttcaagagattctcctgcctcagcctcccgagtagctggaactacaggcgcgtgccaccatgcccggctaattttttatatttttagtagagatgggtttcactgtgttagccaggatggtctcgatctcctgacctcgtgatccacccgcctcagcctcccaaagtgctgggattatacgcgtgagccaccacgcccagctaggtaccagtcttttaaatctttgccaaattgatatggagaaagtcctttaaaaatatgttttttggattattggcataattttttaaacagccttaatgacatatatgattcatccttgcagtgtgcacaattcagtgattttcagtgtatccacagagttttgcaaacatcaccactgtataattttagaatatttccgtcatcctaaaaaagaaaccccaacctcacagtgaatttcagaatatttaaaatgtctgctccttcagtgtcacgtttcaaatctcatgcaaatttttcttgcggtcaactataactttgtaccctatggagaaagtaattctggttctgggaaacacacagttccagattattaaaaaaaaaaaaacaaaaaaaaacaaaaaacctcttttcagctgggtgcaatagctcacccctgtaattccagcactttgggaggccaaggtgggtggatcacctgaggtcaggagttcacaaccagcctggccaacatggtgaaaccccatctctactaaaaatacaaaaaaattagccagttgtggtggcaggtgcctgtaatcccagctactcaggaggctgaggcaggagaattgcttgaacccaggaggcggaggttgcagcaagccaggaccgcgccattgcactccagcctgggcaacaagagcgaaactctgtctcaaaaaaaaaaaaaaaaaaaaacccttttcattagctgtcattctctattctaccctcccccagtccctcacaaccactagtatgctttctgtttctgtgaatttgtcttttctggacattttatataagcagatcatacagtatatggccttttatgtctgacttctttcacttagcgtgatgttttcaaggtttatctgtattttagcacccatcagtatctttttaatgactaattttgcattttatggatatatcacattttgtttatctgttcattggttgaaggacattgcatggcagaaatatttttaaagctctgaagttcataatttcaagtgattgttactttactgttttaaacttttgacctggcatggtggctcacgcctgtaatcccagcactttgggaggccaagctgggtggatcacctgaggtcaggagttcgagaccagcctggccaacatggtgaaactctgtctttactaaaaatacaaaatttagccaagcgtggtgggggacacctgtaatcctagctacttgggaggctgaggcaggaaactctcttgaacccaggaggcagaggttgcagtgagccgaggtcatgccactgcactccagcctgagcaacagagcaagactctgtctcgaaaaaaaaaaaaaaaagcacttattctttagaagcttggcataatcacatactaattttcagttgtatcatggaggccaatcgttttgcaaaagtaatataattgctatataaatatttgctaataatggaaattctaattttggcatgttgaatacctggtaaatcagtagtttgatttatattttcctaaagatacgtagtgcgtaaactaagtactctctctaaaccagcactgtccagtagatctgatggaaagatgaaaatgtacagtctagtacagtagctgcatgactgttcagcacttgaaatatagctaatactactgagctactgaatttatgattttaatttaacttttttatttattttttttgagatggagtctcactctgtcgcccaggctggagtgcagtggcgcgatcttggctcactgcaacctcctcctcccgggttcacgccattctcctccctcagcctccctagtagctgggactacaggcgcatgccaccatgcccagctatttttttgtatttttagtcgagacagggtttcaccatgttagccaggatggctttgatatcctgaccttgtgatcctcccacctctgcctcccaaagtactgggattaccggcacaagccaccacgcctggcttctaatgtaacttttttttttttttttaagacggagtctcgctctgtcacccaggctggagtgcagtggcgcgatcttggctcactgcaagctctgcctcccgggttcaccattctcctgcctctgcctcctgggttcacaccattctcctgcctcagcctcctgagtagctgggactacaggcacacaccaccacgcccggctaattttttgtgtatttttagtagagacggggtttcaccgtgttacccaggatggtctcgctctgacctcgtgatccgcccgcctcggcctcccaaagtgctgggattacagtcgtgagccaccgcacctggctaatttaacttttaaaagctacacctgggccaggcacagtggctcatgcctataatcccagcactttgggaggccaaggtgggaggatcacttgaggccaggagttcgaagttaatctgggcaacatagcaaaaccctgtttctacaaataatttaaaaattagttaggcatgcctatagttctagctagtagaacttgtgcttgaactatagttctagctactggggaagctaaggcaggaagattgtttgagtccacaacttcaaggctgcagtaagctatgattgtgtcattgccccccagcctgggtgacagagtgagaccccatttctaaaaactattcttaagaaaagctgccggccgggtgtggtggctcatgcctgtaatcctagcactttgggaggccgaggtggagatcacctgaggtcaggagttcgagaccagcctgaccaacatggagaaaccccgtctttaccaaaaatacaagcttaaccaggcatggtagctcacacctgtaatcccagctactcatgaggctgaggcaggggaatcgcttgaactcaggaggcggaggttgcagtgagccaagatcatgccattgcactccagcctgagcaacagagtgagaccttgtctcaaagaaaaaaagaaaaagaaagaaaagctgccaatttaaattcctgcttagctttttctaaggtgcccgatgagaggtaacaaatggagaatgccctgtggcatgtaaggggaggggagctagaagaaaatcatgtcatccacttggtatctaattgagatctagatggatcacagatttctcctttgcggtgaaacagaaattttagggtgttaccactgcagtgggaacagccaaacaaccttttttctttcgcagttttctttttctttttttttgagttggagtcttgctcctgttgcccaggctggagcgcaatggtgcaatattggctcactgcaacctctgcctcctggatttcagtgattctcctgtctcagcctcccgagtagctggggttacaggtgcccgccccaacgttcggctaattttttgtaattttggtagagatggggtatcgccatgttggcctggctggtctcgaactcctgacctcaggtgatctacctgcctcggcctcccaaagtgctgggattataggcatgagccaccgcgcctgggctgtttctcggttttcttacataaaaaactcattttcagagtagacacctttttcttactgcttttcatggaatttcattatcagttttagtttgcaatattaactctttttttctggagggaagatatgtattagaagagtatataaagtaaccatttctggagatttggggatggaaagataacagatctgacttctgtgttaagtcagccttaaacgcttttgttttccctgctttatttaaaattactgtctttcaaaacctggaaccttttttgtaggtcagtatttatacaaagagaattagcaatatgaaaccttgagggccatctgtgagttgcaaagcaacacctgtggctgttaatagctgagtagcataatcataatttggagtcatttgacctgactactaggattttttttttcctagttcatctacttatattgtaccttctttatgagttttaagtctcttctcataatttgttgcctcagtttctttttttcctataaaattataaacagtaatactatatttgcttccttcttaaaagtataaacattgaggtatttgttaaggatttcatattcctttcaataaaaatattctagggaggcaatagtgataaagaacatggactcaggccaggcacagtgacacatgcttataatcccggccctttgggaggccgaggtgggtggatcacttgaggtcaggagttcgagaccaggccggccaacatggtaaaaccccatctttactaaaaatgcaaaaaattagccaggcatggtggcaggcacctgtaatcctagctacttgggaggctgaggcaggagaatagcttgaacccgggaggcggagattgcagtgagccgagatcgcgccattgcactccagcctgggcaacagagcgagactcagtctttcttttttgagacaaggtcttgcttggtcatcaggctggggtacggtgacagaatcatggctcactgctgcttcaacctcctgggctcaaccaattctcctgcctcagcctcctgagtagctgggactacagttgtgcaccaccatgcccagctaattttttaaaaagttttttgtaggtcaggtacagtggcttatgcctgtaatcccagcattttgggaggctgaggcaggaggattgtgtgagcccaggagttcaagatcagcctgggcaacatagcaagaccctgtctcttaaaaaaaaagttttatgagctagatgtggcaaacacctctagtcccagctgttcaagaggctgaggtgggaggatcatgtgagtctaggacttcaaggaccacctgggcaacatagcaagaccccatctctaaagtatgaaaataaaatactttatgatcagtagaatcatattttcaggtaactacatctttttatgggtggatttttaatttttttttttttttttgagatggagtctcactctgttgcccaggctggagtgcagtagcgctatctcagctcactgcaggctctgctccccgggttcacgccattctcctgtctcagcctcctgagcaactgggactacaggcgcccgccaccacgcccagctgattttttatatttttagtagagacagggtttcaccgtgttagccaggatggtctcgatctcctgacctcgtgatccgctcaccctgttagccaggatggtctcgatctcctgacctcgtgattcgcccgtcttggcctcccaaagtgctgggatttaaaattttttatcagaaaaatttgtattacttaaatggctggctataataggtagattaatttcatattactaaaatcacaggctgggcgcggtggctcacacctgtaataccagcactttgggaggccaaggcaggcagatcacgaggtcaggagatcgcgaccatcctgactaacacggtgaaaccccgtctctactgaaaaaatacaaaaaaattagctgggtgtggtggtgggcgcctgtagtcccagctacttgggaggctgaggcaggagaatggtgtgaacccaggaggcagagcttgctgtgggcagagattgtgccactgcactccagcctgggtgactgagcgagactctgtctcaaaaaaaaaaataaaataaaaaataaaatcacaagactgtttacttgattatttatttatttatttatttagtgagacagagttttgctcttttgtccaggctggagtgaagtggcacgctcttggctcactgcaacctctgcctgccccaggttcaaatgattctcctgcctcagcctccggagtagctgggattacaggtgcatgccaccatgtctggttaatttttgtatttttagtagagatggggtttcacaatcttggccagactggtctacttgataattttcaaagagactcacctaattttcttacattttgtttttgtaggtaattttaaccaatcagatgacaacaaagattgatagaaatcaggccttgcttgttcctgcattaggtgggtaattaatcagataaacattttagtttatcacagtttttcttatctctttcatttgattctcattgagtactatacgcttcatgaaagcagactgtatttgtcttgttcactggttaatcttagcactaagcacagtaccgttagatactgattgttccttttagttatttaacatttattgagtggccagacacagtgtcccacacctgtaatcccaacaccttgggaggccgaggcggatcacttgaggccaggagttcaagaccagcctggccaatatggtgaaaccccatctctactaaaaatacaaaaaattagccaggcatggtggcacacacttgtaatcccacctacttgggaggctgaggagtgagaattgcttgaacttgggaggcgcaggctgcagtgagctgggatcgtgcatctgcactccagcctgggggacagagtaagactctctcaaaaaattgcgtatctactgtctggcaactgttgtgtcaaagattcttgcccccagggagttcacagtgttagggagaaggaaaggtgaatccacttaaatacaaatcacactacagtgaatatcgtggttttgttagaatgtagtgcttcaagatttatttccactaaaatcttaaagaatattctaccagagtcttggccaggtacagtggcttatgcctgtaatctcagcactttgggaggctgaggcgggtggatcacctgaggtcgggagtttgagagcagcctgaccaacatggagaaaccccatctctattaaaaatacaaaattagatgagcatggtggcacattcctgtaatcccagctacttgggaggctgaggcaggagaatcgcttgaacctggggggcagaggttgcagtaagccacggtcgcgccattgcactccagcctgggcaacaagagtgaaactctgtctcaaaaaaaaaaaaaatgtatctgcccttgactagttttcaactaatggcatagatcattctataaacagataatgtagtaaaggttacaatagaaagtacagggtactgtacaaaggacggattctaacctggcccaggtgagcaggatgaaaaggaggaaggttagggaagggagtgtaatagtctgtcatgtttcttccagctgtttttgtcattttctatcacccacttaagcaagagcttcctaatgtttggatccactcaggggtaatcaaactcagcctttctcaaactcatgccctcagcacactatgataaatcagaaagcaaatttataaatttagtgagaattacagttgtcaagcagaatgaagtttatgttttctagtcagtttattttcttcccagataccaggaagttgggaaagcaggggttcagagttggtaagcagagaagcaaataaatggaaatggatgccctcaggaatattatgcttaagttgtgataattctgatgccctccttggtttactagcagaacgccctttaccttggatattgctaggatattgttcaatagaatggtcagttatgatagaagtgttctatgtctgtgctcttcagtacagtagcccttgctacatgtggctattgaggcatttaaaatgtggctaatgcagctgtggaatggaatgtttaattgaattttacttaaatttaaattgcacatgtggcaagtgactgccctgttgtgtagtgcagcactggataaacataactcctgtgttctagactccaatcccaccattagctttctgtttttgacagtgtttgctagtatgataggtcactgctcattttacattactatcagtttagtttcctttatatttcagaggctccctaatcccttaaagagatttaaaaatcaacgtagaccacttctgtatgaaaataagatggctgaatttgctttgattggaattaggaactggcgctctctttgctagttctggaatttggccaggatgcacatcaaaatctcattcctaccctcctgatttgcctcatgcaaactttgttgctgtgtctgttctttggtcttctattgctgtgtctcagctttagattatatgtcttgcgtagaaatggatcatcagaatgcaacaggcagaagacttagaattgcaaatcagtagggtaatgacaaaccctttgagctgagtgggactgaaaagtaacctaacatataacctattagtaattgttaaccatgaagattttcagtgctggacacataaattgctgagttcaactgccctctttgccctccaaatctagcataaaacaaattggtgatctcaggccagtttcacacctaatatgactaataataaaagtcttgtgtttcaggaactcagtttgtccaaacctgagcccatcatctctacctcacaaattatatccaccttttcatttccttgcactgtgtctgcatgatatgataatactcccaagcactattgcttaaatcttgagttacacttaatgcttttttttttggtcttttttctttttaatgtgaaatagaatatacaaatgaaaatgtatatttagaagaacaataataaatgtccaggtgcccattgctcagactgacaaatggaacattactaccccccaggagcctcgtatgctctccccccaagaggcaaccactatcctgaattttgtgtaattgtcacctagcttttatagattttactgtctgtgtatccctaatagttgcttatttctagcctttatataaatagaattatactgtatatgactgacaacttttgctcattattattttttgattcatccatgttgatgtgtgacactgtagttcatttcgatgacatgaatatgccacaacttaattatatattctgttgatgtcaaaaaaaaaaaaagaatattctaccagagtttttacttttcttctggaggtcagaaatacgttaggcttgatgatatggaaaattgacacatatatggactcagacaataaagttttctaaaagcaaatagagaataatgatttgcagtatttccctagataggtaaaaaccttgtaatctcaggatattactcattttccaggttttttgaaagcaagtatactttcgttatgttaaattaataaagtaagattatatttgatcagaggcgttctgagaaatgtataaccaagtcagtaaggccatatacagttattatgttttttactctcaggggaaagttggggacatgctgctacaatacggctaatctttcattgggaccgaaagcaaaggtcagtacagaaacaagttaataactccgaatattgggttaattatactgaatgaacacttacaggtttcttagagctagtcctgtggatgagatatacagtgacccatgaagtgacacttttgttgccttgtctgatatcacctagagcaaacatagaaatgtgttgttattactgcatatttagctacataggaaattctctggaatatttaaatgatggggcgcatgcacctgaaatgagtaggtggccaaggaatgccattttctaaagctcttcgaaataatttattagccatgtagaaggaggtgagtactctgtgttcctggaagagattgaaaaaaaaaagaataaaatcaggacaaaaggaaaattgttgaggttacctttaaaattaatttatttggaacatacgatggtttctcttatttgcttagtatatttcttgtatgaaattgtgtctgtttttttttttattttgtattttgctgtccagcttttattatccagttacttacctgcatttcacaagtattgttctttaaaagtatggcagcatgaaatctttgtatttgtttttaaagctgctgagcaagtgaacaaaccagcttttattttcttgaaaatagaccattgaaagctgtgaagtcttttctacacttctagaaaatgtcagattcatgctagcctctccgctttgtgattaattggtataacctagaggtcttggtttggaaatgctctaataaagggagaaattaaaatggcatgtgggcaaagatggaataaaaggtcacttaaatacatattgggcctagccagtgaaaatgtctattttttaatctatatttctttgttgttctacaaactgaaaaaaatcctgcctgaccaagttaggttttacggacctgaagctcataacagaatgattacacttctgtatatatcttttgcaactgatcgtgcagtttgggtcttctttaaaaatggtatttgcaaagagctcaggtagtgttttttttcccccacaatacgtagtgctttactattgactgtcgccccctaatttaaacacattttttactctaaaccagtatgactggtaaatcctccccctaattttttttctatgatcacaatttaaggtagttcctcctagttttgtaagtaagttgctgtatactagagtcacaaaaggagttattttctcggcaccaaaccttattgtaaagatttggcaacagttctccagctgtcttttgaacatattgcttatactttcccagttttaggttattctgtaaagcacattccgtcatttattttttcataggaattacgcctgagttagtatacagtagtcttcttcagactataattaaatatttactaataaaatgcatttaagaagaaaaataataggaacagagcaagatatttcatctttttatgaactcaacaggaggaaaagtttgccttctttgtcaagttctagaagttagcattgataagttatccaagagatcagaaaatcacgcttaccatgagttaaccattgtatgaattcaccttcttacaaatccttcccaagaaattagaaactaaagtacatggccggatgcagtggctcacacctgtaatctcatcactttgggaggctgaggtaggtggatcatggggtcaagagatcaagaccatcctggccaacatggtgaaaccccatctctactaaaaataaaaaattagctgggcgtgatggcacacacctttagtcccagctactcaggaggctgaggcaggagaatcacttgaacccaggaggcggaggttgcagtgagccaagattgtgccactgccctccagcctggttacagagtgagactccatccaccccctgcaaaaaaaaaaaaaaaaaacaagaaaatgatgtacaacaccaacactgaatatagatagattgggggaaatctgctgttctataatattttttctacatctcataagatcatttttttaattcttatttttattttatttatttttcatactctcattttagtgagtgcttgcttgtgctaggtattttactaggcactttaaatataacatttcagataatcttttcaataattatttgcagaatgtatacctattattattaaaagaaaaccaaggcccagaaaggttaactgaataagtagtaaataatagctactatttattgaatatttcttaactgtcctttattgtgcaaagcactgtatgtatatatgtgtacatatatacgtgtatgtatatatgtgtatatatatagattatatgtatatatgtgtatacgtatagatgtatatacatatgtatatatgtgtatacgtatagatgtatatacatatgtatatatgtgtatacgtatagatgtatatacatatgtatatatgtgtataagtatagatgtatatacatatgtatatatgtgtatacatatagatgtatatatgtatatacgtgtatgtatatatgtgtatacgtatagatgtatatacgtatacgtatagatgtatatacatatacgtatgtatatgtgtgtgtatatatataatttcatgttattttccacgtaaatctttgaaatagtgttaccagatgagatcaggcacattcagggtggtatggctgtagactgaaaatagtattatctacattttatagctgactttataaacttttttattttttttgagacggagtctcgctctgtcgcccaggctggagtgcagtggcgcgatctcggctcactgcaagctctgcctcccaggttcacgccattctcctgcctcagcctcccgagtagctggtactacaggcgcctgccaccacgcccagctaattttttgtatttttagtagagacggggtttcaccgtgttagccaggatggtctcgatcttctgacctcgtgatccacccgcctcggcctcccaaagtgctgggattacaggcatgagccaccgcacccggccttataaacttttttttttttttgagagggagtttcgctctttttgcccaggctggggtgcaatggcgagatcttggctcacttcaacctccacttcctggggtcaagtgattctcttgtctcagcctgccgagtagctgggattgtaggcgcctgccaccacaccttgctaattttgtatttttagtagaggtgggatttcactatgttggccaggctggtcttgaactcctgatgtcaggtgacctgcccacctcagcctctcaaagtgctgggattacaggcatgagccaccgcactcggccatagctgactttatggagttcatttcttttcttctataataactgtttctagaaggtaattgtagtattgtgttgattgccagccaatctgaatatgtagcttactcctttttttaggtaaaatcttttttcttcaaacttttttttttcgggctgtggatatatgataaataatgtacatactttatgtaatcaaaataaattgacctcatttaatagcattaaagtagttttgttctttatcatttgaaacctgacatctttaagttgttaaagttgcatgaacttgagcccagaagttggagaacagcctggccgaaatggcaagacaccacctctatagataataaaaaattagccaggtgtggtggtgcacacctatagttctagctgtttgggaggccagagttgggaaaatcacttgagccctggaagtcagggtggcagtgagctatgattgagctattatacttcaggctgggccgcaaaatgggaccccatctctaagatattaaaaaaaaaaaaaaagttacatgaggccgggcgcagtggctgacacctgtaatcccagcactttgggaggccaaggcaggtggatcacctgaggttgggagttctagaccagcctggccaatatggggaaactgtgtctctactaaaaatacaaaaaaattagccaggcatggtggcgggcacctgtaatcccaactactcaggaggctgaggtaggagaatcacttgaacccaggaggcagaggttgcagtgagccaagattgcaccactgcactccagcctgggcagcagagtaagactctgtctcaaaaaaaaaaaaagttgcatgaaattttgtatgctttatgctttttaaattttaggttattttaaaaggatggaaatagaaattcatatcagggaaaaatagttataaaaatgaacatttttcatttggagaggaagactaaaaatcttttttttttttctttttttttttgagacaggatctcactctgttgcccaggctagagtgcagtggtgcaatctcagctcactgcaacctcaacctcctgggctcaagcagtcctcccacctcagcctcccaagtagctgggaccacaggcatgtaccaccacacccagctaatttttgtaatttttgtagagatggggttttgccgtgttgcccaggctggcctcgaactcctaaactcagtcagtccacctacctcggcctcctaaagtactgggattataggcgtgagccacagcacccgtccagaaactaaaaatcttgaatagccaaattatattgggcattgaacttaggtgtgctgtctcatgccccagcccctgtccttcaccagtaacacctgatttttacccttagactaatgatggaataatattccaacagttattaaaagaaatacttttgtctatgtccttatattatgtgagttttcctccaatttgcatattcatggttatatgaggccaagattattcagaattacactactctttgccaagacgatctggtggtagagtggagtaataaatcaacacccccacacagtgtttcatatgtgtgctcagttttagagcacaaattgtgcttctgtcttatttcttcctgacccaaactatgtagttcagccatatgttaagctacatctcagctggggccatgagccaagtgattctttggtttagttttcattttaaaagatctctgaagagacatgatgcataaaagtggtatttttacctagaaatttgaggatgatttttttgttttgtttggttttgtttttgagatggagtttcgcttttgttgcccaggctggagtgcagtggcgcaatctcagctcactacaacctcggcctcccgggttcaatcgattcttctgcctcagcctcccgagtagctgggattacaggcatgcaccaccacgcctggctaattttttgtatttttagttgagatggggtttctccatgttggtcaggctggcctcgaattctcgacctcaggtgatccacctcggcctcccaaagggctgggattacaggtgtgagccaccgcgcccggcctgaggatgattttcaacctgaataattaatgcccctttgactttaggattctttttttgttttgttttgttttttgagatggagtctcactctgtcacccaggctggagtgcagtggcgccatatcggctccctgcaacctccacctccctgattcaagtgattctcttgcctcagcctcccaagtagctgggattataggcatgcgccaccacacttggctaacttttgtatttttagtagagacagggtttcaccattttgaccaggctggtctcggatgcctgacctcaagtgacctgcccacctcagcctcccaaagtgctggattatagacatgagccactgtgcccggccgactttaggattcttaacaagcatgtaaatgcttcttaaaagcttttcactttttaataatttcctcaggatagatgtactaggcaccttttttggacatactgttgatatgaggtgatttagataccaatttttcagaaggctagctgattttcatcattcaaaaaatgacttcttaataaggcaggttaaaatacaccttgcctctctttttctgtgaatttttgcattaaagatagattatcaaccctagggaattataaaagtttataattccactcaacacagctgttcttttttttttttttttttgagatggagtctcgccctgtcgcccaggctggagtgcagaggcacgatctcggctcactgcaacctccacctccccagttcaagtgattctcctacctcagcctcctcagtagctgggattacaggtgcgtgccaccacgcccagctaattttttttttttttttttgtatctttagtagagatgggggtttcaccgtgttggccaggctggtcttgaactcctgacctcgtgatctgcctgcctcagcctcccaaagtgctgggattacaggcgtgagccaccgcacccagcctcaacatagctattcttgtattacatattacttagcaattatttatgtttaaagttgcaattacagagtatagaacattttggattctgctgtattttggtctgtgtttttcttttgaattgtgtctgagaagaggggcaatttcaaaattaagagagtaacagatcatagccaaaatgtcctttttgaattgtctttgaaaacaaatcattctattttgtgtaagtaaatgacccttataactctgagaatcttattttcctctaggttagaatctgtattttttagatcagtttcattacattgtgctaaaacatgtatataacataaaatttaccattttatgtttacatatagttcactggcattaggtacattcatattgtgcagccatcatcatccattttcagacctttttcatcttcccatactgaaactctgtacccattaaatgctaactcattcttttttacccccagcccctgacaatcaccattctaccttctgtctctgaattttactcctctagcaaccccatataattggaatcatataatacttgttctgatgtgactggcttatttcacttagtataatgtcttcaaggctcatttatgttgtagcatgtgtcagaattttcttccttaagtctgcatattccattgtatgtacataccacattttgtttattcatctgtggatgcacacttgggttgcttccaccttctggctattgtgaataagttacagtgtatcagttttaaagtaattcttaaaagcagtttttttttttttttttgagatggagtttcactcttttttgcccaggctggagtgcaatggcatgatctcagctcaccgcaacctctgcctcacaggttcaagcgattctcctgcctcagcctcccgagtagctgggattacaggcatgcgccaccacacccggctaattttgtatttttagtagagatggggtttctccatgttggtcaggctggtctcgaactcccgacctcaggtgatctgcctgccttggcctcccaaagtgctgggattgcaggcgtgagccaccgcgcccagccaaaaagcagtcttaaaggtttttgtttatatttgttgctgttacagtacttgaatatagttaataagagcttagaaatttatttctcagctacttttagctttcagttttatattaattgtataagacataataaaatcccacctaagcagatcttgttctgtcatgacttatttttgggacataatcattttatattattatttttgtagagatgggggtctcactatgttgcccaggatggcttcaaactcctggtctcaagtgatcctcatgccttgccctcctaaagagctgggattacagacatgagccaccatgcctaggtgcatcattttaaaacaatgtcgtcctagctatttttattgggtgtaatatgagtaagtgtttctcatttgtagtataagaaattatcataattcttcagcaataattaaaaaaacatgattactgcagacagtttggaaaatataagcaagcaacctttaccttgtgataacagcttttaacttcttgattgtagtcttctatcaattcttttagatgtgcgtatacatacttataaatatgggataatacagtataactattatttagtatattattaatactttcctatctcattgaatattttcttccacgtttagtttttagcataagtaatatctcatcatatgtaaaataatttatttgaatcagtcattggacttttaggttgctttaaaatttcatataaactctgttatatacatacgggtaatttgaagggtgtatttttaatatttctctcctttttgtgttcttagagaaaaaatagaattattaatataataaacctatacatttaaataatgagtttggtcatctgaacttttaattaattaagttcatgtgtttgtatgtatttattctttttctttaagcaggttggcaacattgtacaagtcacccagccagaaggaatgcacagtactgtttcaaatcaaagtcagtattatttgattagagtgggattttgatattgatgggcggtaattatctaaagagagaatttacaacttgcttctgtcaacttctgtaggcagcaagcatatttgaggacagcttttgatgcttagaacattgtccccaaaatagtagtatatacagaatattgtagtcacaaatggactgaaatttattcttaagagcagaggaaatacttattttggggtagtgtgttccatgccatatgtaatgtcaggatattaaaaatctttaaagtgaaagttgttgaagatttccagaaaagaaaaaatactaacattacttattttggtctgtaggtattatagatctattgtagcaccaaatatagcccactttaagatgttaattcttctgtgaatttacatcatagaacacacattttttggctgaaatatgcatatttatcaatagtgttgagccaaatatatttttggcatctctttttttttgagatggagtctctgcgtcgcccaggctggagtgcagcggtgcaatcttggctcactgcagcctccgccctactggtttaagcaattctcctgcctcagcctccctagtagctgggattataggcgtgtgctaccacgcctggctaatttttgtgtttttagtagagatggggtttcgccatgttggccagactagtctcaaactcctgacctcaagtgatccgcccttctcagccttccaaaattctgggattacaggcgtgagccaccgagcccggctttatctcatttttataacaacaaaaacagaaatagagattctgaaactgaattatccacttagtctttgcagtacccaggtgtacttgaaatatcctagttggggaaaaaaaagagagagagaaatatcatagttggaaaactttagagtatttaattatgaaaataaatctgtaaagtacctaagacttaggttatttccttttacttctaacaaagctatcgtaaagtttgttaggattgacctttagagaacatttttataatgcaatgttatttctgtgcgtgtgtatgcaagggtataaataagtatatataaaatactcttaatatagcccgggctttggcacgtatccatgaggtttattctcttcattcacagtggttgataaatttctatctcaagaactttctttttttttgagacgaagtctcactatttcgcccaggctagagtgcagtggcacaatcttgtctcactgcaacctccgcctcccaggttcaagcgattctcctgcctcagcctccagagtagctgggactagaggtgtgtgccaccatgcccagctaatttttatatttttggtagagataggggtcaccatgttggccaggctggtcttgaactcctgacctcatgatctgcccacctcagcctcccaaagtgctgggattacaggtgtgagccactgcgcctggccctagaataaagtagctttcttattagttacttaaaaatatttctaagatcagtcttcaaatgttcttaaagcatatttgtatatatattttttatctttcagcctcagggatttagagatactgttgttacttctgcatgttcattgcaaacagaaggttccttgagcacccggaaacggtcacgagacccagaggaagaattataacccagaaacaaatctcaaagtgtacaaatttattgatgttgtgaaatcaatgtgtacaagtggacttgttaccttaaagtataaataaacacactatggcatgaatg

SEQ ID NO: 36831 - DNA, 374609 bp, Homo sapiens
cccgctctgcttcagcgcacgctgaagacggcactaggacccagggaagtccccgagcggggttcgcggaaaggcagccagactcctccttatctccagtgtcaaacttgacatcagcctgcgagcggagcatggtaacttctccagcaatcagagcgctccccctcacatcagtggcatgcttcatggagatatgctcctctcactgccctctgcaccagcaacatggattgtcagctctccatcctcctccttctcagctgctctgttctcgacagcttcggggaactgattccgcagccttccaatgaaggtaagccaggtaccgcgacgcacggagctctgccccgcggggctcacgctcttcaaagcacgttctcaccgaagccttgcacgtcgggaaggtgcctccgaatagagcagtttgctctgagagtgaaggaaagatgtgccttttttttttccaactgtcttctaaaacacttcaggagataattttagatggtctaaactttgaaaatgtgtttttaatctgacaccatttcgagcaattaccttgtttgccaatttgagcagaaagaaagaaagaaaatcctccagcgttgcaacccagttatgttaattgccaaatagccaaggcagtattttattttctaattatgaccatgtggtactccgagaagtttgaaagaaaattcagccttcctctctagactctttagtatgtttaaaggtaatgacaggttgttcctacttgggatcatggcatttatgaatggactaaagggaaatcagagtttgtcgaagcggaggtgcgtgtttatggtgcaagggctgtgttgaagttgtgtgtatcccgccaggcaatggtttgctctatggtacaggttctaaagagcagcatatgccacattaacgtaagtaatatttgcaagaattacaataagcttaggttggattctctttgtttaaaggcttatatacaaataggagaatgtatttaatgaatagtggatagctcctgggaagatatagtaaataactgaatagtagattaagagagaatgttcatatgcagcaaatggcatttccttgatgttgtgttatttattatccttgtaatgagcattaattccttttcagtgggttaaagtgcaaacctaatgttaaggacaccaatgtgttctataagattgtgtacttaatacatacattttctttctcctgtattccttttgtgatctattcttgtgaatacagtcactaactcgtaaaacaaacttctctaaataattgattagtgtaaagccacacttacaacattaatttcctcttagtgattttgaacttataacagtaacatttagcaatttattttgcaagttaacaataccgagcaactgatgtgcaaacatcatgttatatacatcactccttagaaaatatattgtcaagccaatactgttgtatatgtaccttaattttaaaaacacgagtaaaaacaaaatacttagaaagttttttattaaatgtaataactgcctgatactcggtgacctactttcactgctaatagagcagtaatttatctccttccttactgactgcctttatcaatttggcagttttcattaaatgttctgaatcttttttctaaataagaaaatgaaaattctaaaatataaggatcaagaaaattatcttacccacaaatgactttttattttacaaaccaaattaaaatgtttatttgaaagtaagagtcaatcattcttcctgaatgaaaggtaagagtattcatttgtataacgggtaacatgtataataggtaacatatcaataaattaaacttaatgttttaaaaatttttgttctttgcagatattaaaatattgacaataactagaaaaatagtattaaaattcccacattgtcatgataaattatattttccagatagaatggttatgaactatgtagatatggatattactgaattaattatgcacaagaatgtagctgttagtcagtatttttgtggaaaacaacctttaagtaaactgcaagagaaaaaaaaagacaccaaactatttcacacctatgtaaaattaatcagtattaatttaatgaaacagagttaatcaaatacaaattgcttttaagcctcacctcatgtatgtttggggatataatgtatataattatacagacaggtacacattaaccatatggatatagaaaggtaaatatattcagaaagctgacataattgcatttaatttgcttggatgaaagtttatccatcattcatgggattattccttccagattgtgtcctatgggtagtgtctcttttccttcctgtgattgtgaagggaagctttaaaacaaatttaagatgatttaacttaggtaatacttgagtgagattttaaatattatccatagctgggctctcagttgagttgaataacatgaaaagtgaaaatgccaagtatgtgccaagatttccgtgcaatttttctaacaatgtaatttaaatagaaagcaattcttttgaaaatgtatatatgagaggagtggtgatttaaaaatggtattaatgtagttttctgatataattttttaattttgaaatatgaaatactagactgtatttaaaatattatgattgaaatatttcaacactgtaaaaaatttatgagaaatttactgaaacatatttactagaatatattcttcaatctgttatgaagttaggcatttgagaaccaaagagaacaaaaccaggccattgacttaattgctaggacatttgcagttgtgtgatgtgttttttaatttaagatttaatcattaaacatcaatattgaaatgccatgggtccctgataagaaaaataacttagaaaatgtttaatctgaattttccttctattaatgtatttacaaatatctctcttatatgctttcaagaaaatgactccaggtgataatagggactcatcaacgataacagatattcataattccaatgatcacttgactcagcaattggcctatatacttaaacagaactttataaaaactttattaaattcttatcaggtctctctgtttacatggcttaagaaaagacttttaatgggagatcagctgtttttcatggcaaaatatgattgctacactacgtattattttaaaagttcatatacttactcctagtttccataccacagggatgattaatggtaaacagaaataacattggaacaaagttaaaactggatataaaataaaattatcaactgtggttacttcaaccctttcagaattggtaaaaatactttctttaaacacttttatacatttatggcagtctggggtacaatgcactattaattcatcagcacataatacactaaatcattttttctatccaaaagagttcataaattggattaacatttacctagaaagctctttatattgaaaatagagtatccaaaataaaactgaataaaattaaatattcatatttatatactacttttttaaagactttttttagtagctaagacactatttctatgaaatgcatttccctaaatataaatattctaaatactagaggaaactatgcaattgtttaaaacttaaaagtaaaacttgcatatgaatattataagcttccctttgagtagtaggcaaatgttggagaaaataaataatcaattttttcatttttaaaaattacaataaattggcatcacttttcatatataaacacttttcctcaaataagaacacactgtgattaaaacattaatagagaactaagctatcatatcatctttataagtttttttggtttggaagagggtttacatttgcttttcatagcatttcatcatgctagactaaataattgaatgcattatacatttttgtaatttaatagctctcctaatagctcacccctacatcccccccccaccccgcctccatggttaactgtgctatttgcctgaaggtaggagaaaccttattttcactattttataacccacaacagttaacacttgacctaggtcattaacaggattatcagcaaatttgtttaagcttttactgacaatctgaattgctacgataatattttgaatgtcccgtaaagaaactttttgtaacctctcaaaatctatcacaaaattaattcattctgaatctatatctttgtaaagactagtatctataataataatttgagtggtgaaaaggttcactcggatacctcaatctctttatttttatgtttcataatcatactattccagtccttgtcataaatgagcaattataaactcttttagatattacatcttctagtaataacaatagatttatcaatacaaaacagtttcactgtaactatcaatatttttaattttatatttttaaattattgttactgtagttgatagggttttctttgcctattttaaggttaaaagttagttggatatacttctaattcagaagtgactggacttataaaaggggaactacatgtaataaaacaccattgccacgtgttagatcatggttgtattttatataaagttgtctttccatgaaacactagaaattgggagctataatgaaaaacactttaatacaaaaatttaaaacaaaatattgtacagaatcagatcttagagagttatttttaacattttttagtaggtttaggaagtttttggtaaagtttttcatttcttgaattgaattatggttggctcgttggtcatattaacaacttagtaatctcacgttgctcttaataagtttattattaaataaatgatttagtaacattctttatgtattgcctacatttaacattcaaactttggtgtgttccttaagggtccgaccatttttaatacttttccacaataaatttctttctaatgttaaaatcctttcagaaatttaaatttttttcggaaataaaatatatgcaatttttaaatatcaaatagttacttttgcaaatgatttttaaaggcaaaatatatttccaaaatatatttgatttactaatttcaacacaaatgaaaaaaaaaagaagtgttcttgaaagttacattttccaagtcataagatcttcaggaaaatattaataaaactttcctcaaatcatcaaactcgataaggttttatagacatttactaaaaaaaatctgtgatctgggctactttttatttgaatcattctttcaatgattcggtttggcataaatactagatataaggggaaacgtgtatttcttggaagaacattaagttttacaagttattttctgtcaagatcctcaactttattttttagcctgcacattttttctttaaaatatttaataaaccttgttcctttaattcctgtttgagagaagatttagaagaacagatgcaggtgtctccttttgggttctgttttcagagatctggattttatcatcacggaaggtcaataaagggcttttaccaagtacacaagtagctttccacagattttttaaataaagggttgaccagtagtgtgaaacattcattatattattcatccagttatacagaaaaccaggattagaaatttacttctcagaaatgtggaaaccttagctaactcttctgtaacaactttagaaatattagtaaaagcaatattgtgacatttataaaatgcaaagtcttccaagtcacaaatcaatccacctaggaagacatccctcagtgtgttcggggtgtggatacatgtgcgccacttgcttgatttcattaagtctgttcccagctgcttggtatcaggtagttcttggaacctggcaggaggttttctccaggaaaatctgaaagtcagcaagttttagtttgcctcctaccagcttcctttgtacaaaaaaaaaaaaaaaaaaaaaaaaaaaagaggggagggtggtcgattacaaagaaaaaagtttttgcaggagaaaagaaaataaaaaaagttgattagaaaactggagaagtagagaaaagcaaaggttttaaagccaatgttaatatataaatcatttgcttaaaagaaaggcatttatcacgtaaaacatctggctaatcaatttttattaaatccctaaaaaccccgcacacttaaaatggggttgaggtgggggggggctgcatttctttgtttctcctcaagtttacacacttttgattttttcccagaagaaaatatttcatccaggaaagttttaagagtgacagccaaaaaatgctaaaatgcttccccctttgaatgtctggacgaatgcatgtggaggggtggacagaatcaaaatcaattcagcaaataaagcctcaaatttgaagtgatgttattaaactagaagccctgagtgtgaacatcccccaacccttcattttctaaatcatgtcccgctgttccagtcaaagcaaagggtgaaaatccacataatccaaaccaacatggtgaagtgagaataataggtgaggaaggaggaggaaagcaagtggcagcactgtacaaacaaactgttgtgaatattcctcgccatggacaggagtagccacaggaggggataactgcctttcttcttcttcgccttacactttccacatttgataatgcaaattcattaaattacaaaagtgtgtcatgcgaaattttagcacaaagcagagccgtacgggtagagacagtaatgtggcaacagggagatgagcaagtgttccttgctgccaccacacccaccatcagggtgtcttaaccacaaactattctccgctaggtccaggctcgttggtgcaaagggaaaacaacggtgtctctcaacagttcactgcttgctcactctgcatcaaattaaagatgagatcataaaaaaacatctccgggtgcgcgtaacgcagtctcagccctctggaggccagtgggttctttgtgcacaagtctctccgcgcctggctgcccaagtcagttcccggagcgcgaccagggtgccacggcctccgtcccgaggtagggtgggtgggcgagcgcagcctgatgctcttttgctccgggtttctgcccccgggcggacggtgtagactctgtagcgagcggagagcgaaggtgcaaagttaagcgaacacgagcgccaggaggagactggagcgcgcgagaggcaaacgtgcgccctctgcctgctgccgcggatctgctggcactgggagagcacggcgtactccttgccacctggaccctccttacctgggcgtcagtaagacgccagagagtccatgcgccttggacgggcctggcaggtcctgacctgaggaatagactttaattcaggatctacgatcgccctgccgcctttcgcattgctgtcagctaggcttttcagtttgatgtctggaagtggcgtgtctcttttccatccattttcatgggttcaccaggtgacagccaggggaaggagatattctgcaaggttcgctgccggattgagaaagcatctcttactgggtgcgcttggttgagactcacaggagttgcctcatacgccctgttgtgcagcttgctgatttctaaccctatccctttactatttcttcatcttttgggcattcaactcttttggtgtcgctagactaaaatgaagaatatctttttttttttttagaaaaattttctttaaaactacctgctagtgccacctttaggcccctagtaattgctgaggggatgtcagtaaacttttcccctgtgcatattcaaaagttgtctgtgttctcccaaagcccgtgtttgactgacaccattttattaaaacaggatttttcctcttccaatattgggagtaaacatggaatgggcaagagagggtttttgggagctgtgctatcgagatagcttggtgggtggatgatcctgatgtttctgtggctgtgttagaacttcagtctttttcataaaagatgattttgttaaatcctgtagacttcaagactaatatatcctcagtgccgtgttcaacactgagaaaataattgctcagtgctctgctggcaaatagatttttcccttacattatcattcacgacttactgaacctcatttaatcgttaaagcagccctaaaataggtaacataatgtttcccattgttacaactgaggaaactgagaaaatggatcataataaagcggtaactaagccaagccctctctcgtctttgtcttttgattttaacctcatatgttttctcctagacacaaatgactatgaactagggaggcatcattgtcaggaaaagcactagcttctcaaccttaatcccagtgactgtactaatttgtcttctgactttgcaaggataatttagaaacattcagaaatttgtagtgaaaaattgaagaaaaccatataaatgagggtactttggaactgtagttacactcataagttatgattatctgcgtgtgggggggacccactaagaaactaagttaaaggaatttgttgtggacagaagagtagatgaaaatatctgtgatgacttttcttcacacgttcttacctctgtgttcctttcctgacactcaaacactcctttcatcaccctggaaagaagattttgtcaggaattccatacatacagatagtgaggaaattgtacaatataaccagagtgtgattatttagggttatgtgtaataaaaatgaagtgtgaattaacaattggaattatcttaaaggtcagtaataggagaaaatagaacatggtccaaaaagtagactttagtctctgtggaaatttccccccgtttaaaatataatttttaaattgcttaagatgagaaaataaattttagtgatttagctcttctttcataaaagcacttgtattctatttaactcctgccattgagaaaaggtagctaaaacaggcttttgaaaggtagcaaattaagttgggggcaattatatttttcatgtgggtattttagcacatatgttttgcattaattgctgcaataaattctgttaacctggcaaagagcaaaaatagcatattgatgacatcaggcttccaaagcagaaagcagcttttagtatcttgctgtcttcactgtaacattaaaaaaaaaaaaaaaaaaaaaactaatgtggtggttaaccaaagagttagccattctttcaagctattggcatattttccatgaacaaagtgaagaattagcaacaaactttttcccccttacttccagagaattcatgtcaattactcattttcctgttatttgattttttatattcatatttgttactcattttcctattatttgatttttttatatttatatttgggttttcagaactctctcaaatcaaggcaaatgtaaactgactttaaaggctccaaactgagctgtcttcccttttaagacaaacatcttgactgattacatagcagggcctcaaaagggacttaagcaaatagagaattgtgggttaattttattactgagaagtttagttggtcaatatcaaaactgtttcttctcgatttttaatacattcattttgagaaggttaatataggttttttcaattaatagttaagaaaaatagatgaataagatctaaaggtccagtaagtgtaaactgcctcatgtaagactttaaaattttactttttgcctatgataaagttgattgatttccaatcaacaggaaattgtaacatttcctatctacctcagactgactaaggggaacacagagcagcttgttagcagttaacatgtatttatttcctgattttcaaacgcaatttagcaattaataaaactgtatagcttttaaagggatatattctttcattgcatctgatggcagtcttcacactgagggaaagtctgggaagctaatttgcaatgtcttccatgtggattatctaactaatcctctgggtaagcaaaacaccactcacaggaaaagtctatttgcagcactgtgtggtgtgttatatcaccaacagtattgtcctcttacaaaactgagctattcccaaactgtaagcaaaatttaatgaataaatatataccttttgacctcattatggcataatttttttttgaattacaaacaggtgatgtgaaaaaaacaaaaacaaccattgatttatttgtcactatctaatcttgttcattttccccaattgtcctctaatcatctataatattcaaaggtggcaaaaaggctagagttatatacaaactgagatttctttcccccttgaataagtcacagctgatcatggtagattttgctttttttacagaataaaagaactgacagcatcatagaaaactagaactagaattaagtcagattgttactcttttatgaaatctataaacaccaccaaatctagtaactgccaaatattggaaatattttcaaagatgcagtataaaaggacatagtatttttctcttggtttacttttactatctggtttactatagataatttaatactcatttacattcgataactcaaaaagataaacttagaggttttattatagtgttcttgacacttctgatctaaattatgatttgattgtccttgttctctgaaaaagaaatttccatgtgtaattatatgtatttcatctggctaaactagttaatccatgcttaacaatggtttttttctatattttcagatacaagtgattttctttgacatttgtacattgcataaagaaaatttttcttatctttcaaagtgatgttccaaatcatactaaatgttttaatattcccacaagaaaaataaaatgagaggaagaaaactaaaaagatataaaattagtaatattcctttaaatttttctttccaaaggtgatcctttggaaattaactaagcatgttttattttatgtttggccaggtgtgtagtaggtttactaccctaaccctattagtgaaaactttggaactctaaatgtaatgacaaaggcacaactttaagaatcattaaaatgagtcaagaaaagggttgatatataactaattgcctgttacataatgactcatctttcatattataataatttattgtctgtttatttaccaaacagtacttatctgaggattagttacccactagattttgaaaaaaaatatctgctagggagtggaatgctctgtgctcttgaagatgtcaaattcaatgggataaatgaatctaaaataaatacttatataaaaattgttataacatagatatgaaaattatgaaaatatgatatgaatctttagtggagggtgcaatttaagtcccagaacagagtccctgagagacagggagaatttttttaaggtaaaagataataataaattcataaaaacaaggactaggagattagaagctttgcttaagttcatgtggtggggataattttaacccagatttatttttaactgcatgtaactttaaaaataatttaaatgaatatataacaaagacacacttttaagcatgtccaaaataactaaatattcagaaatagttcttgttaagcacataccgaagctaacataaattctttacattacatgtgagtgcatgtgaatatattggaaacacatgtgactgaatatcaaaatagaaccatctccatataaaaacttctgtaggtgctattcctattatgactacactacccaaaaatatctcattggtctttatttgcattctgccatctctttcatcaataaattaaaagttttctgactattccagtgcggagtttgatgctttccattgacaccatgctcctaagatgcaaaggaaaagactagtgttttgaaataaactgctaagaatgtggtaccatatttgatcctttggggaccattataaaaacccaaaaacaagtcttgaagagtttgttcgtgtgtgtgtgcctgtgtttgtagatgtccatcaaatttgtattgtcatgatcaaaataaatgatacacctgagattttagacaatccagatattctgcagaatatgatgaagtcagaactttattctgattttagttttccagaaatttgtttaataaggaaaccaatttattctacagtggggttctttcaaaacaaatatgtgtgtatgtatgtgcacatgtgtgtttggggatgccaaaatgtccagaggatgtttttaaatttaaacttacttttgtttcaccactacattctttgtttcctatgctagaattttgaatctttatatccaacggacttctaggaactatgtttatttctaaaggaaatactacattagagttattctgtaggccagttttcttcttgtattctattttcccagccaacagtcaaactctggctgaacagatagcctgtgctatctggatgtcgatattctacattttatgataatatgattttttaaataccaagatagactgattttatggggtgaaggcaaaatgcatatgctgtagtttaaactgctatttcccttaatgactatttgtatttcataattgagtaatatgttttcatttttcactttttaatctttcaaaaaggtctctctgaattggatgtaaacaatcattctattacttctggaacactttaaaaagcaaaactgtgaaaaataaaatgctgtttacataataatgtcctggttttagaaacttacattttgggagacacattttactcgtctgaatgattcataatatcagttaacaatggagagaaacaaagagctgttatttaagtcaggctgttagtgcactaaaaattcactggcagtagagcatcacaactcatttatgtgaaaggattattttgttataagaacacatttttctactgatatcttgatacctgtttgttccataatagttttgatatcagtatgacctttatatttctctgattaaaagagaaagaaagaaaattttaacacttgataaacagcataggattgacatttactaaagtaagtttctagcagaattttgttctatgttatttcctgaatcactctagttataaaaacacagactcatcttattgtgagactctgttttgattccaaggagttccccctactgttggcaaagattgagatgagacagctaattgcaatttcttctataagatctttatagaaataaatccaaaattattgcccaggagaaaaagctaatgagaaagaataagttaagtgcagaaatcttcttatatcacataaataggctgttaaaataccacctgaccaaaggtttttcatagcaatgtttaacatggcagcatttaaaaaattactacatcagcctggcacggtggctcacacctgtaatcccagcactttgggaggccgaggccggcggttcacgaggtcaggagatcaagaccatcctgactaacgcggtgaaaccccgtctctacacaaaaacaaaattagccaggcgtggtggcaggtgcctctagtcccagctactcgggaggctgaggcaggagaatggcgtgaacctgttaggcggagctggcagtgggaggagatcgtgccactgcactccagcctgggcgacagagcgagactccgtctcaaaaaaataaataaataaataaataaaataaattattacatcataattttagctgttcatttgataaaaattgtataaattaacatttctgtgatataaaatgctgctaaatttaacacagtttacaggaacttttatctgcacacaattgacacataatagttgacttcgtttatagtacaacatttttataatttttatctgtgaaataaaatactaattaaagctattaaagtattttggctgggcacggtggctcacgcctgtaatctcagcactttgggaggccaaggcgtgcggatcatgaggtcaagagatcgagacaatcctggccaacatagtgaaaccccgtctctactaaaagtacaaaaattagctgggtgtggtggcacacgcctgtagtcccagttactcaggaggccgaggcaggagaattgcttgaatccaggaggcagaggttgcagtgagccaagtttgtgccactgcactccagcctggcgacacagggagaccccgtctcaaaaaaaaaaaaaaaattatgcttgggtagaaagaaaataaatacaaacaggaagtccacaggaacaattaaattaagaatatacaagcatggtagataaaagttatgttgcaatatataagtacatcaaaaatctatcttctctaaacttctcaatatcataccctgctgcttacagtaaaacagaaaagctgagctttgctgaattcctatcagaaaatataggtcgatttcttaattctgtattatgtttgaccggagaactacacagagaatgataacactgagtacaaagtttatttctttctgtatcattttcttcaatttgtgacatttaaatatacttagaagcagattgaagagctctgtgtagtcctgtaacctagagcaaagttattctgcttattataacagaaagtggtgaaaatcataaagataagtatttgtgaaatgaggctgggacaattacagtgatggtgtgcatagaaagaaactgtcattactctttagtgaaaacaagatgtaatcaaaggatgggcttatttttgttgtagtggttttatagttatttgtacttggctataaaagtcccttataactgaaggttttactagagaacatgtgcattattatatgagtttgaaattctttagccattaaagcctactgttaaccttgaaatgattgtttaataattatttataactcagtttcataaaatgcaactatagccttaccacaaagcctatgggtgtattattaggtaattggaaagatctgcttcagtaaaaaactgtggcatttaattttaaaaaccttttagaactctctgcatgtttgtggcacttaaaaatctttcaaggtgtgaatattagtttcactctcagtctttctaagtggacaagtagccactatgaatcagaatttagaaatgtcctttaaaaatctttatgtgttaataattctctaaaaatcaaaactccagaaacttgtacatttttaatccgccctcactaactgggaacatttgtttcaagcccttcttttagtaactgagaatttgaaataaaaagtcttagtttgttccttttactaagaagaaaagactatgtaaattatttgaataggcaattatttgtgacactaccaatactaatgagcaattttactaggagtggacttttgattgagtctctccattgtgacagaggataggaaaggaagagagaggatgactctgggaatcttaatcccacaatccaaaagagggggaaacataacagtagaaatcagtggcagaaatgacatctaggtttcctcctttccataagtacttattaccaatttgagccaatttgctctatactttcctcctttttttgtttgtttgctttgttttgtttgtttttgagatagtttcgctctgtttcccaggctgcattgcggtggcgcaatctcggctcactgcaacctgcgcctccgggttgaagcgattctcctgcctcagcctcccaagtagctgggattacaggtgtgtgctgccatgccagctaatttttgtatttttagtagagatgagttttcgccatgttggccaggctggtcttgaactcctgacctctggtgatccacttgccttggcctcccaaagtgctgggattacaggcatgagccaccgcgcccgccactatactttgtttttactcctttactccattctacaccttcttatttacgtcagaaaccaccattccttctttccagatcttagtaacttagtgcccatctgaaagtcaaatcaacagtccaagtaaggattgccttccccttcttatgaatataagccccttctagtcatacatctctatttaaaagcaattagaggcagtaaaacatgtgaaagaaaaacctagaaccatatccatctatacttaagatggtgttttccaaattcatttttgcccagaaaaactccagttatttatttaccaacttaaatagaatcatgacatttaaaaacatttccaatttaaatcactttcattaaaaaagtttatatattccacatagttttttgaatataaaatattctaaaattaacaaaataatgtgttttctgttacacaccaaaaatatttggcaatcacatcattagaatatgaaatctgggaaggggtaacttacagctttgataaataactggcatgagacagccattaaagaatgaagtcatgcatatgttcctatctagccttaagaaagttttctttttgtcagattttatcattgcgaactcgtattgtccagcaattgaaataaactatccaactactagtgcaattaaaattcagtccacagtagtatatttgtatgtcacaactcattagcctatcctgtctgtcctagagtttgaaaggaaatgatcaggtctagatatgtttagagaggggacagcattatagtaaccaaagttcttgcctgtatcagtgtgagatttaagatatgtattgcaatgttacattgagtcaatgtatgcagagaaatcgctcacagatttactttgaaattccattcattgtcttttcttacctcaattatgctgtatactcaaacagttctacaatggatcacaggagatttgaggtttgtatcctgggagtcccaattaagtaacaattcactttaaagtatttagaattcttagacggtgttatttttatttgggtacaaacaaaaggcactttataaatccaaagtatgtgcttttaaagtgtgttttgaagttaactattctactctactagatcatgtatttaggtcatgtaattgaattataaatacaatttagaagccacaatggaactgttgttaaataatattaatgtattaaatttacgagaaggaagtctgtacagcatgttataaactcatggtggatttaaagatatttatggtatttgaacattacagcaacattgcaagatactcagggtagatataattgatagacaatagaatcagtcagaagtaatgctgctaattgtgtttttctcatttatgctgaatagagtgcactaaaaatttaatttctgagtaaatgcaataaatttaattaatcttctacacttactttaattgactgtatggtctaacctattttggtttatttgttctcctttgagtagaaaccaaatgctgatgtgattagtccagttcttttccattgttcttattatcagaagaaacgtaaggatatggtagttcattagttgacaacctacattccaataagtaatttactaaatggagtctatgtaataaccatatcttcttcttctcactctggttactaatactgagattaaactagtgattgatcttaacatgtggagtaacatataattatcatttagtaatgtgcaattactacctgaacacaatgatacattaagccatttaaacccctaaggacattgcaaatataatctaataatttatgtatactggcaagctgatttctactatgcaaatcccatataaagctcagagaaattaaatgattggtatcacacaactaacaactgaactaggtatatcttttatcagaataaatgttagtaatatcctttaatttaaaggtgaggaagtattttcatattttcaaaaattttctaacagttatctgaaatataatctataacattgattaattggttgagggtatttaattatttttcagagataattgcaatataattaagcatactgttaatttccaaactgatatcctgggaaataattcaattatggaaattatactatgtaatccatgcagcggctatctatcttctgttttaatttaaatacaattacttctaattaggattaatttattgggaaaaaattctttaatcattaaggaattataatataaaaggtaaagtttatgtttgtctttcactagcaaaacgtaaagaatctaactttgagaattgtatttcttttaaattgtagtgatcaagagccttacttttacccatttaatttatttatcaactaaccagataatcaaaattttagtactgcttgaaaatttagaaacctaatgtctatcaaatatgtaatttatttttcttaacattttataagattaatatttccttcacaaaaaaatagttgagatgattttttaaagtctatcaaatacacaatttatttttcttaacatttaaaagattaatgtttgctttgcaaaaaaaaatacttgagatgacttttaaaaggatggtgcttttcatgtatcaggaaacactttataaacaacatgagaacatgttgtgcggtgtatgtatttacattatgttttggtttgtgtatatatgtaacccctgaaaatgattcccttctattgtatttattgattttcatggtctggttcatgttaataatgcatgcttagtttatgtaaccttccttcacatcctccattagtcaatcatgggattgttttctaatttaggagaaagatgaggtaaaaccatagtttccattatttaataggtcagatagacaattaaagtgaaccttttgttattgattgtatttgaaatgctgttgtatattttattttctaacctattacaaatgaatattcagtatggaaaataaacagtgttccatcttcttttaataatatattaaaaatgcaaccatatgcatgctatattttactttttgtatacaaatatcgattaaaagtcattagaactagcacaaagttctgagtaaaaccactaaagcctttgagtaaaaataattactttaaataagtaaagctttacacaggtgttattataaaacatagttttactttgatttctcctcaaattggtagttaagctttttgtgtgttacatataagtaaataatgaatacatttttaaaaaatacacattgcagaataatatgttgagtattagccagggatgatatgaaggtgtcatattagatataaataaacagataaattgactcattctgtcaacatatttaagaaatgaattaattgtggaatcatatgtaaatttatcaaatttaatatttttgaagttattttgatatgctagcattaatgttgttttctattatgcatttttattgtttcctctttaaacccataattattatgccagaaattgccagtatattgaacattaacctatccttgtaaacaaatgcaaacagtttaaaaggacacagaaacttttgatctcttaactttccctgtgtattttttgtaatttccttctttttatcctaattatagacttataatgagaaggaagagttatgttttttgagcaacatcaacaacagacaatgtgaactcaacagaagcaaatagaaataattcactgttattaactgtgtttgtgtattatgttttattttagtcaatctactggattcaaaaacaattcaaggggagctgggctggatctcttatccatcacatggggtgagttcaataaactatcacaaggaaacattttctctattacctgtcttagggagcagatgaatttattgtattctctaaagagaactcttgtacttctggtgacaaattatacttataggagtattcaatatatggagtaccacagcttgacatttgtgtccaatggagctagtgagaattttgaagattttttttctccttaatttatcaattgcttgaatggactgattaaatagtttaattattattggcatcatgtcaatgatctaagagtgactttttttgatgtgatcagaataagtgaattaattagactgtctaaatttcaggtaatgtagaaagtgtgtatttggagacggtaatctccaaagtcatagccttaaaatcaacctcagtaactgctcttccaagtagttagaatttattggtcaacagtataaacctatgttgtcttaatttacttgtttcaaatgtctacagtttgcctagatcagctcaaaaatgggaatattacttagaaaaaatctgctgctgcctttaagttttaaactttttacatagctttggtattttatcaatccagatacaaattacagagtgtgtagcatattggtgttctgaatgactataatgaggcttttatgggagaacatttttcttttattttttctgaaaaatgaggggagtgttatttacatttctcaaactcttttccctacacaattgtgtaataaattcctgagcatacctttttgtttctaagtatagtttgtgaaatatgtgaagtactattttgaaatatttgtcataggaacaaatttatgtattcctgtccttctatgatagtcgtcttttcaagagattgtaattacttccacttcgtgttggcgttcagtctttagatttttgtgcctaaatatacacaattttttgatagcaccagcttcttcaccagcggatgttttccatcagagatacttcatctatctgtcatctttgtatctgcttctcttcctgacacaccttgactttgacaatatgccaaaacctaaaatcaagccttcattagttactttagaggagagagtatgaagtaagccaggatttggttttcccagaggtgtaaaaggaatcaaatgattaagataaaagcacagcctaggttgtcataaagagtgaattgaaactcaagtttgagctggaaaactcatttgaaactaatcatctaaaagtcaaacctcaccttaatttgattttagaaatttaaatttttcatgactccttcagataatataccagagaatctgctgcttcaggatataagaaaagcaaaagctatggtaacatttagtaactatatattagtatatggtatactgtataccatatatagacatactatatactatatatactatatactcaataatatagtatatatattactatattagtatctataactaatagatatgtatatgtttctttttaaaacaagaaatcatcttatatttcacagcaacagtctggcttatgttttcctttaaagaaggtataatggtaacacattttttatattgggaattgggggaaatgaattcccccattgttattctcatagataatgtgatgggatagagttggcacatctacttccagagctatgttggaggtagacagtggggtattcttagcaccttgctgggtaaagtgtggcacagggacaaaccagcaacatcaacatgtgggagattgttagaaatgcagactaccagaccctgctccagacattgtgaatcagaatgtgtatctcaataggtgactctttagcacattgaatttgagaaacactcctctgcataaattacctcttcacatttcccatctctggcccaatttactgtctctttgttccccagaaatctcttataacttccacagtcaaaagttttcagtttcttctttggtttactgttgcctcagagatccccacttggacccattagctcctcttcattgctgtcctctgttgatcttgcaactgtgattttcctatttctgatgcataaaatagcctaaaacagttggtcattctcttcaagcttatcattattatttgcagggagaaaagagacactccccaatagttcatgaaacttacaatacctgagaactccgaagctaaaaaaaagaataaaatcaaatgatgtgaattattgttctgtggtgatatatagtgtatatttcctttaaatttcccacatataaagttaaccataatatatataaggaaatatatagtgcagatttagaaaacattagattgttttttttttttttttgagaaactgaccaaattactgggtgaaaataatgtatggtaagtttaggttttggatttaatagcctggcatatacaaatatttgtgcctctagattcaattaattattgttattgctctcatttttaatatgacaaggatagattagttttgtggttgtattgtttttaaaggaaatagatacttataacaattgtgatatccttgctgaaacgtttttcataaaaaaaagacaagtaatagctggaaataactttgagtttgttatttttcaaattaattaactctaataactggcagtacatctgactggaggataactaaaatatgactgtaaacttaagaggaaaaaatcataataacaatattataccatattaaatcactgcaaattctcactcttgatttagggtagtggttcttaacaggttgagcgagtaagggaagagggaatttttattttgcctcggtgggatatttggcaatgtttgaagacttttgtaacaactggagaaagcaggcacttttacatttagtaggggagacaagaggtactgctaaatatcttccaatgaacatggcagcccctaaaaagaagaatgacctggtctaaaatgacagtggctaaattgagaaactcttacttaggggattaataatagcattccatcaggaaatgtccataactaaggagatttgggagactgccagctccctctctaacttccaatcatattctcatcagaagctctaaattccaaatctgttgaaatataaattttaaaaaataaataagtgattcatttcaaacttgaatctttcatggaatgcttgtatcatctgagctataaaaaattaacatatttggagaaaaatggtgaagagtagttcattcctacatataatttcttttctatttctattcttccttttcctccaaagacgtattcatacatgaaactttacaattcacctaggtaattttcttgggagtagtatttctatctcctttttttttttttttttctttttttgaaatggagtctcgctctgtcacccaggctggagcgctgtggcgcgatctcggctcactgcaagctccgcctcccgggttcacgcaattctcctgcctcagcctcccgagtagttgggactacaggcgcccgccaccacgctcagctaatttttttgtgttttttagtagagacggggtttcaccgtgtaagccaagatggactcgatctcctgacctcgtgatccgcccgccttggcctcccaaaatgttgggattacaggcgtgagacaccgcgcccggtccctatctccatttttaaatggtgcttcatatcttagagaaaaccttgtagggagatatgatactacatatattattaggccttggactaattctccaaataaatatctgggagtaaatttaatgaaactttaattttctctaaatgaaggtcatgaaaataatactcaaatttgtaaactgaaattatttgtggaggtcgtgaatagcaattcatttttcaatgaaagagttttatttgacactcatataatctggcattatatttggtgactttagcaaagcagactgaagcagttaccttctctggccctataaactatgaatgatatgatatttcaatccagggcttaattttattcagaaatttgggtaaataattcaatcgttctaatattaatatttgatttggagaacaatcaacacatatcaaagcctctatatattgttaggttattgtttttttctaaaaacagccttttgcttacacatgacttaaattgattgtacttaaattgattgattgattgactgattgatagtgtctatctaccacgtaaactttcttagactacatatcactacataaatgcattggaggagagatccaaggaaggttgagctacacagttttcacttagtatagtattgatattgtgattaactagtacaaagaaatcatgagctatgactcacttaattaaagaaactccaataagaagagagtgaggactggcagggttcagggagtgtagaaaaagcactgtctgaaatgagtaatatatgtttgtggaaaacagaaagaggtatccgaattagtaattgtggaattaaagtttctttagatatttattgatgtcttagcggtgaacatgcacttaaaggaaaacactcttttggcaaatagggagcttgttgattgcccacccaatatctgttcgctggattctccttgctgatgaaagaaacatcgatattgttcaagttttcaccctcccaggtgttcctggaaaatggcccctctgcgactccatgggttgaatgctgattcatcttggaactaatcatgaccatgatagttattgttgcagggattggttgaagcaagtgtaagtaaagccaatgagactggtgcagaattccagtgatttctaggaaaggttttcctcctgatggagagatagggagagacccatcatttcctccgtttgggcttgttctgtaaaggctctgggtctgcagcagctgcatttctctcgggactagaaaggcagagcccagtgagcataagagaagccagcatggaaccttgatatcactgaaccactgaattacgtgaaagaatgcctcttctttgttatttaagccactcttagtgtttttcatgctttcaaataaaaggcatccttacaggatagaatgttttatctttgctcaaatattctaatttctaaatggaggctatggctatggcataattgtatattatagtgttatttatattttccagattgtcttttttggtactttagtatgatgtcaaaaataatagagtagtaaaacaggttaagaacattggttagaattgaggcatctgcatttccattctatctctaccacttattatataatcagatgtaagccaattaatcaaaaactgaccaggtggctcatacctgtaatcccagcgctttgagagaccaaggcaggagaatcacttgaggccagggcttcaggatcagcctgggaaaacacagtgataacaccccatctccaatcaatcaatcaatcaatcgatcaatagaaattagcctggagtggtggccttcacctgtagttctagctactcagggggctgaggtgggaagattgcttgagcccaagagttccaggctgcagtggggtacgactgagccgctgcactctagcctgaatgacggagccagactctgtctctcaaaaagaatttttttaaatcttgaaaaacatttgtcttcacctctaaaaaaaggaattagagtaattcctatgtcatatcactttagagcaaatgagatttgagcaactgaaatatttctatgcatctaagaatacaaatacatataatacatgtgaaagagctatataaatatcatttcttattctaagacaagctttgaggttctcccattttaattcaaactcttgctaaattcatttacatgtctccttaaatctcagtctacacttgaggtcttgaatttgtatttaggagaaggaaagttgacagtgttgtgtgaagtctcagcaggcacctcttctaaattcagagcccaatacattgcctctgatgtcacttcatttttatttcatataatctgcacagacaaaagttcgcatacaatcttgctgcaaaaggaattgcggttttggaccacgaattttaaatcattattactaggctcaaacacatctttattagtcaaagtaggaaccattacaatcatcacatttttgtcaacgagaaataagtttgtttattcctgtagaataaaaatctgtgcttcgggattcgacgaactcttggaaagcattttctgcatcctgctagttgtggaagcgatttccctgcaaaaggttctggagatgcttgaagaagtggtagtcggttggcgagaggtcaggtgaatatggcagatgaggcaaaactatgtagcccaatttgttcaacttttgaagcattgtttgtgcaacgtgtcattgggcattgtcgtggacaagaattggaccctttctgttgaccaatgccggctgcaggaattgcagttttcgatgcctctcatcaatttgctgagcataatctttgaagtaatggcttcaccgggcttcagaaaactgcagtggatcagaccagcagcagaccaccaaacagtgaccacggcttttttaatgcaagtttggctttgggaagtgctttggagcttcttcttggtcgagccactgagatgcttgtcaccagttgtataaaatccacttttcgtcgcacgttacaatctgatcgagaaatggttcactgttgtgtagaatcagaaaatgacacttcaaaacaacatttttttttttttttactttcgctcagctcatgaggcacccacttatcaagttttttcacctttccaatttgcttcaaatgccgaacaaccgcagaatggtcaactttgagttcttcggcaacctcttgtgcagttgtaagagaatcagcttctatgatcactctcagctggtccttgtcaactttctttttttttttttaaaaaaattatactttaagttctagggtacatgagcacaacgtgcaggtttgttacacatgtatacacgtgccatgttggtgtgctgcacccattaactcgtcatttacattaggtatatctcctaatgctatccctccccactccccgcatcccacaacaggccctggtgtgtgatgtcccccttcctgtgtccaagtgttctcattgttcagttcccacctatgagtgagaacgtgcgatgtttggttttttgtccttgcgatagtttgctgagaatgatggtttccagcttcatccatgtccctacaaaggacatgaactcatcattttttatggctgcatagtattccatggtgtatatgtgccacattttcttaatccagtctatcattgttcgacatttgggttggttccaagtctttgctattgtgaatagtgccgcagctttcaatggccggtcactatgctcctcatcttcaaggcccttgtctcctgtgcaaaatttcttgaaccaccactgcactggaccttcattagcagttcctgagccaaatgggttgttggtgttgtgagttgtctccactgctttacaatccattttcaacatcagtaagaaaattgctccaatttgctttttgtctaacatcatttccatcgtctgaaatacatataaaacaaacagcaaataataagtcattaccaaaaacaaaacgagaaatgcacattaaaatgatgtataacatatttcacacttaattcagaatgtattccaatatcaaatggcaaatttcaacaatgcaaacactgcaattacttttgcaccaacttaataattgaggcagtttaaacatagtaatttggtatgcagtttatttataatttttagtgatgagaatgttctcaaatattgatatttcagatttcaggtcaaatgttactttttcatggagacctcctgacttttcacaagccaccctcctgccccaccacctcctaaatgactgtcacccctattcctagcatacaacacctgataagttcctctacctccttatgcatgttctttgttgtatatccacagcttacaattatacattaatgcaatcatttgattgatctttatttcagccaggaaactgcaagctgtgtgaggccaatccccatttcatgaaattctcccttaactctcagcatttacagttcctgtattaattgcccattaattaaaattatctaaaaaatgaataataagagctttcccaaataagagagctaacaacgatttttgttttgttttgttttttgaaaataatttgatgatttacactatattacttgaaataatgtcttttagggatttcattgtctcttttaatggcataaaattaagtacaattcttatatataaacgcatatatcttgaataatctataatatatctatattaaatatattacattgtcttttttactagcagacatatttagttaaatgtagctagaaaatacaactggcttgtgaactgaagtttaactgaaaaaaaaaactatgtaaagatagcttcatattgaaaattatattgattgttatcaaggggaaaaaagtgagaatcctgtaaataaatccagttgagcaaatcatagaactgtttaaaatgaataaatcatagacaggaatgaaaataataaaaatactttctaaaataagtaattacttttctactttacagtatgatgttatttgcctgtagtattagaattattgctatttgggaagtttgggttctaaaaatcttaccaactggatttctagctttcgctttgtgaatggggttttatatgcagaaataatattttgacaactgtgtgtcagcaataatcacctgggattctgcctttatgaatcacagtccaaattctacttcataggctgaatagtcaatccaggaacatcaaatttttgacatatgtgatatgtgattcttggtcacttgaaatttttctgactaaactctattttaagtatgtcactttcacctattatgctgacctttcaaggaaggatgtctgattaaattagaaaaacatggcaaaatcttacaggcttttttttttttttttttttttttgaccctttccttgaaacaaaatgcactctgaaaaaaaaaagggaaaacgtggacaggtgctagaaatcagataagatagaatttattctagcgacttttaatttataaaaagtaaaatgttttcttggtgctttaaaaaaatagaagtgatttttctgttgctaacactatgtctctttatgaattgtgttctcttcatcaaaacagtgtttatgttttaggagattggattagaattttaaaaatatggcatgtactatatttcatttcttttactttgatgtaagcttagtgggatttaaaataaaggagacttgaaacataagtgcatgggttttatttcctccagctttactcatgaattcatttgtgctttataatccttacctaacatatattaactataaagttaaataaaaagctaagatgtagtcaaataattttcatttctattttgacagtttaaatatttcatatatttgctataatcattctttatttttttaaagtagatttaaaaatttcaaatagaagacaaaattctgcttctgctagtttctcatattgataacattttttctctaaaacaaataactttggcactaagctctgttttgttgtgcaacttcaaattagcatattttctggtcaaaaatgcacagttattaaaataaaagtgaccaaaaatatacatattataattttaaaagaatggctttcatattcaattcattatacattaaatgtgttgaaacatgcaaaatagtgtatggcagactgaataggtttgtgcattattaagaaatggcctattcctttaatattttataaagagtatattcagactaaacattatgttttcaagcttccaaatgttcttttgtatgaaggatataagaacaagatacataccctgatggaaaggagtttcaactgtttcattccattacgtgtaaaacaagaatttataaaaataattcacacaaaagctttgcttatttaaaatattgcctcctttatgaaaatttttaattatttggacccttaggcttattacactctggtgcttagtttcttttgaaagattaaaaaaagaaattaaatttagtctataaaaactatggtatagtatactttttacgtaagtcccatgtcccaaatgatagtcattgaacctaagaatgcttaatggctatgatgtatacaacataaaccaccttaagtatttctgcaaccttaatagctgtagattaccattactttttttcctacatatgatgctcactttattgagaaataattatgtgaataaaaatattaccaaagtaatgtatgagattccttgggagttgctaaaatcattcatctccattgcatgtgacataagaagaaaaatgtcaaaggggctgatacacttggatttttctgatatacttaaaatcatattattacacattatttttattaattttgttaataaggcagtttgatatacataaactaacagatcaaaattgttacctttaaacttgtatacagtagttgttagaaatgcaaaattctgggccccaatcatgacctgttgcattagaaaccctgaggatggggcccagcaataggatttttaataggctgtccatgggattctgatgctactcaagtttggggattgctgtgttagaagatcgttatctgatgtaatgaggcacacagtacttactaagatattcagctgctgcttgattcagggctgtagttcatctcaacctctaaatacagcactgtgtataattcatgattaatataactgttgatatttttaaaatattggattttacaataaacacacaggaagagaaaagacgcgtttccctggcaacttgggaaatctattcctggaaatttgtcataggaatttatttccaagtcatcaaatttatctcatgtattcttggaatttagtttgaaccacatgtagtatcttcaatatttacaaatacttgtacagtatttatatatctggaatccattgctcatgataaaagagatgatactaaaacccaaaaactaaataaacaatgaattaagtgataggaaaatgggaatacagaattggaaagtccctgtcatgcagttactagaatataaggttgtctgggaaatgactattaactgttcctagagtgttactaggatcagactgtgatgaattttgtgtgccaccctaaaatgctcacatcaatcaaagacaacattttaagcaggtgatcagggaggatagtgtaattgaagaacaaataggaatcagaaagggcactgtaaaagttcccattataggttaatgggacctagaatgagccttttattctttggttatatatcttgaggatttagcatcaagtagaacttttattattttgttaagactccaggaagggctattcttaaaaatcaaatcttcattattttcttttcttttatgttaatcagattatagtatttattataaaggcacaaaacaaagagaagtcatatgtggaaaactgagtaacttgtaggacctatagaggactcagtgaacatgaaaattatctagtaaactaaggaaagcaaaagaaacaaacaaaagagtgtgtgttgggggacagaaaagtactctcgcagtagaagttattatatttcccttctgtataacagtcaatattcttttgggcctaaggttaagaataagctaattttttaaaaaatgtaaatggctacctcccttctcaatgtaaagtgacaagaccaagaatccagcaatcggggagacagcctagcctattcaagaaaggagagatgcaatgcaatgttttaaaagaattttaaccattttggatggtctatacttggatactattccatgccatggaatcccaggaaaactgatagccgcacacttcataggtttactcaaaagtcttcaataggatttaaatcttgtgggtgatatgagtcaatttggtaaactgtgtttgtccagaaattccctgaataaatatgtaatctgtatccgtattgttggatggatgtactaggtagccatttcttaagttgaattagtaacacaattttgatggaaatttgcctatcctgagtgctgaaaaggcagcaaataagccataaaaatattatatgtagaatcttgtgaaaacgtttattgatagagctgcttccattttccattaaaggcagcaaaattttactttatttagagcagtaaaatatatttgaatgagtaatcaaattttagaggtggcagaagcggcagcgactatagaaatcatctagtgcaatactctaattagatagacaagcaattgaggctcaagtaggcttagtgacttgatgaaggtcacgtcattaccttctgggtctgggttcggtgctcttttcattcctcctctctgtggaggagtactggtctgtgcacagtgacaaagaaggatttaagattgtgtagtttaatattatcagattatactttatagaatttcaagactacttcaaccgagtgtcatgcattgcagcagcacccaagataatatccaaatctggagacacagcagacaaaatagagctacttttctcagcaggtgaaaaatgctgatctttcataagcccaagagaaaaatcaggttgtataggattattattagctttccattctcgtgaatgtgtatcccttcatcacaacttgatttatgatccagagactgagctgtcacttgacgactaaagattcttaactcattttctgacaagtagaaattgattttagcttgaattcaaagattaatctaaatctgcttgcattgaaagagtattttcaaatgttgctatgtaactaaaataaatatcacatagtttcaatttctgtataagccaattaatttttgaagatcttttaaaaattagtatatcattttcctacaactagtcttaaaacagaaggattggatatgttatcttctagccagtaaattctcaagatttaaaatatctctaaattgttggctttattttgtgctttctgaactgctaaaataatcactaaatacatgttgttcatatgtagctttcaaaataattggataatataaattagagtaacaagttagtccttcaacaatttttggagactaaaatataaaacagaacaaatgagctttataactcccaaaaaacctttgtggtgaaatttgctttagtgattatctcttggaaaataaacacttttattttctgaaataagtgattctgattcaaagaaaagtttaggagaggaaaacatttaggggaaggttaagtgtaatagcattatttcagaagtgaaaatatatgaggtaatattcgtttctagaacctatcaaattcttaatagtttatgtagcatacaaggggcttgtagaatctttagtacactgaaatttgttcactctgttatccaacaactgctttagctcctgctgtgtactaggtactattgttggcagtagagatgcaaacaatacaatagctaatatttctctaaagggctatatactattcctagtgctttcgatatatcatttcatttaattctcaccacaatcccatgaagttttacaagagagaacagtaaggcccaaagaatttaaataaatcgaacaaattcacaaatctagtaagtaaaaacatcaggaatggaaatcagacaatctgattcccataaaatgcacgtcaccactactttatactacatatggtaagagaagtaagctatttccaaggaaatcttaaagtttagtggaaaagaccaatacagagcctcatacattatgccaagggtttggcttccatcttaatgcaaaattgttatgaagtctgggaattaggatgtttactccatggacttagactagaggtgcagagatcagacggtctaccaaagtcatcagagaaagaggtctaacaagatatggaaaggaggtaatagatgccaggtgatttatgctatctgttctataagaaagggtgtcaactaggcagaaagggggtagagaaatcaaggataatttccatgatattgtgattgatgataactgatgcatgtcttggtttctcctagatcaatgtttcccaaactttagagtacatcagaaccatctgaaggataccacccttatagttatggattgccttgctaatggtgcttgtccaaagatcacactttaagaaccaatgtcctacattaatactaaggctttcgcctgcaaataaatttaaatggcttggtattatgaaagtttaaaggacagaacttcaatgaaactttaaaaagagatgtgatctgttatatatatatatatacacacatacgtctaggtgtgaatatatctatgtatacatctacacatatatctgcatctataacacatatcctaacatacccagtggtatcccatgtgctatttcaatatatgaaattgtttcatggcccctatattataaataatttctaaattgctggaaatttagaagataggaaatttttacacagattcctccaggcagttgaagaaatttatataatgtacttctagagttttagcagagtcaattatgggtattttggaggtagagtatatatagaagctaaaaataaaacttttttctaaatattaattttatattgtatgctatttgctatctaaaactgatagtttctaaaaataattataaaatatactcatgacatttggttgacaaaagggaggtaatcatgaaactttaaatagaattttaaacaataatagccttaggaaatgtctaccatatcactttttcccccaacgttcaatttccctttgaaaagcactgaaatgatagatacaacatttgtagaaattatgattcttaatagaaactttggtctatatttaccgcaatgtttaaatgggagaggagttattgtttaatctgttactagatcaggggctgttccataggaagtggctgtaaataaacagagcatgaaacctctcaaggcacttataagtaaatgagctaacttttgtggccataggcctgctttaaacataccaaaaaaaatctcatgagtattaacattgatttcatcccaaaatgtttacagcaaagtaaaaggatgttttaattgtttaattattggtctttattcaaaattgacataaactgttacttatattaacgtgcttttagagtacttcctcaggaaatagacacttttgaattgtcatcttagaagaataggatatctctcatcaaatactgtggccaaagtgcaccaaaaaaagaagatttttaaaatgtaaaagccatttatttaaattgtacatactttatttttattgttataatcattaggaatttcatggattgatttagaccagtgagccatcaaatctttcaatagcctcacgcagtagagatcccctttatgccttttcaaaaaagagcatggatccggcacaatgctaaatgaagattatgttcaaaaaattgaaatgactgaacagttaactagctgtaacatgtttaacaatagaatggggaaatcctcttttaaccttttagctaattattaaatatcttaatatgaaagaatctaaatattatttatagaatattctataaaatataactaatgaaaaaatgaaaaggttacctgtacaaaaggaactataacattatatttataaaatctttaagtccggaattctgcacgatacctacagagtttgggaaaaaaaattaaattgtttttaatgagactagatttctctttacttttctagtaatacttttgtgtttcttttggaatatacaatgtagctggtctataagcaataattcaaattaaatagaaagctgtcatgttaattaatataacccaatctgtactactaagtggcgttgaaagatcttgctttcacttgattctaggtgattaagaatcagtcattagtaatgtataagcactttttccctagatatttcagagtcaaaagaaagctagaaacaagtcttacccacaaggaccaagtatactagtgtgttttgtcttgttcttgcactagagctatcaaagtcaagaaagaatatggtctatagtggttggaaatttcattctagctgtcaattatttcatgtataatgcgggttttaaaaaaattctttttaaaataattttagatatacggaaaagttgcaaagatagtacagagttgccattctctccacctactttctcataatgttaaatcttacataactgtggtacactatcaaagctaagaatttatgtaggtacattactataagctacagactttattcagatttcactatattttccagttacttcctttttctgttccaggatccaatccagggtatcacattgcatttagtaggaaggaatttttttcttttctatttatagtcaataatatattttaccacatatcattttgtcatcagtttaactttttaaaattaataggtttatttttagagcagttttaagtttacagaatgattgaacagaaagtacagagagttcacatatattccccatttacccccacagtttcctccataattaacatcttgcattgctggggtatgttttttgaaaattgatgaaccaatattgatacattattttaacttaagtacgtagtctgcattagagttcactctgtgtattctacagttctgttggttttgccaaatgcataatacatattttcaccatttcaatatcatacagaatggtttaattgccctaaatatcccttatgctccacctactcattcctttcctcctcccactcatccatggcaaccacagatctttttgctgactgtcgttttccctgtcagaatgtcacttagtgatatgcatgtaagattcctgcacatcttttcacatatgatgctgttttgtgtttgctttgaccatctatgtatccttccagttctacacatgccattttgaattctgagtttacaaaagaagcctctgtccttgtgtgccttccattttgtacttattgaggtgtgcttctttttgaacttagttttcttttggaattattaatggtaacattacaacaaacctttcagtgcagtttactattagaaaatatctgcacatatgaacactttcatttcttttcatattatcacttgtaagatgacagtgtgcatttcttttacatttcttgttatttttacaataccatactattatttatttttgcttaaatggagtgctgaatactaggcttgctcctcgtttccaaacactctgtggttgtgttttgttttggtttgattctttttacagtaataacatatggcaattgtttatattttcaatgcccaaagctgattattaaactttgggtgtttaataagagttgaggaaaaaagtccagaataggcataatttaccaattgaaatataccagtttattgacctactttagttgaactgtttgaaataaattaagaaataacaatcatatcgttcttatagtatcaatagtaagcattgaataaaaccactggatttgatcgatgatttaacagggtaaaaataaaattgaatttaccctcataaaataagacaagttctttttcctttccaggaagaaaagaattcatcctctaaacaaaattttgttttcttgatagaggaggggagacagggacagggattaaaaagttgatattcttttgcctacctgagtcattgttctcaaaactttgctgctaatgaattactttattttctataattcaaacaagttagaaacattctattttagttgtgtgtattacatatattcacaaacagacacacacacacacacataatagtgtatttacctttatatagagattcttcaaggaaatatacaaaaatatttaaaataatatccatcatatcaacttcttaataaaactactgtgtgaacatactcaatttccagatatgtatatacacatatattatttgagctaaatcaattcttagcacagttatttaaagcaatatagaatgatcttcataatatagctctttgaaagatcttatcttgcaatcttttctttataaatttgtctgaatttataacattcaatagcttatatccttccattcttttcactaagttgatttaaatgagtcaaattttttaaaatctgctttttctatattgtctatttcaaataatgtattaaatatccacttagtcacctaatgtagagacctttgagtcaattcttatttgttgttttatttttattcatattcagtatttatcgtttcctgaggaatttttttttctcaagtgtgtctagaatcgatttctcactctccatttcactgttgctttatttccttcagtcaaacaatatcatcaaagaagacaccactgtgtaataatatctttggctttaaaataagttgcataatttagttaaaaaagaaaaattaacatcaaaataataaaaaaatgagatgtagtgttaaaaatgaatagatgctaattttggaaaggaaatccttacagtagttctcacttacatgtgattttgatttctgtgctttcagttaccagaagtcaacagaggtctgaaaacattacatggaaaattctagaaatagttcataagttttgaattgcccactgctctgagtagtatgatgaaatctctctctgtcctgctccatcccactcagggcatgaatcatccctttctccagggtatcctccatgtatacacaggaccagcccattagtcacttagtagctgtcccagctatcagactaactgctgcagtttcacatggcttgtgttcaaataaaccttatttaacttaataatcccccaaagtgcatgagtaatgatgctgccaattcagataggccaaaaaaaagtcataaagtatttctctaatgacaactgatgatgagcttttattcatatatttgttggctgcataaagtcttcttttgagaagtgtctgttcatatcctttgccaacttttttgatgggtggtttgtatttttcttgtaaatttgtttaacttccttgtagattctggatattagacctttgtcagataggtagattgcaaaaattttctcccattctgtaggttgcctgttcactctgatgatagtttcttttgctgtacagaagctctttagttcaattagatcccatttttcaattttggcttttgttgcaattgcttttggtgttttagtcatgaagtctttgcccatgcctatgtcctgaatggtattgcctaggttttcttctagggtttttatagttttaggttttacatttaagtctttagttcatcttgagttaatttttgtacaaggtataaggaaggggcctagtttctgttttatgcatatggctagccagttttcccaacaacacacatatgtttattgcagcactatttacaatagaaaaacttggaaccaacccaaatgtccatcaatgatagactggataaggaaaatgtggtatatatacacaatggaataccatgcagccatagaaaaaatgagtccatgtcctttgcagggacacagataaagctggaaacgatcatcctcagcaaactaacacaggaacaaaaaaccaaacaccacatgttatcattcataagtgggagctgaataatgagaacacatgaacacaggaaggggaacatcacataccagggcctgtcgggggtgggggtaagggaaggcagagcattaggatgaatacctaatgcatgcggggcttaaaacctagatgatgggttgataggtacatcaaactgccatggcacatatatacctatgtaacaaacctgcacgttctgcacatgtatcccagaacgtaaaggaaaaaaaagccacagagtgcttttctaaatgtaaggtttctaagaaaagaaaaaatcttacaataaagttgctaagatgtatggtaagaataaatcttctatccatataattgtgaagaagaaaaaggaaatttgtgctaattttgctttggcacctcacactgcaaaagttacagccacagtgtgtgataagtgctcagttaagatgaaaacaacattaaatttgcagacacgaacagaatcgtgtttcaattgaccgcaatcagttcaatactgtctaggatttcaggcatccactgggggttttgtaatgtaccccctagaaaaagggcagaatactgtatttacatttaacctgacctcaggaataattcctcacccctgaggaattttggtctagaagtataatatagggcatcaaaagatgctagtatgaaggtggaaataatgactactaacaattgagaaaacaaaatgactcatatattagtgcaaaataaattcagtaaaaatcagtcagttctttgacagtagcatggagtagctggtcaaaaaggaggaaaaccagaatggaaaagtctgtatgttttgcctatggaatattaaggaaaaataatggatcgtgcattaggctaggagagtaaaacaccatgagaaagaaaaaggcatttgggtgtaatgatgttatattctagaagtatacaatgtctagaatgtacaaagatttttagggaaaaaatgcatgaacttgtgtgttgattaaatgcaaatatcagtcagtaacacacacatgtgctctctgtgtgtgggcatttgtgcatgtgtgtctgtgtttttaaaatgtattattggaaaactaaaatatttattaaaatgaaaacactaacatataaggcacttaataccagggtcattattactgagaataagagtctattcaagtacctgtttttaaagtatctaaaagataatggagagtagagtttatgaatttactgttttactggaaagagtctcttcttgggtttaaaaattttaccaattaagcagagaagacaagaagcattaagcaaatttatttaaaagcaaacaaaaggaatttatgaataaattaagattttatgacaatatcaaaagttatacaaaatgtttgtgtctttcatgaaacagacatccaaactgaaattaaatttagttttctctaggttttttcttcttaaagattgaaaagttatcagggaaaattgtgcttttaaactttgtgatgacatatgcttttaaggagcctgtataactttcagaataataaaacaaaaatggctattttagaatattccttgatgatgaattaatcttacattgttttccagcatacccatcttaggaaagttctgtttatcatgtcacttatagaaacaactggtgaatgcatctgaattattttcaattcctgtcacttgcatgtcaacttgcaccatcttccgccattcctaagttaggtatttgcaaatagaaaatagacattattgtttatttggagtcataattataaacatataacatattattatttcattggagtcatatatataataaactaattgtgaaaaatagacatcaggaacctgagaataccgagtcagagaaagctagaatgccataatgcaaattttgaagccagcgcataccaatcagagattatagttcttcaaaagagacagaaaaatgggagcatggtttttccattgaaacagaagatactattgcctaaacaatcataaaatattatatggttcaaaggattttatagagtgctggtttctacctgaaaccagatatgtctgacatggttgtatgcacgtctgctttgaaaaatattttcttagtctataaatatttaccaaaagcaatctatttactgaagcggtaccagacattttggaaagtattactttgaggatggaacaaccactattttataatctcagtcatcttttgggtttccttttctgaaatagaaaaccattgaaataagacacataggagtggtatgtcatccatcagacactagtatgtgttcttcccttcaagtgcttggtgtatattaaaaactgcccacattaaatgcatagaataatctttttttattattattatactttaagttttagggtacatgtgcacaacatgcaggtttgttacatatgtatacatgtgccatgttgtgtgctgcacccattaactcatcatttaacattaggtatatttcctaatgctatccctccccctcccccctccccacaacaggccccagtgtgtgatgttccccttcctgtgtccatgtgttctcattgttcaattcggcattacaaaattcctgtggaaaatatgagttgtgggtatttatctttataatatttaaaaagttataagaaactaaaattaagattctttaaaagcaaaaagaattcactggtgtgtgactatgtgataaacaatggaggggtgattgatattaattaataagaaagtttaggtcaaatattctgctctcatctcagctgttataataaacaaattaaatatttagtgagagtttgcaagtaaaagcaccgaaatatatttctgtgtacaagtaccagcttgttctcaggtaccactaaaatctacccttaagcagtagttgtttcaaaggtcctgtggttgtacatccatttccttgtatctctggctctctttttagtgacaatttggatgggaaagtatatgattcttaacggatattgatttcatgctaatgacttcatgattaattatttaagcatctaataagtcaaattatgttaaatcacaccacagacattgcagatatgaaagtctaagtggtagccaacaatttcagattttcatggggtatattttgtcagatgaacaaataattcaaattttaagctagaagtaaagtcaacatggtctttaggaaattcagacaataaaatttgatacatattcccaagatatatgtaacttttatttatatgttttttgtatagttggataataatgtgcattcgttattggaaaaaaagataaatttaaaaggctaaaacagatatcaatagagggtacccatgcacctcatttgggagaccttctagagtaggtaatagctaatatccttcattttatgaccaatagtgatttctagaatttaaaaattcatataacttccccagatgcacatatacatattattgagaaaactccaaaatgttgaaaatggatccatattctatgttactgaaatgtttaccagatatcaatttgaatcttatgtgtattcagtttttccatagcattaattccttacgtcatatatcaccaaaatgacggactgtttcaagtagaccagaatatcatttgtacctttagaacacttgtaatttgacatttttagtatagaatttactgcttagaaattacagcctggtatggtgactcatgcctgtattcctagctactcaggaggctgatgcaggaggatcacttgaccccaggagttagaggctgcagtgagctatggatcatgccactgcactccagcctgggtgacagagtgagaacctgtctataaaaaagaagacaatacagacaagttctaacaccttttcttatttacgcttaacagtagaccctgtagaagaagtctgatcttttaagtctgataataagagatatattatgaaaaagataaaaattatacaggaaaaggaacaactgatgatgcataaaagcagcagaggtatatctaattatcatacctaaaatatgtgccgtcgaaagccatgtgtgtctaatagtctactctcaaatccattatctttactagaagaaacccgatttttattcagacattcagagaatgtttcatatatttacttcactggacttctaagataccattatactggcattctactcagctaaaggagtacatttcccagcttctatcaaattgaagtgtgtctgcatgaaagagttttaactgaagggacataagtaggggtgtgggacttctacaaagatgctgtacaggaaatctggcatttgggtagtgactggcactacagaagccagtcacttggggacattagaatgagagctatgacttagggtcagcatagtgaggagcaggaagaggcagctcactggtgctttgcgggagatgccacagcacgtgccagctgcctatttcagtactgtttatacaagaaaattagacttgtgtatgactgaagattttctaggttcaatcattggagcataattccaaactaatatacaaacaatatattattttaggaaaaattaacataaatcaaacatggatatgtgtataaacgcacaaattctccattctctacatgagcataatagaaataatagaaataaaataaaagcatagaatttaaatattaatatcaaaacatccaaatccattttgtggtctggcatgacctgaagctcaagtaagaaaacttttctccaaattctgtttgcaatgatccacttacctttactcttagaaatagtgagaggcctttacagaaggctgcagaatagctttttgttttttaaattacagattttccacatttaaattttaatattgtttggtagaaatgtttgttttaatgaagacttctgccttaccttgagattattcagtgcatatgtttatgttatctcaaatatttggacgcatattttaattcatttttctgtggatcacgaaggtactcatcaacattatggtgtccttattaatttatatccatgtgttctcttctttacctgattaaaattccaaattctatctctaactcaacaaatgatcagagggaatacaacatacataagtcacctatacattagaattaacataatactctcagttgtgttctggtaaacctaaaacgacctcctcatgctgttccttattatgattaaacactctcagaaactgcacaggccttctctttccacccacaacctcctttcacatatggaagttttaacttagggtcaagaccattcaagatgtctaggtgattttactcatctgttgttatgagtaattctcaggacctaaaacgttcatactgttaaactttttagggaggactaatggaatacatactattatatattttttaaaatgctggaattcacatcattattctttcacttatagtttcaacctccagaaacttaattatactttttaaaaagaacgtgcttacattttccatccagtcaatgttttttacagagtcaaaatatactagggtaaaaagtaaaaaccatctttgaggttataggaatatatttaacaaaaatgactgtgaaaaatcacaaaggaattgttaatatgtttctaaatgaacgaagaaatgtaggcattatatgtggtgaggaaagtttgaaaagattcattacaaactagcaactaaattccagaattttgataattagtttggtaaatttagaaaaatcacccaaggctcagtttgtagtatttatctgtaaaactgtctaattattttttgtctactatttcataaatatcatgtgtgtatttataagctattataggttgatggatataaaacctaaacatagattgctacaataaagcatatttaaataagcaccactgtaataagcactatgctataagttaattactaaatgggctatgtatgcaataaaagccacagatgtttggaaaatgaagagttccattgtgaattgacatgggtaaaggaaaaggcacttaaatctagaatttcagcttcatcttgaagcaggtaaatgagtcagagagaagatgagaatgtttcatatatttacttcacttaagatactatgctctcctgctttaattttttcacacttgcgggtccttcttcattgactttgctgttgcctctttattttcagccttctgcaaaatgtagattcatatatccaacttccttattaatatctccatttctgagatattaaaaggaaaaaagttgttttcctctttttctttgagcccacccccaaaacatatttctcctgcagtcttcctcatccatggccacttcttccttccaggtatcaggccaaaatctctggagtccactttgattattttccttctctcacatttcacttgcagtggtggcaattcttgttgactttactttcaaaacatatcagaaatataaccatttcttacccaccagcaatgctacctttctgaccaagccaccaccatcttttacctattttttgttaaatccaggctccctgcccctgcatgtgtcctattatagttacactctgtgttcatcatagaatgatcctgaatctacttatctcactcctttgctgatgatcctctaaggttttcccatcacattcagaataaaagccaaagtcctcagaatgacctgcaaggctcatcatgatttgtcccccagtgacatctgtgacctgctcctctctccttccttacactgttccatccttgctagtgtccacggtgtctatgaacaagtcaggtctgcttttatctctgagcttcagcacttattcttcccacttcctgcaaatggttcccctttgtcctgaagccatgaggccccccgacatttatttctgttctcttcaaatattgacctctcgttgtggcttgccttgatcactctattttaaattgcatttactgtttttattttctccataacaattatcatcttctaatattctccttagtgcatttacttgttactgttattatttatatcccctttccttttgagcaggagaacaggaaagttttgggcttccttgttttttgggtttttgtttgtttttttttttttttatttttatttctcattctttggacgcataaaaaggtgagcactcaatagatatctgttaaatgcatgaataagttaatgaattaataaatgtaggaaagtgtcatttctccatgattttttttcagaaaaagttatgagtatcaatggactgtgtggtgcttatatactgctaattatgtataaatgaagtgcagcaaaacatagtctcataataatttcaaaaatactgattttggacctagcttttaagatttatttatttaatgaacagctatactgaacaatattttaaattgtttgattgaactaggattaattatataaatcatgtgaaaaatttcaatcatttggcagccattttgtaaacaactcactctatcattttgtaattggtagattgctcaaatgttggaacagtgtaacacaaagttttcagattcaaatagatcatgattttaaaaggttggaactttaaaaaaaacaggattttatttgagacattaggcaattatccatatatttcatctaaagacaaatgtaacacacagccaacttcctttaagccacattaaagcatctaagaacatatatatataaaatatatattatataattataattatataatatttataattatcattgctccactattataaccattagaaacataattctgtttaaaagtttcaaactttttaaaattttttcaaagaataagtgtagttaaattttcttgaagtttattcaaactgacagctattaagcacttactgtgtatatgtctgatagtgctgtacattaaatatagaaagatgaatatatgtcataatccccaggatgaaggcattatggagttaatagactcagaagtgtatgtaaaatcaatacataatgagaactattctaaaatatgaataatgatcttgtacattttttatctgtaatagcttaggtactatttctttatttgttaactatggttccagcctatctgcgtcatttaaaacaaacttctcaaacttcaagaaacatataaaataccctttttctagttatattaataagactatcaagtagcatttagtgggtgtataccttgtgccaagcactagtgacaatatgtactgtttcatttaatcttcccaaaagtccattgacatttcaagcatagtattaaccagacaatgctcatatagataaaagagtaaacaaagtttgtaagaaagatttcagattagattaccttacaattgcaatccattttgattttcatggtggctttttgattgttcatggaatttctgaataagaaaatacattttcacaatgccaggctttacaaatatcatttataaaagctaaaaagtaaagcaaaataactactgttttacaattacgttttaataatgttaacttaaaacttaaaaataaaaccacttctcatataccagtttgtggaggattgagttcccttgagagagtgaaaatatggtcttagtgatttcttttatgagattaccctttctcatctttgaaaacattgaacagattcatgctttatacagtatgtagttgaacgttgggaaccaagtcgtactgcagtggtaggagtaattacagctgtcagttctttcaacatgagaaaacaaccttgtttcaactttacaagaaacagattgtaagtatccaaaggaaaagaaataacagtctttatgtgatgaacagtgtggtgattgttaaactagtaaactcggccatttggagcgatgtatttactggaggccgttgggaagaagatactgtttacgtgcaagtttgagagtgttttatgaatgaacaaacaaaaacatgagcactaagtatctcatcaggaagattataatgactggtggacttttcagagtagagacattgtgtctaaagaaacttgtcttaactgctttcatgtgagttttgtttttgtgtgaaagcacttcctttgtatctgggtgttcctcacatctggtttatttggatgttagaaatccaggacttccttatactaaacaagaagagagcagatttaaaattggaaaaacttgaaaacacattataaaatgaggagcaagtgctcttatttttaactgctctgcaataaattgtttattttttaagctatttgtttaacatgtgcttcttctcttaatctgtgtggagggggttatttggtgtgcttttggcaaaattcagtctaagtgccaaaatcagatgacagggaaactgacagaaaagcaaatccattgtttttattccactgttaggtaaaacttaaggtcctggtttcaagcgtttgccattttttttctttactttgtgaaaatgtttacttcttaggtaaaaagaagaatgatattagttagcaaattaaccaaaaaagttagtgtgcaaaagctaaaagatgtttttaatgctaaacagagcaggaacattttatttaaaaaaacgagaccatgaaagtgctaaatatataagaatataagattctgatgacttttggtggcatcactttcctttatctttacatattcactcatgtccactacacattttattttttttttggaaaaaaaaatgtaactaagggcagccagatggcctaggacagaaaacaggacacctctccttgcctggacagatttcaagattgacactgcatcagtgcacaaatgaatccggataatgtggcagaaacaaggtgtctgcctcttaatatgtagcatgcaaaagctgaaggaataaaataaactttcactgacagttctggtttgcagatatataagaatgaaattgtgatgaagtgaaggtttgtactgggaaagaagccaggatgctatggtagtgcgatccagtgttccactcttggccaaccaaattctgctcttttatgatcgaaccacttattctcaagttctgctttagaaaaagcaagattaatgtggaagtcttcattaaaattcaattgccagatattccttaatgcaactttaatataattttctaggatcgccaaatttaaacaaattctatttgacctttattaacaggcaccccttctcatacttcagctgttatccataacacctgtagcaaattcctatggtgttctttcacaaaaccagatctcttgcaaagttgatgaaaaacgaagaggaacaaggagcatagaatatcatatttcttttaggtgtttctcctgatttcctttgggtcctggaacatgtgcttaagtttacagttatctaaataaccctgctgctccaagcagatgactgttgtaaaggggtaaccttgcggggataaaaccagggcaggggaacccagaagcagagatgaaactctctgcgggctgatgatgtatgtatattgatttcacaattgtcctacaggtactaattccaggaagttgcttctacatgtctctggggatgcagcagtaagtaaaagagaacaaatcatccttggcagtagggtagatagaaaataaccaacactaatatatacagtgtaggtagtaacactcgctatgaagaaaaagaaaaaaaaaaagggaaagaagtcaggggaaagagagagttaatgggcagggctgaaattttaaatagaatcaacagagaaaaccctgagaaagtgagataaatgcctaaagtttgtgaggtcttttctgtccacctcagttgaaagagcctaccattgcttgtttgtgtttttaacagatacttcagtagttctatgtataccattgcttcacaaatattaattcatttgaatctacaagataacacaatgggacacattctattataattttgtagatgaaaacaaaactacaatgaaaataagtaaattatccaaggttgcacaaccagttaatgttgaagataagatttaaacctaaacagcttgactccagaatgttctaaaccatttttagatgcgtctttaaaagtagatttatttctgtggattctaccacttcattgaggattgcctttaatgttcatggtagacagtatgtggtttttcattaggtgacattgtctcttacttctcaattaaggtatacttataaattcttggggctttcttttacactgtctattaaaaggaatgaaagaatatgcaaagtattggttggctatttagtctggtcaagaattcctaaatttgtttatcagaaaacaatgtattattacaaaaaatgttaaagatgttaagcaagataaaataaatgtacaggatgctccttattatgtctgcttttcccagattcataataaatgaacacattaatattttatagatttgagaagtcctctttcaaagagacaagatttgcttttgtatatcccgttgcttctcaaacatattttacagtgggcctcttcttctcagcaacaactgcaacattcaaaggaccccaatgtgctaaggagcattcttaataaacagtgccaaaagagtactggatcaagctgtcttccaaatttggaattagttctatttgaaaggagtggaaacttggtaggcaaatacatatgaaaaaatacatatatttgcccttaattttgttaaagaaaaaattcctatgcatgtatttggggaagaagaaaagaaataactacttttttttgttatagtcctaaataatacatcactgtagggcaagggcaatatattataaatagcctcacccacatttccttaagcatatgtgcattatttacctaattcattaatatattagttcattttgtactaatatgtctggcatattttcaaatgtttctaatgtgattttactgattcattaagtcaatatttatcaaatatctactaggcattttgataatcaaagattttatttttagcatcatttctatagccctgattattttacacaaaactgaagttccttttaccaaaatcagatgcatgttttatgaatcagagctcttagttgtaagcattggaaacctgctgaagctgatttagtcagaaaataaatttactgaaaagagtattactaacccagctcagaaagtggctagatacaagttagggagggtacagtaaggaccacagcaagcaccaccaaaatccactagtgaagtccctgtaattaccaccaccgttagtccctggctatggtctcattgacaccacgacaaggctgtcaattgaagtcagatggcattgccaaagctgctgccaaaataataaattctccactgcctctcactcccattacagagttctgggcaggaatagtcaatgaaaccaattggaactacagaaaataagtgaggtgtatttgatgattgtgtatctaaatataggaaagtggctcattttcttggaatccaaagcggataaatatcttcatgacccccaacattaattactattagtgctataattttcatcatttttattattacattgtagtatatagaagtactcactgtaatgaaacatcttagcttcacacggtgatttatgagattgtgttgaggtataaaggagattaattaagaaaactctaaacaccaactaggctttatatgggctatgagttccttccttctttgcttccttccttccttcctcccttccttccttcttttccttcttcctatttttgtattttttaactttttcttcaaaaataaaagaaaaattatactagatttggaaatatgactaaatactacaataacccgacactctaagaccgttatcctaaagcagtataccaaagagtttgaataagaaatgatggtaatcaatttccttacattccgttaggagaaggaagtttgcaaatgctgtaaatgaacataatatataatatattagaaatcaataatgtttggaacaatcagaatggatctcacatttcttctgggggtaacagacaacaaacatataataaatacataaactgtatgctatgttaaagtttgaaaagggatatgaaaagatagaaaaagcagtgtagcatatcttgttagtgtctgtttcttacagaaaatgatggtaatatttagattgttttccttaggttgtttggagaataaaatgagacttcatgtgaaggccctctgaaaagttgttatgattacaaaattgtcaatattcttaagtaaataattataaataactgttcataagtaaataaagctttatattccacaagtcagagaaaagtaatattagattttgtgtgtgtgtgtgtgtgtgtgtgtgtgtgtgtgtgtgtgtgcgcgcattctttttctgtgtgtatttctttcaccaaagtttggatcatgttgtacagcaaacttgtatctttttaattgtcagccctaaagattcaaccctaaagctttcttcaatattgtcacaaacttggtatatctctttggcaactgctttccagacttttaataggaaatccatcagcaaaattttcactttttatagtctcctcagcttacaaagttgctactgtctcaaacctcaaatatttctacattaaaaacattttttaactacctatttcagagtggttctccaattttttggtctcaggattgtactctaagaaattattgaggttttgcttatgttggttatgtgtgtaaatatttaccctaatggaaattaaactgggaaatttaacgaaattattaatgcatttaaaaattagcagtaagtccactagaaggatgttaccatctgagtgatgatctcatctcacatcacgcagcttctaaaaatctccaccaaactctggtaagacaattagagtgaaaaagacaaacattactgtactgttactatgaaaatcattttgatttccctggatcacactttaaggaccatgccatattagaaactagaataaaaaaggaaaatgtttgaatgggtaacacattcacatggttacaatttcaaaaattatagaagaaatatagtgaagtctctctccacctctgccagtaagtcattgtttctcctctctcaaagccattaatagtattagttatgtggttatatgtatacaaaaattgtgtaatgtttacatagtataaatataacacctgcttttatacaaattgaatctttcaattatgtcttatagcttactttttttgaaatctaacaatgtatcttggagatctttcatataaagagcttccttgttctttatttttatgtttgcatagtattacagagtatggatataccatgatttatttaattagtttttttactgacgggcagtcattcattttatatatacatataaaacaaaaacagtggctgtaatgagtaaccttgtgtgaatatcctataatttttattattttaaatctgactttgtctaggcacagtgatttatgcctgtaatcccagtatttcaggaggccaaggtggatgagttgtttatcccaggagttcaataccagcctgggcagcatggtgaaaccctgtctctatgaaaagatataaaacattagctggatatggtagcatgcctgtagtctcagctacctgagaggctgaggtgggaggatcacctgaacctgggaggtagaggctgcagtgagccatgattgcaccactgcactccagcctgggtgatgggagtgagactctgtctcaaaataataataataataatagtaataataataaataataataaataataaacctctcttgcttagtgagccttcttatccaagtgaggtaattcacttaaaacacaagtaagagatttacacaggaactgggaattagatgaacacataattatcctcagagcaggaatgcttgaggctgaaaaggggtattacttaaaattaaaattggggataacatgtagaaagtaagacaatcctggacatattaggtaatttggtgtcctggaaatcatgcattttagaaatgaggaaagcaggagtaaatacaggaacatgccatactccaaataaattagatcagaagaaataaagtaccttattaattaataatgtccaaataatctatttcagccattgtgaatgatgatgttagttttatgcaaaagcaaatgcaatgacctagcagaatttgttctttgaggatctgatttctgctcattttctaaaatgttccttcactcagtattgttctcttccttcctctcttgcccagaaatcacttgtccaacctctctccttctcctcaattgtagtttgggttcccctgaaatcagactgtaggaaggcattttgtatgctgaatgtttagaaaggagtgcctttgggattcaaacctgtggaaaggaaagaaaggaagcaggaatggacagaaggtgaagtgaagctgtgatctagacctaccaagggttttagcccaaccctgcatgctggaactgagaggggcttttagaaagatcttgaattgggctgagattgcaaggcctttttattcctgcaaaatcactggatgtgccacccttgggaaggacctgaactctaggacggccactccatgcagcaaagacaatatctgaaagggttgaaagctgcagggtgtctgctgacagcatcccagcagccggggctgcagtccttcaatgaagaggtattcaggtggcaaattgcagtgtcagcctcttgtatcaacatagtcgcacaacaaacatgattcatactaagatataaatgattaaagtttatatttaccaggatatttcattttagcatgagcaaaataaatgagccaaattacaggagtgattatagctttaggatcattcacacctaaacttgaaccctgccattgcctcttattcactgtaagcttcagtttcttcttctataatatagggatgatgatacctattttggaggatagtgtacagattagaggttatattttaagtaaaggacttaagcgcctagtacatagtgagcatttagcaatgatgacttatttttaatgagtaatcataaaattgatattaacttgattaacttttagtttgatactaaatactttgctatgattttgaggggtcgggggagaagggaacaataaggaaataagaaagctttcccagaacatctcatttatgttgctgctgatgctttatactaacctttttatcatattttttaatattattgattttattacattataatagcaatacctcatattcatatgatataaaaataatgtgtagatgttttgtgagttcccttaatatccaatgtatacttctattgaaatgtgggaatgaaactttgtaaataaactaaatgaatactagttgtgagtatcttaactacacacctgggaaatcgaggactcttgtccgatttcccaatcagacaagattgtgagctgtgggtctctgctgtagctgggtggcaggtataaatggaacactcctgaacaaatcagaattaattgccaagagaacctacagtgttactttcaaaggatgatggtatggggaaggaagagacacaaaaacccattctaaagtgactgttttctctttgaggtcaataaaactggtctggtggtttatccaggtgaataagaggctgattaaggaatgagatctttaaatctgattgtgcctagtttttttgtatagagaagtcaatagttaggagcaacaaaccagagtaccaaataatattaccatattattttcaagggaatagaaacatctcaaattaatccagtgatgattttgaattcttcagacagaggtagcgtttcagacataaaggagtagagaagactaattgatttagcagcgcatggatctaccaggtagcctagacaaggaatgtccaatcttttgtctcccctgggtcaaattagaagaagaataattgtctttgcgccacatataaaatacactgacactaacaatagctaatgagcttaaaaaataatcaccaaaaaacttataatgttttaagaaaatgtacggatttgtgttgagccacattcaaagccatcctgggccgcatgcggcccactggctgtgggttgaacaagcttggcctagacacgcccccctaaaaaatccaacaaacctttgcagagtgtatgctattgctgggattaactggaaatctttcttggaagacatttttcagacctgtgtcacacctgacatctgaattttcccattcacagcttctcttgccctttggatctgcttccacccagacttgctgtagggtaaatcccactagtttttctgtcttcctctgaacttactagaaatcttccagcacaaaattctagatgccttcatgatccttttcttttatggagaaaaaagattaagtaggccaaggaaaggatctccagattattcaatgaaagtatatgcttttctgcccatttactctctagagagcatacaattagtgttaatagaatgtgtgctggtaggataatgccccagaacaccctgcagaatagtcacagtatatctcagggactagaagagagtgtttaataaatgaaattatctgataatactacatttaaaatggaggtgtatttacacaactacacagagacaacttgtagtactactcaaacaaacaaacaaaaatctttcaatgcagcattgctgagtcagggttttcatatccttatacttcagaaactgtttcttatttggcttttaaagattgcaggtccttcttagagtctttctgtcacctctgattttaatcagtgagggattaggaacataaaacagattaatacaggagacattttgtaagtgattctaatgcaacaacattctagacaatcccactgggatccatgggaaaattcaacctcatttcttttgtagctacaattgaaactctgggaaagctgaatgagaacacaaagaactttcacttaaaataagacaaattgccaatgcttaactaatcctcaaaagcagatcttcctaagaattaaaacgaaatgtcatagtatgtaatccacccaacatatattatctgtatataaaacattcttgaaagaaattatacttttcgtaataattatttttaataaatgcaatgcaatgcaaatatatttcaaattggttcaatcattccatccccaatgctatcaccatagaacagaccatctcttaactgttctaatgcatggattaaaaacttctgtgctcttctgtgcctttcctctttccatctccatattgtagtcaaaatgatccattcaaaaatgcaagtcttatgttaattctctgcttaatttttaatgttattaccttcaaaaaaatgtgttacttttgtattctccttttgaatccttgatccaaatatcttgcatctttacatactcatcttctgaaataaaagaagacatcagcttttgtgcaacaaaatcctgactcctttccaaggctgttcaggccttgaatgataaaggcccctgccgttctggaacttggtcatgctgtggctacactggccaacaatcagctcctcagaaacaccaaatacccattcagggcttttgttcctgtgttttcattttcccagaacacttttccctggctcttcaagcgccgttcaccctatggtttgttttagatgctatcatcatctttgttttacagatgatgaaactaaagccagagaggttaagtaatttgctcaaatgctcattaatagcaaatgagtggcaggattaaaaccccggtgatctaactccagattcccggctcttcactgcatgagatctctgtcttagcacccttcaggtctggttctcagcctaaacgtccgggtagttttccctgttccaccgtctaaagtaggtttaagaaccaccttcatcttctcattcttcgtttatcttcttcttcatataatttatcaaaatttgtaattatttattatggtagttgttcagctttttaaattgtacactaaattatgaggtttctgtgggcaagaccaaaatatgcccagcacatatactatcttttgaacagaagcactcactctacacatttttgcttgaaataactaaaacacatggagaggaagggtagttattggatgcctgtaacttttgaaaatgatataaagtctttaaattataataattgtttttttctgattttttactctgataaccatgttacaagattctatttcattcaaacgtataaaaacaacaccaaccataaaaacagttctttgaaacaatgaagacaaatcaattatcttctatccttagcatttctccctttctctcccaaattcacctgcttcctctgatttgctctccttttttcttttgcttcttggaattatttgcatataattagtttccaacacagtgacatatcagaaatgtcgtactctcagaatattttagaatgaggtctagggagaacctaaacaaaatgcacccttttattaaattgacctgacaatattaagggggtgcttttgaatggataattctttgaaagcatcagttaacaaacagcacaaaaacacaagcacagcaacccagcaagtatgatgtattatttaagaaggggttgagtggggtctttatctgacaagtcacaggcagaaaacacattcctgcaaattgccccatttctcctcaaaatgtgtctgaggtgaaatggagcatcctttgtttcgtacaaagaaaataactcaggaaaatgacagtttagtgatacatatcctcatggtctaaaagtcaatgacctggaaaaaaaatgatgaaaactaatttgttttaatggacagatagtattgtatatttttatcatgtacaacataatgttttgaagcatatatacattgtgaaacagttaactagctaatagatgcattacatcacagagtttttattttgtgataaaagtacataacattcactctgtttacattttttcaaatataaaatacatatacttggaaattcaaaggacatataatttaaaatatcacatttatattctctttaatattttctattctttcaataagaagataaagcataactacaagatttagcatgggtaggggtagggggagaaatgagaaaatgaagtagggagaaaagctatttctctcccctatgtggggagaaataacattacaaaaaagaaatagaagctaaaatgcatcatcttcaattgtgtgttatactaactccatagtttgaagtttgtgcttattagaaatcctgacatctgtgaatttaaggtagttgtctctgtttttgtcttaaatgaaagtcaaagttgaatacactgaactttctgaggagcagcagaatttcaagggttccttcctttagaaattatagggagtatctgaggactaacttgatactggagaaatatttgcacattgctaaaacctgttattctcttttcaactggagcaagatagaattcccacagctaggtcattactatactttgactcctaaactctcatgtttatactgtgtctacatatttgagaattgcaaaaggtgggaacaacactttcttcactgatttctattatttattatatacacatatatacacacacacaaatatacatacatatatgtacatatatttttaaacaaaattatgattagcattttatttgaagagtgcaaagtacctaaaagtcactaagacaaaggtttgaagttgacactggataaaaagacaaccttgaaataattttaaagtttgcaattaacacagatcacagtgtggcaagtaaaagttttaatagcagactggcccaggccttgaggtaaattatgcataattattcataactgctatttttggcttgcctgatttgtcctagacctctggctgaggaaacaatttgaaataattagtgtactagtgcattgacaatgatgaatgaattgaatacttcttgtgccaaacatagatcttgataggaagcagataactttgacaactgtggtattttgttattagatctctgaaagtggaaagtttatgttattttttgtgattttttatagggtgtttcataagtcattctctaatgtcctcaatcattaatgaggctgtgattaaaaacaaaccaaaaaaaatttaaaaacagcattgatgtttatttataccaaatttttacatgtttaatgttaagagtttaaactatgatattctaaaaataacttcatggtaattaagagacttcctttcaattttaatttcatgactaaattagagtttagtatattatatcaaaactatatttaagaaaaataatacagataattaaacacaatgcttcttgaaatagagaagctttaaatttttcatatgataattagtaattttttctaaatattacaaaatgcatatttgcctacctgttgagttcctattgctaggaaacaaaaccttccctttacatatgttagtatagaaaataattttcaatgattaaaatatgcaaatgtattgaaatttaaaaatttagaaattctggtacaccatcaaaaaataaaactagcagaaaattatagaaaagtctcagagagatgtttttccaattcattgtacataaattatataaagctcctcttttaattaagcaaatactcagaacacaatatattcgcatttttcagtagaataaacactaacaattgtctgtctggagacaactgttccttggctggaggtttggacagacaggcaatctttgttttggtataaaagcatcagcccatttaggtcacctgagtgaaaagaattagacttattttttctgaaaccataaaataatttaaaagtataaaaagatgaattcacagacaacctttggcatctataataattttatcactgctaattatacatgtttttttttctaattttaaaaggttagttagggcatccacatttgcagtaaaatttttttatagatattgtacatatttttcagaccgaaattataaacatttatattacacaggcacatagtagttgggtcttagctgtgcttctgaaatacagcatctaatcaatgttctcattctctgttacttataaccatgacaaaattatttaaatgattcttgcttttcatgtatagaataaactgcaatcttaaataaactgctaataaaatatatcaacttgtttgataactgttatatataaactattattttatgtaactcttacccataatgaagagataaaaaatcacacaggtgaccatacagtgtttttgtgtatattttcagatatcatatatttcaaaattgtgcctatgaccttgaaaaagctgtttttttgtgggatcatatggctacataaagagacacttctcttaagttctcttgcatttattaggtttaaagttcaaatatatcatttcttcagttttactgggatgtatgtaaattctacttcataaccttaattttgtttttttgttcatattttctgatagtagaaattgcagcattcaatctactttacctgaagcctttgttaattagatacagttactggttttgacagagccagatgaacggctctgaaagtcaacaaactctaatattgagattatagcctcggcggggcgcggtgactcacgcctgtaatcccagcactttgggaggccgaggcgggtagatcacgaggtcaggggatcgagaccatcctggctaacacgttgaaatcccgtctctactaaaactataaaaaaaaattagccgggcgtggtggtgggcgcctgtggtcccagctgctctgctcgggaggctgaggcaggagaatggcgagagcccgggaggtgcagtttacagtgagcagagatcgcgccactgcacttcagcctgggcgacagagagagactccgtatcagaaaaaaaaaaaaaagagattatagcctcagaaaataatgatttaatcacagaactagaattacttaagtttaaacctaaggatacttggcttaatctgtgagatagcttttattttattttcctcataaggactttgtcatattggattactttggacccaaaccttcaaggacacttagcctggctctctgtcctgatggaaatggaatagcggtggtctgggagtgaagatttccactggtctatggaatgcacacaacttggctataaagtgtagccaaggagttgatgacatacgaactagttcttctacacttttcttctgagacaggtgctgttgcgactactcttgctattgaagtgaagatagagcaaaagtgtagacagtgggatcccaagctcaaatataaatatttaaccctaagtatcagttataaaaatgatacgtttctatatgtcattgcagaagagaaacacttggggattttgagacccttgagtgaagaaaaagaaaaaacaagaatttatttgagagcaatttgagagcaatttttgtgaatgctcattttggttatttttgttaatattacctagaattaagttcagtagttttctggtctagtggatcgttaaatagaagatgtttacagcatgaagagcatatgctaactctttaaaaccattttttttttttttaagaattgaatctgatacttttgcttagctggataagggaggcaaaatttttaacagattgaacactttaaaaaggcttctgtttagtatcacattatgggcatgcattttcagattggtacaaattagccttgatattacatgaagatttttatgtctcaaatttatcaacgttgtttcaaaaactatatgaagaaagaagcgttttacccactaaaataaaatgaactgttatatagcaggcttaactacctctgtggtaagttctctgtgagagaatataaaataagcatattttatttttcaaatgcctcttgtcatttgaagccaagcagattcaactttgtggcaatggctacatactgaactctatgagaacaataatgtctcaaattgattgaatatcactaatcggttctaaagaaggtgatactgtctttaagttggaagcaattaattttggtgtacaatgaagcaagcaatggatataataggtgtttttcttatgacacaaattgataacttgattttgaggcttatattgagtgaatgtcgtgggaagtaattttacaaactcttctcacatttgtttcattctaagaaaatggtgaatgataaaataatgggaaagaaaacagcatctataacttattcaggattgcacactcttttcttaattgctttagggtacaacttcagagcttattgctaaaaggttatatgttttccttgtgatgtgattttctaatcacggggaaaaaaaatatgatatcatcccaaaggaggcagttgaacaaaagacaacacataaccagaaaagcaaaggttcatggcctgacttaaaactcctttgaatcaggaaccaccttatgatcacaactgccatgtttaaatgcatgactcagagatgtgcctatcgttgataacattagcgggtcattgtgtaagcctgaccataatctttctatagacagaagccctctgtttgggtggaaggcttaaaaagtagtgttctgtgagatagattgcaatttcttccattcgcttttgtttcttccttcttcgtaaccaaccgccccttcttctctactcccccaccaccccctttacgtctgaagccatcaattcatgtatttaaatgtccttggaaactgaaagtaatctagaaggttattagcatattgttataaatgttaatggcctgacagcaaggatgggctttttcttttatgcgtgttgttgtgaacattgtgagtttaaatggggtaaatcttccccattcagagtgttgccctggcccttcattcacatgtcaggagctcattgtgtgcccaaaccttgtcagaggcttctagatgtttagtggcagcagcttgccattgagagctgggaagagggctgtttgggatgggggaaagaccagcctaggcagccaggtggtggccaactggccagtaactgacagacaatttaacctaaccaggctgtacagtcaggcctgcgttacaaaagacccacatgtgtccttagcaagcttcattaactcttttggctagggctgtactcctctgacatattaattagttgcaatgctttctcctactccaacttaacctttccattggtcactcgattcaagtggatccattggaagctattagaataatatgcaaaataactggaaaaatagctgtaggaggaacaagattccctatcacttcactgattttgtaagaaacaacaatgttgaaaagaaaatgtgtgatcattaatacttcactcagaaaggtgatctattccatattgttaataataacaggacatcaattacagtgtaattatgtgcatgtcataggtatagaattgtcatgatttattctgtctctgtaataaaaataaaggaaaatactataaaacaacattttgatgtattttaggttatcttaatgaccagagtgacttgatgtggggattataaattggttcagctttttgagtaattttcacaagttaaagtcttaatgaagaagaaattgcaatattcaaaaaagttaatatttttaatattataacaagtacagtattcagaatctgtaaatatgtttcatatgtacataggtagagatagatatacatataaatgtatccaccaaaaaagatgagttttttgtgtactccttgatattttacatttcataatcaagtgctgtatcatgtaactctaagtagagatgcatcaagtattgaatttaatgactattgaatctaatttgtatcctttgtttgttttgcttatagaatgttttttgtcagaggtattctatacgcataaattaaatgtccaaatttaatttggaattcctaaaatccaaggccaaaaatgcattttatatatcaacccttacataggcagtaaatcttcagtggtatagtacttttaacttctcacagcagataagtcacctctcaaatccattgggtgagtaaactcagtttcattttatcgttttagatactgttatttttccaacttaaggaaagtttcatattacttagttcaatatcctaaagaaaaaaatagaaacaagtacaatgtgtatacttattattaaatgtttttattagctatgtaaaatcaataattctaaaagtagattttgctttaaactgtattaccagaaagagagaagctgtattcaaaacctgatgatgagcattgtctgcttactttttggtcagcttcactgtatttttcctcacaataattggttaatatgagtcaggctgactctaaaataagcatatctgaggcaattcttgagaactaaaacaatgtgtttagttttaagttacatataaaaataacatactgtcacatttcaagaaaaaagaaaaaaatgatcccttcaacattggctattgtctctaaaacatgttctataaaaaataaagtaaattaaaaaaacatagtgaacaaccacagtctggtagcaaacatgcattttattcccaaatcacacgtgtgtcttttgggacatatattttgggaaaatagttgatattggtggtagaagcaaggaaaaattactcggcttttacagagaagaaactcaagaaaaatgctatgtaagaaaaatgactcatggagataagttataatagttttaatttcaattgattttaatttaattgtgaatcttagggactcagaaatgatctgttttctgttggtgaaagctgcacattaaatatcaagaggtcttaggtttccgtgatactaggtgttctcatacttagatagtctcatgtatttgcatagtaataagattataatatctgtctctaggagtgcttaagtcttctttatcatccacgagtaatctgaatatacctgatcaaggcaaaaatgtaagtgtggtcattatgagtatttcattattgtttttatcagggaaatgagattatctgcagctacatacaatgagcttattatctgttagtagattgggtctcttttttaatccatttctaagcagcatgtgcatttacataatgtacatatcacttcaggaagtaaaattacaaaaagattgattgcagagagtatatttaccctatattctagcaagttcatcatttttttaagaatccctgtcttgaatgtaaatcagaattattatatccttaataatatagttataaatcagagccaacagtcttagaaccacacatcttaatgaagttactttttaaaattaaccaccaagttaaattatgaaatatatattagagtatgatatttgccaggtgataatactttaaaaaagatggagctttggaaagaatttatactaatcaatttaataggatataaataattataagatgttttgaccctacatttttaaaaatcaaatcaaatttggtaaatctgataagaatagcatgtgcagaggaaaaaaaaagcatgaaacattgtgtgaactaatttggttgtctccatttaattggaagcatgtattaacattctgtggttctgcataatactttttctgttaaactaagcttcaaaaatctggtaacaataggtttggtaaagaaaaaaagtgatagcattttttttttttttttgtaatctggccttgaaactttcacctgaggaaataagcatgtgttggttgtatttggcagtagaatgttacctttgaaaataggccctttttatttgatgtgatccaaaataaagctgaaacaaattgggtcacaggtgccaacacttgataatttacagtgtggtaaaaccgagtggtgtttgtaagtataatttgctccgggaaaatttgaaaccactttaagttggaaaagtgtcaatattttataacatattttataccaaccatacccagattgcaagatcctttctaactacaagctgtagttaactttcaactattcatttaaatttgtggcttacaagtgtagtgtaaagtcactggtcatttattaaagcacattctttaaatattaagacacaggaattgataaacatatatattttagtatgtggaagtttattttgaaccttgttgagttattaacttcaaaaaaattttgaccaaattagtaaaattatgtttcagccttattggctttatgacatttaaaagattataggcgttgaagttcaaaaactaatattattaaatattagtaactaacattattccactttaaattttgatttatacaagttaattaaaatacttcctaaaaggacgggttgtcatctaaaattttccttttggtttctgaaccatgcctgcgattctattctggttctcttatattctggtacccttagcattgaaaaaggaaggaggaagaggagagagaagggcaaaaacatcctattctccaggactgaattcctccttctgattagagttattctgttgttattgttgtttttttacagttgttttcgttttggccaccactgacccccaagtgatgctatcttgtgcaactttgcttttattttttgtttaagtttcagatatttttgtgagatattttgtaatactttaatatagaatctgaagtttcttttagcattttcccatttcatttctcattttgtgatacacatctcaatatattccaatttggagatattagtatatgccactgtagaaagattataggtgttgaagttcaaaaacttgacttagaaatatctttttgtggctggacatggtggctcacaactgtaatcacagcacttcaggaggcggaggcaggaggatcacctgcggtcaggagatcgagaccagcctggccaacatatagtgaaaccccgtctttactaaaacgtgcaaaaattagctgggtgcggtggtgcatgcctgtagccccagctacttgggaagctgaggcaggagaataggagaatctcttgaacccacccaggaggcagaggttgcggtgagccaaggttgcgccactctactccaccctgggtgacagagcaagattccatctctaaaaaaaaaaaaaaaaaaaaaaaatatatgttttttcacctactgtttattcttacaccagttacttaacctttctaattctcaggaatttctcttgcagaatgagagtaataatacatgtctcacagagttgctgtgtgcaaccatattttgtaaagcatcttacacatattaacagtcttaaatcttatttagaatcatagtgttacaaatgtatttaactataagtttattaatacatacatcataaaatccttgtctctgttggcatttgttgtgcaaaccacttggaatttatctgtaatataccataggaaaatgaattgaagaaaataaaattttcaaaatggctttcaaatattttattttaattttatatggagattaaaataaatacatgcagatatttttcttaatatttcagattctcttgtaacaacaaataccaaatacaaaaacacagccacatacaggacacatatctcacacacacacacacacggttttcttagacattgactaatttgcaaaaccaaacgcttacttatatgtagcatagcataaagggttcactctgcgtgtgtgtgtgtgtgtgcacgtgtgtatgtgtgtgtgagttttatcacttctcataatcatctgaaatttcctaaatattataagagtagtttttcttcttatatctgattccacatcttaacaaaaacttttacctctaagcatggacagaatgctggttagctacctgccagcaattctttacatctgatctgcaaaaggacacttgtctgggtgttgtgcatgccttggtgtgcactgacaactgagtgttaaaatctctgggggacatccagagcgaccacaagtctgaggccttggattacctgtccacatttgggactgtaactgtgaaaaaagatttctctctcatacatctgccttctctcttctgatttgatgttccctctcccattggtaagatttcagtaaacaacttcaaagactgacataggctgacagcacacggcagatgtgaagggttacttcctttctcttttaggtttcattttttaaaaatttttgaaattatcaattagccttaaggtttagtttgttagaaagggttttgaaaagccactcaaattgccagaaaatgtgaaggatagcaaatcttcaaggtgttagttcaaattagtggttgctaattaaatgcactgttttatcaaatcactctgtacatctcctgtgggtaatttcaactgtagtcctgacaacatttgatgtgttttatatttgcattcactgtttttgatgcttgctttatttcctcttcttctacctctctttccctcactcgttttattctctcctatttaaatactgtgctgttcaattaaatattgattgattgatttactacactcagaattttccaaagaagactgagtcacaaagcaaaaatataatgtctaatgataatgaacataatatcctccaaaggaaccaaagtattagaggaaaatcccaaggggtgaactaaattcatatctatttgtacatttacatttttattttgggttctaccactgaaatttttatcttctttgtggatagtcttaaagtgttgattacaattattctactgaactttttcaaggtgcagttcccctggcatgatgattctaaaacaaatatttactaggaataaatgacattttaagggcttataatcaagagacatatgtagccaatagatagatagatagtaaataatttcaagtcatttttatgttattacatcttctaaatataattttgatttccatgttgatattcctttattccatttgtgcaaagatggaactaaggtataaagaaatgctgttagcatacgtataattacacatacattattgttgaggaaggaattagaaataggagtctggctgtggagttatatgtcatagcaaagatgtaccaactgttttgaaagaaattcttgttctgaatttttagtccttggggaataatagctcctgtgaatccattatttattactgtagatagtacactatctatgaagtttgtggattggagcagatattgtttagatgttttagatgcactgaaaattatattataaaaccttttctgttttattattaattctgaataatataatgtattaactaaaataataatattttcaatactgttatatagaatcctctatttttaaagcattttgagtccataacttctatttgttgagccacagaagaaatttatattttatttttatgggtaaaagaaaagtgttttatatcagttactgcttataactagcatctgaatcttgagaataaccttttctatgtgtttaaagtcataattttattgcttttatccattgtgtattaaatcataataaggtagtcaaagtcaataaatgtttgtggtataaaaactagatgtatattatattattaatgtgggatgtttttctaaaagcaaaatggtacaaactatatcgcttatattttataaaaattttcatttttctttttttacttgaataaaataatttctttatacctaatgaaccatttgagtagtgttatttgtgtttcttgcaatgttgaattgtttcatgtgcatttttatgtttgccaatgattcaagtattgtgaaattatatttgagatggaatttatttggaagactaattaatatgtctttttctaatgtttttcctactgttatactgatctctgatatctcttattcctccctcaaaaatcacatgggaatggagtatagatagttatcagagaaggggttttaaaccagtctaatttctttaaaaaggaggggaacttttataattagttaccaccatttgcctttatttttcatataataggatacttactccatcatctaataagaaataaatcatgattcatagtgagtctctttatgatctttggtccagaccagtccaaggggaatacaagcataaagtctgaatcttctctcatctttttcgcttagattgaggtcactgttggggcagagcagggaactgtgtggttaactgtagtgaagacagcctttgagcccaatgctaagtgttatgttcaaatgttgccaatatttttaaagtctgtaaaaaaaaaaaaaaagatcttcaaaaaatgtggacaatgaaatccttgtctagctcctttttcgctttttcctattaacacataaagtcacaaatgcatgttaccaagtcaaacatactcacacttgtagatacatgttcccagcagggtttcatttgtgcttagtgctgcggtttggtgaaaaaccctctcatgtgtatagttgttttcatttttgagcttgtcacagcatgaaatcagtgtctcactgagagcagggtttttttttttcaataccctgagacttagaggctaagtaatttaaatgtttaaatatgcagaaatacaactcaagtgcagttcgtatattcatatcaatttctgttataaaaggttaaaacaaaatgctgtaatctgtagttgagggtgtttagaaaacctgttctatttgtttccgtgtttttctacaacagcataaatttcttccctaaaaatctacaaatgcatagtgtgccaattaaatgatgtcaaaacagctcaacattaatttttttttcatgaaagctttcttacctgctatacatctaagatatcttaaatagaccaggcttgaatgtggaaatatttaggcattgtcctttatgcaattccaaatctgattttttttttaaagtaagttacccactataccataaacagagtcagaagttagtttctcttgattttcaagtctgtgtgtattcagttccctaaaaagaaagatgaaaccattctcttaaatttatggtgtgtatatttactgactggcatgtgacaggaacactggttagaaagccacagcattatgatgcattgggtcaaatattgttttgacattgtgcttactttacagtaatcaacatattaaactgaggagcatttccttatatatgcaaaatgcaaagtataagggcagcagtttagtagcgttataaggccatagaaggttaaggtttgcttgccttgtggtgcagctgataaaacaattggactgtttccaaaattccttgactccagctttgtcatttatttttctctgtcgttattttttaaggaaaaaaatagacttgtttccatgaaactctgaggtggcaaacctgtacttcacataaaataaaaactttttttgtaagtgaagtgcatatgggactactctggcaagtttagtttgtgtaatttgctaagacttgcttgtataggaggagctaaaataatttccagagagttggaaaaaaagagattttgtcacagccttttggacaagatgttgataaaccaagtgactgataaacccctttaaatgggatattttccatactccaacacatagtatgaaaatttattttcatagttttgaaaatgtttctttttatgtaaacaaaaacactcatattgtaattatgtaatttgagtttgacagacttaagtaatctcctagttttatttaaatgacttttgtattctacctgtttcttttatattgaagtttactttttgagcatttcagtgaatttattggtgttcattggttttctgccttgttttcaaaattgtaataggcatgttgaagaccacagaagaatttctgagttaatttccagttgagcaaatatgacagatatattaaataaatgaatactaccatagagtttaattcttctaacttctactgattttttttcttacagcaaaatatatcagttatatattttgtcacatagctcagttttgtacactgattaaaatatttgagaagccaggcagacattcaaatggacctgtttaataggtagtcaatgacaacctcagaaggtgatgcagccaaataaacagaaaaataaataaaagacaatgtaatggagatggtagtggagagagatatacttaatactgcggtgttttaaatttgagcttttggattattagtgccatatgcaatcagtaagtatgtcataaatcttgtccttcagaattatgagatatcaagaccagctccataatctgggggtatagggtatttttgaaataccttgttcaaaaactaacaactttaagattgtggcagcagatcgttaaatctaagcagagagccctaggagacgatacagattgcatgctcagaaagctggcctgtcaggcatgctaattgagtgaaagtcttcaaagtaagaaatggttttcaattatttgaatcattattccttggcaaaatgctagtaccttttttaagggtcgctgggaaggttgatgaaatatttcatgtaaacgtcttaggcaacagtgagcactttagatagcatttgaccagtgataatcattttcatccttacttatctgttagctttttttttttactatggttttcctcttatttgatgaccatactatcataaattttcctttatttttcccctttatccttctcttctcttctttatgactttaattggttttttctcctttcattgaaaaataaatactggttttataccactctttatttcctataacaaggacagctgtacccagtggtgccactttatagccccaaccatgcctccatgctgagtgtgtcctttcatcagatttccttgacatctgtaaaagatcagtccgggaatgtataattgctaatggtatagtctgtacagtacagaaaatatggctattcattgtggagagtagcctagtcactgaagtttaaatacatcagagtgtcctttaaaaataagaggtaggaatgcattgatagcttggtgtaggaaattttatagtctgaatagattctcaattgattttccgtatagtacacatagatttctattcactttagtggagaatttacaaaaggtatgccttacattatgtcatgaaaaggaaaatattgaaaaaaaggtcaatccatacataaattttgagcagagaaagtatagcttaaatgaaataggtttttctaattattggtaatttgtgtggtgcgtgcataggcatgtgtgtacttcttttgctttacctggaaatagtctatgtatgtaaaagttgaggtataatcaacaaaaacttagcatatctttctacatctgtaccaatgtcagggaactatgatgtctctcacactcctttgaaagagaacattaaaaaaaatcaaaactccctctaagtaatataaaaatctattcattactggttttcagaatcacatggtatatattacattgttactaaaatattttgaatgaaaattatctacaataaatagcttattatttccactgaattacacaaagcagacattgaaacttgtcagaatgtcagacattttttaagatgaaaggaaaactgattacaaatgtgattttaatttgaggactcggagaggtaatccttgaagtcagagttccagtataatttaaaaacatccaaaacttttgatgatgtactctgatagttaaaataattattgagttcctactacatgtatattcatagatagctacagatttagttattaaatttctacatgtacctttctatatattgtacacacaattgaaattaaatatgaattttaaaatggactgcacaaggatggatgacttcctaatctcttcccactgtctcacatgcttcattgagctcctaagaggtttattctattatgcatagtcctggatggtgctttgggtgagatctgtaagatttggtcttttctcatggctgcaattagatcttctcttgctacatcatcctaccaaatacccaaagatatgtcaatattatcctgattagaaggtatggtaacccacaggacctttataaatcaccttttgcctcaccttcctctctatcacttagggtcttaataattattgcctaaagttctgaagtactccctacacacacacacatggcctccaactttatattaaggtgatttaataaagaaactattttttaatgaaaacagatgcattctaagccttttctattaacatgatgattttttaaagactttatgttccttttgctttatgagcagaaatctagaattttataactcttatactttgtttaatggctcaagaagtagctgtcactttttgggaactgggaattagctacagattatatactgctgtcttatctgaaattcatttgcaaaactctagggttgaaactacttgtaattgtaaaagtctgtgagatttgctggttacatagagacattgaaatgattatgtaaatgatcatttaaatcatattactatatcctattctatgactataaaaatttttaagatataatttttatgaacagtattttgtgttttttttaaggtttgaccttttcctttaaatatattcacatgattcggagcagtgtttggaattttcaagatgttggtattcttcaaatgtttcagggaccaaatagttatagagatcactggaaaatgatggtgattttcctcctcaacttattcttagatagaaattgaaagaaaccagttcccctaagggaaaatattttcccttggcttcatgaagaaaacacaaggatatgtgtgtagaagtagttgaatggctggttgacttgagtggcttcatcaaaatggaggcccctgtagagtaatggtatccttagtaggttccaagttacagggatttcttggcatgaaaaccattgtgctctatttgtgtttgaaaggcctccattcattgggctggttgtttacattggcattaatctaattacattccggttgttttgaatttagtttagatatgccataagtgattctactttctataatcatatgcagaaattacaaagtagcagtcaacgaattacttttaaaataagcaaacactggaacaaccaaactcttatgtttttcaggagcaaaatccaaaatgtaaacacacactgaaaagctctttaaaaatcaatgaaagatactgtgcttttccaagccagaattcttggtttcccttgtgattgttaaaacaaaaggaagcaaaactcttgaaatggattcgtttcagcattttcttccccacatctaataagagggaatgttttccagcaagataatgatggggagtcaggcggaaagataggggacttaggaaaagggatagcagcagtgatattagaatgtgaagctggaaactactgctcccaggactaaatagtctaagtgctcccaaatcttgtgtccattaccaacagggagattggcatgtctggtttggaaagcatgtttttaatttgcatttgtctaaaattaaaaagccaacttcttattgggtgcttttctccccctgctgtctctggattatttttctgctgtgagctcgtgctttatctgcatgtgtgggctgtgaaggtagtatatgactgggcacctgtaatcaaagtatggtaaagaacctaaacctagaaacattatgttgtttcctgtataattcaaagtcaaagcagcatcagtaatataattgtaacaacgtccagcaaagttctagcttttctccttgtcaaacatttatttattttcttttaaaatatcaaacaccgttttagattttagaaattagaaaaaaaaagtttggtgactttgctgtcccctacatacatgttgaactctctggtgggtactccagcacctgttggggctgaattaagcattttattggctacttatgtagaaaggaaattatatttgatatattaatatatttagtagttgagagaatagatctcaggaaagctaagtaatttaacagatatcaacagatattgtgaaaacaagaattaaaatccaattttcttacttgttcaattccctggtcctcctctacgtttttcactgctggctagaggactgtcttttgtatcttctctagggcttaaacttggcaaaaatgtgaagtaggtgggattggaggaatgtgttttgttccttcagttctaccctctcacttttcatttcacttgcatcctcacaatttccacacagctctccctttctactttgtctactctcagagccttcttggttcacatattcgcatttacacaaatgatgatttaggtttaacattctattatacccaggggtgtggtcatttttagggacaagcaacaggatttagagggataaatggttcagtagtggaatgttgtcttttgaaaagtgatattttgagaggaatagcccctcattgtctattactcaaatttaatgcatattacaaataatgcttattttgtttgcaagaaggttcattttttttctttcttccttctttttactttctcttttttctttctctctctctcctctccttctttctctttttttcttctttctctgtctctcctattcattctttctttcatcaagtggtacatgtctactgtttgtttctagagatgaaacctaaattatagtcttacattcataattggcagttagtgagtccaccttatttttcatatagacttcttttggtaaaatttcactgcattatcatgatatattaatccatcttgatactatattgtaacttcctctacacctaacaccctttaccttgtctttgaggtccagggacctgtttaaatacctctgttcatttttataatgatacaatctgtaactatcaatacatgtccttggtttaaaaaaaatataaataagatagtaagtttacaactcacctatagctttgttaacctttttttctttaattcttaaaaattatttcaaagtcaaaacggcttcaatttactttccactgtcacgaatttcactctgtgaaatgagaacaactcaaacttcacattgagaagtattttctgatgtttattagttgtgcttgtatagtactgccaattacatttattagccctaaatattaaacagctggcagaattccattgtatataaataagacatttgagacctggacaagtgccatgttgaatacagccagctggtgctttttacagtttttttcgggctactagtactgatgccacagtacattcagtgtttaggtaaatgacaatagaaaaacatgttgtgaattgggaattctataggaaattccattatgtagaaatatagcatttcaaagacttttaaaccaaggaaatgatacgttatgcacctgttgattgaatttgttgaattttgtgttgcctggaatatgtttttaatctttaatttactgtgtgcccattttatattgctgagttatgccatgcaaaatgatgactgcttttatgtttcgtcttctaataaaataaatttttatttcagatttattttaattataaaagtgtattgaacttaatagtagtatacagtttagattctcactttatatgtagaatttactctttcagagtactacagactttaatttttatcctcacgaatatttttatgttcatatcctacctttgttgaattactgtataaaagccctttcttattacatcaaatttgtgtttttgaaaagcaaacatatttataatatgcttaatgtatattaataagtaattaatatttatttatgaatgtatttaatatatgagtctatacattaccgatttattagtattcattaataaattaataaatattaataaataatatacattataaataaatgtatatatctatgcatttaatacatatttatttatatattattcataagtgtataaagctatacatgtattatgtaattaatttatcttatttaatgtgtattaataaataattgacatatatttacaatatacttattgaataagacaaatgctagtaaagtgacttgcactgttgcaaatataaaaaatatgttaatttaaattaaaaaatgaatttgagctgatgaatatcagtgtgattctaaaaatgtccctctgttttaaaagactatatgttcttaaatttaactggtaaatactgtagaaaatatttgttgatttacatgatgtgcgagagtgtgtgtatgtatacaagcatgtgtatgaaaagtttaaattaaacagtagccttgtcaccataaacacttatctgagataattggccatgacatagctttgtaggaacacttcagaggctgcgctgggcttgagaaatgtaatataacaactctcttgacttcagtgaaataaatgtatattatatattaattaacactaaaaatctcttagcaccacaaacctgctttctttgacaattctacatatattttaaagtgtataactggtatctcctaaacagaaacaagtaatctgaaaaaaattcaggattttaatgggcaatatataacaagttactttattccaataatataaaagaaaactagtaggcagaattttgtttttatttattttgtgatttaatgattttcatgatgacaataaatggatacattcttgtttgtaattccccctttaatacccacacataatacttcctcaataaaatgttattgaagaaacaaatagatgaaacacatccagataaaaataagccagctacgatctcgttctatcataggcacgtgaatgacacccatgttgccaaacgctgtggctcagtcgtcaaccgtcaccttgctcatcttgcagaagtatttgggagtgcttactgacttttcttcttttcatcatcgacttttattcagaaacttcttcatttggtgtcagcatactattttcatagttctcttgctttactgggcactttttcttaagctctttcctagattctcccaaaaattcttgatttctaataaatgaaaaattctagaactcattcttcaaactccttctattctctgtacaatcttttcctagccaatatcaccatctacatattgaccgtccttatattatatccttgacttcatcatgctcctaaattccagactcataacaggtgctattacaaacttcacttctaactaatatatccaagatacttctatattctttcaccaaacctgctccttcttcagttaatctttcccatcttaataaatgattttcttcttcacatcattcacacctcttcccatgacaatttatcagagctgtgatccttgaccactgtgtccctctaccctccttcattcttcactatctgttctctttttcctccttaaaagtaggttccatgaaacttgagactgctatttgtttatctaacagcctctatccccagttttgaaaagtgtatggttcatactaggccctcaagaaatacttttgagtgagttaaatataagactatagtaagtgcttctctcatgtgctatctagactagatgcctgtgcctggagtgtaatacctggagttaaatggattccagtttatgtagaaagtttagaaaacatttctgaaaggaataaattttagtctttctcaggagtatgaagaggactaaatgggaaggattgtccttaccttatgaaatgagatgtataccttaaactataattgacattaagtgggattctagtattaaagtccaaaccttcatttcattagtattaatgtccaattcttcaatcctaatataatgttgaaaactatactaagagactgggcacggtggctcacgtctgtaatcccagcactttgggaggccaaggcagggggatcacgaggtcaagagattgagaccatcctggacaatagggtgaaaccccatctctactaaaaatacaaaaattagctgggcacggtggcgcgcacctgtcatcccatctacttgggaggctgaggcaggagaattgcttgaacccaggaggcggaggttgcagtgagcccagattgcgccactgtactgcagcctggtgacagagcaagacttcgtctcaaaacaaaaaacaagaaaactacactaagagacctagctctagtctaagccacttttctcttcttgagaattcctcgtttcctgaacgttactttgagttctgtattgctcccctgacaaattctttttattccaaaacagaacccttgctttcatttgcaatattttttcacattatctattttttaaaactaaattactgtaagtactctattttaaacaactggttactaaggaggcattaattgtgtccattatgatctgcaatttattattagtacgtcttcctttgttcagtagccctgccattttgcattgagatttaatactggaaaacaaattttaaacccagttcagctcatttggaagtataatttcaacatgagatctgagctgaaaacaggtacctcgttcagaaatttaaacctaagacacttcctgtgcaacagtattaaacatcctctatctgtagcagctcaaggttttactatttaaccattttatgactactttacctaaaagctgcacctgcttctttgatttatattatatatcttattgaaatcaggccacactttcctttacttatttttttaacacttactaagagaagctgataaagaaaaatattaacatttctggaccggtctgatgatagtactttaaattatttttcctaactctcttcaaacaaactaactctcttatttttcctaactctcttcaaactcgttgtttgccaggtgagtctatgaaaacaaatgaatcagtcatttcagagaacaatatatctaccaattaactgggtaaccaattaaccaattacctataaacataggctttattttaatattaaacatttaaattttgtataaatattgttacaagatatattctttgttacatatactgtgactaaagaccacagactgggtggtttaaacaaaagaagtatttttctcacaggctggaagtgtgaaatcaacatgttgacacgattgcttcctctgataaccttgaaatacaggtgtaattgcataaagttgtagtttttataaatataacatttgaaaccccaaaataatatattctgtgaatatcttctctttatgtaggccatttacaaaatatggaaacctttgagataccacagttgagaagtatctgtttcaagcctctctttctggcttataaatggctgtcttctcgtgtctcttcacattgtcttccctcaatatatgtctgtgtccaaatttcctcttcttataaggcctccgtagtatcgaattagagctcacaataataacttcattttcatttaattacctctttacagatcttctctccaaatatactcccatcctgagatcctgagggttagaacttcaaagtatgaattttgggggtatatgattcagcccataatatatgtttaaacgtttacccatttcattttattctttttattggaaatattaaaatacaatattcctctttcattggtgtagtaaacattgactgggtgacgcctgccagatattatgctagcttagaagacaaaaatggatgaatacatttgagccacagtgcttattaaaaattaaagtggagtttcttctgacctttaatgcactctccagcttaccagagttcccatgattcctaattgtacccaactagtattatatttttatttttatttttttaattttttttatttttttattttttttgagacggagtctctctgcgtcgcccaggctggagtgctgtggcacgatctcggctcactgcaagctccgcttcctgggttcacaccattctcctgcctcagcctcccgagtagctgggactacaggcgcccgccaccacgcccggctaattttttgtatttttagtagagacggggtttcactgtgttatccaggatggtatacagcctgtgagaaaaatacttcttttgtttaaaccacccagtctgtggtctttagtcacagtatatgtaacaaagaatatatcttgtaacaatatttatacaaaatttaaatgtttaatattaaaataaagcttatgtttataggtaattggttaattggttacccagttaattggtagatatattgttctctgaaatgactgattcatttgttttcatagactcacctggcaaacaacgagtcttgaagagagttaggaaaaataatttaaagtactatcatcagaccggtccagaaatgttaacatttttctttatcagcttctcttagtaaatgttaaaaagataagtaaaggaaagtgtggcctgatttcaataagatatataatataaatcaaagaagcaggtgcagcttttaggtaaagtagtcataaaatggttaaatagtaaaaccttgtctcctttgtctcgccctagtgtgtgacttcgggaccttccttaatcttttggcagctccctgtcttcatcttttgaaaggagatattatttatttttaacttgtaggttggttatgaggactatattaggtttataaatatcaataacttagaaaagtgtctggcccatgaaaaacatgtagtgcgtgattaaggatttggcaaacccagtgaaagaacgtccagatccaagaggagaatcctaggtataatattttgttctagaaaccacactacattatggagtgttcattaacttacattcaacacctacaatactgtgagtgactgctgatattgaaaatgatgtactctgagccttcgtagatccagagttataggagtaaaagtttaattttcttcaaaatagtaaggctaagatttgaagcaggaaactataataataaatataaataaaaggtaaaatatactatatatactacatacactaagaaatattttatgtaccaaaatatattcatatatgtatacacatcaagtagaaataaataaaatgactgtaggatttaggaattagttctccaataaccagaatacacaattgaccaaaatatttgccttctggtatacttataaaaatctctaaaatatagagttaatttggttttcttcaatgtaatcctacttaatttcatggtattgacttggatttcatattttgaatagaggatcctaatacagagaaaactggtatatgttaccattttaggtgtcataaagctctagaagctgaagaattctctggagacatgtaatattaggcaaataaaataaggagccatcctgctcctaattcagagtaagtaactgctttaaaatatactggatttatttagcctcatcagattaggatatagccaaaatcaataaataatcacttgtaaaatttgaggtagaatttagagaaatattttcaaataaatatatttttacacacctattattaatacataaactttgaatgagtttgtaaataatctctgaaatcttttgtacaaagttggaacaaaaatttatctggatagtaaatagaggtataattgcataacgttgtagtttacataaatataatatttgaaaccacaaaatatctgaatatcttctctttatgtaggccatttgcaaaatatgaaatcatttgagatgccacccaaaaaaatggttaatctgtgaataaagacaacaagatctttgtagcttaagtagctggccattgtttttgggtttaaaaatttcttttaagttcaaaatattgctctgataagctacaagtttgtagctgctccccaccaaatgatagcggccttggcattaccatgggaacaattgttacaatttgataatcctatttttcacaattcaatttgtgattagaaagattttcttcatccttgatcattttgatgtagaaaggatttgttaaaagacacaaaattacagttagagaggaggagtaagtgctagtgttttatactgcaggatagctaccgttaacaataaaatattatatagtttcaaataactagaaggaggatattgaacatttccaacagaaagaaatgataaatgtatgaaatcatagatatactcattaccctgatctgttcactgtacattatatattccaaaatgtgactatgtgccctatgaatatatacaattattgtcaattaaaataatattttaaatgatattgaataaactacttttttagaaaaatttaattacacaaaatgatatgagtacacactatttagctttttaagtgtttcccaatatgtttacctgctatgaacatgttatatgaatagtattgaaccatttttctgagctcaaaatttataaatgttccttcatctctaaaatttcatgtccaagtggctatttatggttctaatgtatttcattatttttgcttgtacacacattcacattaggctatgaaacggaatgcactatatattatagaacatttgtaaacatatgataattttcaaagtagaatatttatcacttatgatttatttataatcatttttaggtcaggattaaaatgagatttagtccattcccaaatattcttccagaaatgtaacttttctttaaaaatactaatatttcagaacttgttaaaacatactctttatagtacatggattgatgtgctaacaaaacgatattttaataagataactaggttcatctaaaattatagtaatactatatttctgtatttgtttcaaagttattaatatttgcctgtaactggcaaatctcgtattaagtattagtagagcagagttttatccagactgactttacaattagtcccttctgccttgcagaaacaatgtggtttattggcacttgaacaggtctaagagtaagaagatctggtctaggttggacttttattagctttgacattggatgtgtttctgtctctctctgtagatatcgattaagaaacctgtaaagaaagttctccaatctcctatagaatctattgaatatttttctattcaataataaaattgttaggacaaaatctctgtatctgctttgacttcttctctgctatgctttatgaagtaaatgacgttttgtgaaaacctctgctaacaaaaatacatgtattttttatagtcaatatctgtcttcttgtcagttcactctcctcagaccatactttgctctaaagcatcctctataatacctatacagttattgaaattctcttctctccagcaactctgacattgtttttcccttgttctattctcacctctgcaaatgctccttttccagcagtatataccatgccgaacttgaaaaactttttgatgtgggaacatttcaatatggatgttggaaagagcaatttcgataatacagtatttccacttctctcatcagctcatagttctcttcctaccctgtacacacaagcatttcataatacagtttccgacatttcatttttcttgtatttttttcttttttaaacataagatttctaaaactttaattatatgactccaaaatctgaatttatatgcatgtaatttttttttctgaattctggatatccatttcaacttttgaaaacattctttttctgtgtttcatgttgacattattagattctacccatattaaacttttgctcctcttctttgcataagttctcacacctgttttgctgctctttctgctcataacgttatctccaagtcaccaagacaggttcataaaaaacaggaaagctgtgcaactgaagagttctgggtttgaatctaggctccaccattaacagctaacagatttaggggaagttattgaaccccctcctaagcttcattttgtctcatctatagaattagtagatgatggcacctgcagcacagggttttcaaggataaaatgatgcaatgccagaaaggcccattaccttgaacataaaatggtcaatatgattatccaatgttagcttaaaacctcagagtcattttcaggtttttagttttctcaaaacaaatatcaatcgtttgtcaagtccttgtcctactcctaaaatatttctctcattcaaaaattagttcatttatttgcttattcaatgagtggattatgtggaactgtcctgggtgttgggtatcagtaatgagcaaaatgaacaagtcctcattacctgtcccttagataaccacagtaactctcagatccatctgcctccattcctcatctagcccatcctaaacactcttgccaaagcaatgtacttaaatctaattgttgcttaaatctcacgagtgatgagaaaaacttccattatattccaaaccatctacatggtcattccccactgttctaattttctactattgtctttatagcacccagagtgattctaggaaaaagtaaaacttgtcagtcttctgctcagatcccaggattgggctaaactcttcaacccttccccttcctccttctcccagtcattctctttacctctctcctctgaggacatacaagatactgtctaccttgggattctttactgctgtttcctttgccttgaatgatgtttcctgatgtatccatattcttttattcaaatagttcaccatgaagtcttcctctgacttgtctcatcctttgaggttttatttaagtatcacattttcagtgaagacttcccaggccattcattttgaaatcttcccctcctctcaacatacacaactgtgtcctctctctggcttccgtcattgcttctcctgaaaacataacactatgtaagaaaacacattttaacacttaattttgttttgttgtatatctctcccactggtatggaagctccctgaggagagatttcaagtcatagatttcaagtcatcattttcactgctgtaatagcaccttatagagtcactagtgcataacaggtgtttgataaatatgtgttgagttagtcaatgaaagatcaacttcatctctcactgcagctgcccagtgatgtccaaactcagttggaattttgggggttttatgcctttttccatatcatttcacctgctcggaatgtgctcatcctccttcttcctcctcatctattttcactagtcatagtagtcaaaattatacattttgacatagtagtcaaaattctacttatgtttaaatttcttccctaaatgccacctcctgactgctaattttttcctctggtttttgtactgggagtggcaactttcaatagcataaatcacattcaacacttttctctcatgtcccacatcaaatctataaaatcccgtggctctaccacccaaatggttttggaatctgttattttcttcctatttccaccaatgctatcctatccagactccatcctatgtcacaaaagtattacaataacctcccatcccacttcttagaccgtcactccttgctgtttctcttcagcacagcagcctgtgacctttttatgacatgattcagatcatgtcactcctctattcaaaccctttactaaatttccatttatctaaggataaaatccaaagtctctcttatgacctaaaaggacctaaatgaccttctactcaactacttctctgatgtaatgtttcatgacatcttgatcataatggtagtgccaagaaatggttttgtagaatgtaagggcttcataaacatttgttttatttagcaggtaacaactgtgtaagcacttactatcgatattatctattaagccactaagcaatcctgttagaaaggtgctattattatctccattttaaacatgatatacctgaggcttaacatactgcctggtatgaaataaaaacataaaaaaaaacataaaaacataaaaaaaaaataaaaacataaaaaaacttatttttattaaaatatagaatatatctcttgacgtgttatgcagatagatggcagatatattttacttttaaaaaagataatagtgaaaagaagtgaagtcaagtgtctaataaaattacagaaatatagaacatggtaaagtgtggaatactattggcaaagattttattccagtttagaagggcaaatttatcttagaaaaaagatagcagactcatttctcataaaattgtggctgggcacagtggctcacacctatattcccagcactttgggatgccaagacaggtggatttcttgaggtcaggaattcgagactagcctggccaacatggtgaaaccctctttctaccaaaaattacaaagattagcctggtgtggtggtgtgtgccttagtcccagctactggggaggctgaggggggagaatcgcttgaacctgggagacagaggttgcagtgagccaagatcatgccactgtactccagcctgggtgacagagcaagaccctgtctcaaaaaaataaaaataaaaaaataaatatgcaaagcagccaaatattcagttaccttttgtcaattatatttagtgaatttcaaaagagtaaaacagacttacactggtcataattgttatagcctcaaattagaagaaacagaaactccagcaagtgaaaaggaataataaatagacaaactttgaatttaaaatacatttatattattttataaggaaaacaaactagtatattccggtgacatttttggttaactcagctttgtcagcataataataatgaatgtttatttgctgcttcccaagtggcaaacacagttacaaccattttaaatggacaatctaattttgttcacaatatctctagaaaatgttattattatttttcccattttacagatgtgtaaattaaatcatactctattgaatctcttagttattaagtagtagagctaggtttcaaacacagggtcttttatctctacaggttagacccttaaatctaggctcctcaggatactcaacggataaaagattaaacatgtttctatgaagtattgttgctacccttgtgaagagaacagtagaaggggtctctgtagctttaaaattggtgctataaaacagcttacatttcagagaagtgctctcaaaaattacacttattttgttaaaaagtaaatttagctatctgaagatctgtaaaacttagcatatgttccatagtgacaccagttaatttcatttccgtcaccgggagtgctccgcaggtatattgtaaattgctatgaattactgtggctgtgacccattatcatagcaggaaattgcatgaatctcacaactgatatgaaatatactgctgtcactgttatgcattaatttctaagtagttggtcatttgtaataattctgtaaatgtccatcttagcacagttttcagtctagacaagttaagccaatgtgcatggaattttcctcattatcttcaagcagttatactgaattctaaaattacttttttattggacaatttcaccttgaatatctttccaagaattggaaacatgctagtctcattgtcctactctctaatacttaagggaaatttactctataaaaagtaaagccatttggctatatatgattagaaagacagagtgagaaaatctctgatgaatgtcaacagtgtatttttttctttctaacttgtattgaatatattaatgatttattagattattcttaaatcgtattgactcccactttactgaggtaattttcagataatggtatacttcatcacgatagttttaaaaagaacatttttgcaataagtgtcctttacattataagtaaacatatttcaccatttaaaaaccaaacctttacaatgcaaattatacttttcttctcttttctttgatattgacattattctcctcacaagaaagaaaattcaaatagcacacttcattgaaacttcttgacaatggtgaattatatgttgtctccctatgttatactttatattttagcataacatatatctgtttcgagtcaatgcttctggctagaaattctcttctttggtaaatctttgaatacttttaataatttttgaatttttttatttccaccccaccatatctcaggttttcagatgctttttcctttatcttccaaaactattttcaccctctatttcaaaaatctgaattataaatttactgacacatagtttctagaaatgtataccttcttcttttttcctgtaagtctgtcattggtcttatagttactcagttaaggatactctgacagataactgtctacattactgattttctaaatccaatgcctcatgtagccaaaagcacacttctgtctgtactttgtataattttgacatttggcacattgcatgccatttaattttagtaaattaaaatagggcgcttacttggttttaggcacagggctagatgcttgggaggggaagatgaacaaaaccagagaccatggagggcagcaagactaatgaatagagaaatgagtgagtgtgttttatataaaataacagtagatataactggtagatattatgttctataagaacagctatcctgtctatctgtgttataactgcattatcaatatagagcctgatacacaatattcaataaacaaaaatttgaatgttcttgaaaggagaaatggagtctacattggacattatttcacagagaaaaattaaagatatcaatttatttatatacacgtaccttgtctctttttgttgatgctgcatctttcagcagaaagaagaatcattctgaaatatgttttggtatatccaaaattctaagataagctgagttactatcttcacatgtagatattcactgtgtgcattcataagaaaaaagagcatctctttataatctttttgggaaatgttcagtatataattgttcaacagaagtcatcttaagaagtcttgcctgggtctttgccatggtcttgctaaagctcttctcttttttattctttattgtaccaactcccagtccagagctaaccatgcacctctcttcagtagtttctcactgtagcaaatgaggcagagacacattgcactgcccaaattgttcctggccttacatttctaagtatgccagggccttgaataaggtagttttgtccaatatctttcattgtaacactgatgagaaataaatgtaattcacagccagggacactgtctggagtgttcacatcgtccccatggctgcatgagttttccctgggtactctgtttttctcccatatcccaaagatgtgcccgttaggtgaactggcatgtctaagtgttcccagtctgagtgagtatggtctgtgtgagcgtgcccttcaataccatagcttcctgtccagggctggctcctgccttgtgccctgagctgctgggataggttccagccaccccagccctgaactggaataagcaggtgtattagtctgttttcacgttgctataaaaacactacctaagactgggtgatttaaaaagaaaagaagtttaattggctcatagttctgcaagctgtacaggaagcatggctgaggaggcctcaggaaacttacaatcatggcagaaggcaaaagggaagccagcatatcctacatggctggagcaggaggaagaaagagcaaagagggaaggtttgcacactttcaaacaagcagatctcatgagaactccctcaatatcatgaaaacagaaggggaaaatccacccccatggtccaatcacctcccaccaggtccctcccccaacattggggattaccattcaccgtgagagttaggtggggacacagagccaacggttagaaaaagaatgaatgaatgaatgaataaatgaatacaaattattttaaaataaaaatctgtcatgtgtacaataatcatacaaatacatggcattaaatgaggcagtactaaggcactccacaagccaccatatttgccatggtttttgaactacacagtgggaggaggtgctccttaaagtgtttactttgcaaatgttcattcctagatgtaacccactacccattctgaccactgtctcgcagctattcaccaaaaattgggttaataatcatcttgttttcatgaatttttcttaaatgaatctgtatcttacatttatttccatgtttaatattagaagtgcttcgagtgtttatttagaaatttggtgatgttttcataaccagaaatatgccatgggaagttaactcttgtttatatcaattagcccagggtaaaattggttttgttatacattgtttaaagtcacagtttccaagaatctatcgaggatgttaagtgtgaacttcaagtacttgtccacatatccacagcccgctgccctatattccaatcgtactggaacccagttacttaaacaggttttgtcctcacatttgctaagcctgctgacactttttctccctctctgtgtcctccttaattttcacttacagaagttccaataatctcatattttcatttccgtatccttttccaggaccttccttcacatgataatctttcctttctcaataactccttgcagtacctcaaatacagaacatattgtcatctactgtatgtgttatgcctcctccaccagcatcaatttctgataagaaaaatcacattttgtggccaagcgtggtgtctcacgcttgtaatctcagcactttgggaggccgaggcaggcggatcacttgacgccaggggttagagaccagcctggccaacatggcaaaacaccgtctctactgaaaataaaaaataaataaataaataaataaaaagtagctgggcatggcggtgcatgcctgtaatcccagctactccggtgactgaggcaggagaatcacttgaacccaggacgtggaggttgcagagaaccgagatcaccctgctgcactccaacctggatgactgagcgagactctgtctcaaaaaaaaaaaaaaaaaaaatatatatatatatatatatatatatgaaaaattacattttacttatctttttactatacacaatttctaatttaagctttgcacatataaatatttaatatgtccatgtaaaattgaataaaactgcaattataagggcgttttcaaaaatcacaaatcaccacagaaaatcacagtagaatgctatcaaactacagcaaactataaaaatagtagcatgtctaaaatcaattgtcttcttcataccagtataaatatgtgattgaaagttatttccccacacactgtttgcatgtttttgtaatacacctacctgttttgtcaggtgttctaccaccagatgtgaaatagaacactgtgaggatttacttggtttgttataatatcttatcattccttgtaggaggtagaagatgaggttattcaggtgagcttctgtgtaaggcatgcctaggccctggcaaatctggagtgaaaaaccagatgggataagggctgaacatgagaccatgctacagagacaggggaaggacgacattttagacgcagtttctaaggagactcagaattcacggaagctgatattggagcatcctatcagttcaggtagagtgcagacgttaaaagtccagttggccaagggatatatagcattagttctcagtgttgggggttagaatgttagaatcacctaggtttttttggttttgtttttgttgttgttgttttttttttatctgggaagcagtattttaaaaaagcttcctggttccctgcttagccggaattaaaaaaaaaacaaaacaaaacaaaacaaaaaaaaaattacataaaggaattaaacagacttaaaggtatgagacatttgtccaaaggtgcggtatcattgcaacagacctgagatctcagtacagtaaccctgaatcccagctgggagaaaaataacttaaagctccggctgggcgcggtggctcaagcctgtaaacctagcactttgggaggccgaggcgggcagatcacgcggtcaggagatcgagaccatcctggctagcacggtgaaaccccgtctctactaaaaaaaaatacaaaaaatcagccgggcgcagtggcgggcgcctgcagtcccagctactcgggaggctgaggcaggagaatggcgtgaacctgggaggcgcagcttgcagtgagccgagatcgcgccactgcactccagcctgggcaacagagcgagactctgtctcaaaaaaataaataaataaaataaaataaaaatattaagaaaaaaaccttaaagctcctagaagagtggagctgaggctacttcaggtcttctctcagtctaggggtattaaggaactagaagacagagaagaaaaacacagacatctatgagcccagctgcgaggttgctgggtaaagcggagacagaagggacaacatactcaaactttctggagacattgtgcctttaatagcctgtatcttgttaaaaccacagaaagtactgaggtatgcccaatattggtgagaattctaagcagggatcttacatgattctgttcctagctcttctcactctctaaaatactttgttggctttcctcataataattctgattcttttacatttgtctttgtttcccagatcttttcagtatactgtgccaaactgtggatattggcttttctatattccataaggcaattctaataccattaccaaatttctgctgaaaacttaggggctaaaggtggttgggtatgaatagtagccattataattaagataactgtccacatcttcccacatatgcccttttcggtcatatttgtcttcggatcctgtcccacatcttgttaatcatagggattttccaacatcaaatctccatcttctgtcttcctgactcctcggccacaaatgtaattctctgatttgacacaccacacacacacacacacacacacacaccccaaacaaaaaaacaattctattcctcatttgtctcaactatttgacattactctgatctttttataatatacctttagaaatatatatctgtgtgtaaatgtgtgtgtgtgtgtgtgtgtgtgtgtgtacttttgagaccagaatgggctaaggaaaactacttatgaataaatagaaatataatgatttttgtagatatatttgtgcgtgacacttgacagtgacagccttgctgtaagagattctgcatgcatgcttaaaatgctgctgcctggtaaatgcccaaatacttccaggacgaagactggattttgaaatggctatgagtgtacaaggggaaataaacataagaataaaaaacgtgagtggagaaaggaataacatgaaccgacttaatatcacttaaaattactgggtgcaagattaatcatcatcagcattttgtaaagcgcagaaattggtgtttcttataaaccattgaaatgcaaaaataatgtaaatgtaacaatattgctgatgcatttcccttatattgtcatccacaaatttcttagaaactggttttaagtcttaaaaggtaaatcatgactatcttgcaatcttaatattttccaaattatattagcttgtgcactaaatttattgcagcttctgtttctcttaaaggaagtgtaaacttcctcctcaccttactaccccttgttagcaaataaataaaaatgttttctatgaaagtaattaatatcaacaataaatataaattcttaattaccataatgatgatatactagcataatagttattaggtaaatgccagttaattattaaaatatatgtttccctcaaaaatatatgtttgattcagtgacaaggaactgtgctatctagaaaatataaactaagagcctccttagtatcttatactacctttgatgatggagaggtttggtgtggttattttcagaatggactgtccagtgggagaaagtttggatgcataggtttcttatacttgaaatgatccagagaaagatgaaaatacaaggaaccctatgtggtctaataattaaagcttaaagtcaaaatctggaagctaggctaaatatcagaattgtttattttaatgagttagaggttgaaaaagtattttgagctcctcttttgtttgtatccccttctgctgaagctgttactggtggataccaatcacagagatttcttgaaagcattaagaaaatgaagagaaagatgcttttcaccaccaaattctatgttaccattgctatgtctcccttttttttttcatctctgccttgagacaatttctttagcaggatagaatctctgataaaatataatgataatatataatgaatattatacattagttcttacagtagaaaaatgaatgaaacatgggcattctttacatttacaaagcatgagcattataacagcagctttaattaatgattttttcttgttgctgctgctatgagaaaatattcatttaagaattttatttctactgtctttagtcctcagcaaatgctagagttagagacttgttgttttcgcaagtggtctgagatggcacatcaccatcccttacaagcaatttggccttcattacaaattaatgaagtgataattgctccttgcaaccttttatgtgcaaagaatgctggttctgtttgcattatcttcttgcaatgtacacctctgttttcaaggacttgtggtatcttgccaaatgttaaactacactgagatctccataattaaaatcatattttacatcaagttatgaaaacctctacacaatatgttctgtttgatgtccagtaaaatgctgttcattgcagaataaatttgcaaatgattcatcaaagtaacaatctcatttattactaaaaggaaatcttgacttaagaaatttaaagtcaattggtttacattcaaataatattgtcatgatcgaactttctataagatggttatggaaagcatttgttctctagagtttttgctacatctgtactttaaaatgccattgtagaaccaaggtaatgttactagagaagactctataaaacactaacttttaacaccagagatttttggagcaccaagtctgttgactgtttttttatattcaacatatacattcattttgctttgaatgtgactgtattattataggcacctcaatgtaaaaccctaagaactgagacgctcagttgctcttatcttcttaaaaactcagtatattacatacatatagagtggatgcatgaaaattgtatattggcaattattacaaatataatgtgaatattttctttccttaaactgaggttagaatgtatcttgtatattacttctgagatcttctaaaatagtctcaacttgtttcgttgttgaatctcggatgtgacaatgaagctaggtcaattttgcctccagaaaatgagtgcctatcttgtattttagatcctgaacgatcaaggtttttaaaataaatagtgctgttaacttgttttgtttgtaagttaataggtgagctatgaagaactagaagtttttaaactgtgattgtcacaacagtaaagttcacaaattgttttttataatttaagaatttagtataaaaaaatttcccctaatgaggcttaaaggccaaataaatgtcatgttcctttgtttgtaattaccgacaatttaataaattaatattttattttattttgtgattagaaggtgtgaattaaaatttctgtgtctttaaagatggcaacaataaaaactagggactgctgaaggagaaaaggagggaggcaacaagaattgaaaaactaactgttgtgtactatgctcacaacctgggtgagaggatcaatcatactcaaaacttgacctcatgcgatggaccaatgtagcaaacctgtacatggcccaaactgggaaaatattcgtacagatgaattttaggcagtagtattttttattctttttttaaacaaacaaacaaagcaaaaaacacacaagaaaatcataacatagtgtcaatagaaatagaaaaaactgttaatgcattttatatgctgttgatttagttaaaagtgtttaatgtctattgttcttgatgaaaattattaatgctttattggagaaaaatgtaggaacacatttataatgggcttcacaagggttttattcataaatttaactacaatatttaaatatatttaaatattttctctaagaaaaacgttttgttgtattcccatgaataactcttacttataagaaaaataatatttgtgcatatgccaaaaggtgaagttttgtgctccatactacagtgaatatgaagagacctgcctaaaatttagcaaatgcctatgaaacaaaattaaactaactttagcatgtatcatgaattaaatttacaaatgaataggggattcaataagggttctataatacagaaattttcttaagattgtcagggttatggaaggcataaggcagaagaatgcacagtcccatggggttataccgtaagaaaggcatattccagatgggcacagtggctcatgcctataatcccagcactttgggaggccagggcaggtggatcacgaggccaggagttcaagatcactggccaacatggagaaaccccatctctactaaaaatatcaaaattagccagttgtggtgttgggggcctataatcccagctattcaggaggctgaggcaggagaattgctttaacccaggaggtgaagattgcagtgagctgagatcgtgccattgcactctagcctgggcgacaggagcaagactctgtgaaaaaaaaaaaaaaagaaaagaaagaaagaaaaggaaggaaggaaggaaggaaggaagaaagaaagaaagaaagaaagaaagaaagaaagaaagaaagaaagaaagaaagaaagagaaaaagaaaggagggagggagggaagaaaggaaggaagggaaagaaagaaagaaaaaaagaaagagaaagaaagaaagataaaaagaaagagaaagaaagaaagaaagggaaggaaggaaggaaagaaggaaggaaggaagggaagattccacaagttccacaagaaaagaataaaggacagaatatccaccacatctttcgtaaacaataaaagagtttacattgacaataatataatatgtggaaatattacttatctcgattcaaacacttagaaaaattaacatgtggtttaggaccagttttaagaggaacacaaatgtgaaattcaagagttagaaagtttttgcgtaagtaacagagatccctagaaaactttacattcaagaatggcatgacaaaagatgtagtttcctgcaagaagtaagcaaaatggggcataagaggaaagtatggacacagagataacagaaacaactggtctaatagttttaggatcataagtaacacacacttacgatgctaagttaaaagcttctcaaaatttgtcctaaggatcacagaaaatagtgcttcactgttctcaaaagtctgaatgcttttaaaggtttttacagtgataaaagttgttctaagataaccttaactgctataacaacaaaaccccaaatatctatctatttcttgactaagaaaagatccaatgtgggtgcaaaaggctttaagaatcgaatgtttgccatgtcttctgtttttcacacataacttggttttatatttggcgggaagctgtggggtgaggaacatttctatttttacttcaaatttttttttcatagttctgcaacacatgtccattgaaatgacagtacattaaaaaatgtcatgcatgatgatacatagtaaaaatatcatttatattcactttattttaccttatatcaattttaccaaaaacctggcacaaattgggaaaagattaataagcatgaattttaggcagtattattaattttttcttttttaaactgagaaaaacacccaaaaacatatgagaaaataatattatagtgtcattggagacaactgatttgaggttttgatcctggaatgtttgattaggctctattaactgctaagtgtctttttcctgaatattcaacaaactgtaacgcaattgaaatgtgttcatcaaaattataaattactttatgtccattaactcagagaaccttgcaaataaaaactacaaacaagaatgtttttaatgagtaaatgatgatttattatatagagatggctctgacacccttatgttgtattcgttattatcattaattctgcctcactctctgtttctctttgattcttcagtgggaagagatcagtggtgtggatgaacattacacacccatcaggacttaccaggtgtgcaatgtcatggaccacagtcaaaacaattggctgagaacaaactgggtccccaggaactcagctcagaagatttatgtggagctcaagttcactctacgagactgcaatagcattccattggttttaggaacttgcaaggagacattcaacctgtactacatggagtctgatgatgatcatggggtgaaatttcgagagcatcagtttacaaagattgacaccattgcagctgatgaaagtttcactcaaatggatcttggggaccgtattctgaagctcaacactgagattagagaagtaggtcctgtcaacaagaagggattttatttggcatttcaagatgttggtgcttgtgttgccttggtgtctgtgagagtatacttcaaaaagtgcccatttacagtgaagaatctggctatgtttccagacacggtacccatggactcccagtccctggtggaggttagagggtcttgtgtcaacaattctaaggaggaagatcctccaaggatgtactgcagtacagaaggcgaatggcttgtacccattggcaagtgttcctgcaatgctggctatgaagaaagaggttttatgtgccaaggtaagagccttctctatttttctttgagcaatatttctcacctatgagtttatcatagtgtcattaaatgaaatgcactcagtctcaactcacttggcaggaaaacatgcctcaaactgaccatagtctatttatggactaaaattaattccatttgatgtggtaattcatgctttgctgtagaaatattaatgtatttgattatacagtgctggcctgcaccctgtaataggtgttatacatgctatatttaagtttttctgctgtttaataactaaggtaatctaattctagaccacctggaagaaaaacattctatctcttttatgtagaaagttgagaaatctttagcactcagctaacctaattctaacagaattagatactgtggtggttatttatgctggtgctcatctatctcatagcaatatttacttcattgctataaagtacagtcttttcttcactgacatctgggtatcaaatacatgtttacttacaagagattagtgcttttagaagattatttgatttaaaaatccagagctgatgcttcagtgtttaatgtatacaggcatgatttttaagtgtcttttgcaccatgatttggctcgttttagtgctcaaaaattatttgtatcatccgttaggcttgaatgcatatttgatattaatataatatcacagaactagaactctttaatcaaattaatatttattaaaatcgctttatattttaagtggaatcaattaaaatatcattttatataaaattatgtatatcagctgtgctatatcatatcataatttcacttaatcccaaaatttacttagcattaggcaaggttttatgcttaagaacacactaaaattgttactcaaattttaaataaataaatatataggagaagttaagtatattgtccttgaaattttgtccattttaatgcccttgcttgctgttacactctgtcaagtctggtgttctactcctgatcgcataatcagtcacttttctcaaatgcaagtggaataaatgagactactttgcatataaattgtcctctttaaatctggacagaacataatattttgcttttgactgtagacatggttcacagaataaattcctcttcctcttcctcttcctcctcctcctcctctctctcctccccctccccctcttcctcttcctcttcttctttttcttcttcttcttctccttcttcttcttcttcttcttcttcttcttcttcttcttcttcttcttcttcttcttcttcttcttcttcttcttctccttctcctcctcctcctctttcttttggctaggtaggataggaaaaaagaaagctaagaatagtaaatggtaaatttttctctttcaatgactgtttagagagagaaaataaaggagggtagaaagaaatattggcgactaaagaacgatttaagaatcgcatgccaaacaaactccaagaagcaccaggaaggtaaagagtacttattacaataaatttggtgaaatagaaatgcatataaaaataactatgcaagcttaaactgataaggagtggtataaaaattagtaaggaaggtaagaaaatatgtgtcataccgtttactaggaatttatctaatatattttaaaatatgacttttatttaaatacattatctctcatatttgatgaaagagaaggatactgtaatatattttctttaatttaccatgtatataacttaaaatttatttggaccatgtttctgggatctgggcagacttgctggattttgacagcatggtcaaatggcaggtggggttgtttttttggggaggatgttcataaacctccttttaaaagggtaacactgaaaaattaaaattataaagtgacatactaaaactgagtcatctggcattcactttcaagcattgacaatattttacttgattttttcatttggatatttcatattttttagatcccagcataactcttcttactggttttctctttttaagattggaagtgtgggaaaattttgtattaataccaaggaaacatcatgattttttttttttgttctttttaatccagcctaatgaattatgttatctgttttggtttagtttggaggggagagatgaggacgctaatggctttttatatagtcagttaattacatttgagccagatagcagaaggttactataaatattccttctcatataaactttgtttagacttagtgtaccaaataccttattaatgtcactgaagaatttgttgctctgtgctttatctctgcacattcattgtggaatgctaactttattccttcttcttttacattagcagctaaatagaaaagtgtgtttgatgtgatgtatgaagacacctagactttttgatgactatccaaaattatatttgttttacttctgacttaggataccagttcttactctccactcatttctctgttaattcagaaactcttaaaacagctgccaaagtttcaataacaggataattttaagactctgcttgctctgacagaggcgctagagaaaattgaaaaccttagtatattcttcacacctactaagtctgtgtgcacaatcagaaggcaccctctggaactgcaaggtgctcatgagtgtgaatgaactcagaagcattcctttctagttgttttttgcctggaagttccttaaggggagacaccagaaatgtcttttcttagaaacatcttgcttagaacatagcagaatctaattgagtaggttctcaagtagatacctataggatgtgtaattactgtgagatttctatatttctataccaactatccattcttagaatagaggtcctgaagagaatagactttacattatttatctttgattccactacgcctttcagaatgcattgcaaataaagatgttaattttatctaatttgaaataaacatatttgattattaggtcacatacagttgcagccaggcaataatagattcatctgacttctcgttagaataacgaatagatgatgaagtaaaggaataacaaatatttttacggtaccaaagatcatacttttttcttttatgaatttatgatgcatattatctttctgctttaaaataatcaattgtttctagattaatacctgtaataaagcaaccgtctaaacaatttttgtagatgctgaaataaatgtggcatttttgtcccttaaatttactgatctagtgcttaaagcattggctcacctcgtaaagactaccctataattatcgagattcttaccttcggttatgaaaaatttcctttctctgaggttaaaatgacagctgtctatttcctctttgcctttagcagttatacatccattgtttttccaaccaatgaatttatttaaataaaaagtatggcactgataagtaataagataaataactttaatataacaaattaaacagatacattatagctttataatagctatcaagcctctgatttatacaagattctatgtcttctcatcaatttatgtacatgagcctaatgccaaaaaaatttctgcacttgtcttcaaattacagtttgcatttaattgttctatttagccaaaagctcttgtcactaacaagtgtttgagggcttgggcttaggagtcctaggaatgcagcttattaattttgtggctaaacattttgagccttagtttcttcatccacaaaagggatgggcttcaaaatggccagtggatgtattgcttagtccactgcacaatatacagcactagacacaaggtatttgaacgtcattattttcagtcatcagaatccctgaaatgtgttaccttccttgttttcttgtttcaatacattttagaacatttagatatgatgaaatcacccattcaacagcttaccttagaccttagacatattttaagagataaaacatgtatttaatgaatgtatatatttgtgtattcattatttattcattgattgcccaccttcttccaaacaaggatccaaaaggattgtgcttttctaaagagacattttttttgttcaattaaacctctagtctattaaaccatgggtgatatttcctccattatcttattgttaagtgttatttttcttccaaacagcagtcacgcttgatttttcccatctggtattggactcagtctcttttttttcatagtatgaatcttcccactgatttttccaaagtgccttgagtttataaatgcacatttttatattgtatattcagaaagacttttaggttttaactggtttgatttaagaaagcatgatttaggaaataagcaaacaactgcaatgcaaaaataaaattaaaatgctacatctcaaaaatgttaagcctaggttttgttcatattgtgtttgtgtcctaacattccttctataaaagacgagtttagttagttggaaaggatataccaataaataatgcccttgccttgaaagaatcatgtgaatcaaaaataagtaagcaactaagaaaaagaaaaatatatctgttgaaacatttcacctgactctggatagagctaacttatctatttactttgctttaggtagttattatgtatacttaagaatggcccaaatactataaaggcagtggagaagcagtataagttgtttgaagtatatgtcaaatgtgcttacacgaattattattatgtgatattactggaaatctgtgatcaaattatgtgagtgcactatctaaaaagtagttaaagtaaaaacttattttttaatatgaaaagtgagagaaagcaagggaatatatttggtttgtgacttcttaaatattgtagctcatttttgagtctctataaaaacaatataaatttaaaccatggatttgcaagtttaggaaaatagaaatgtgaattctttgttctgtatatactgcaaatcagattattttgaacactcagacacaatgtaattgcaaacatgtttaggagaaatatgtctgtggttaaatttagggagtagagcaaattcatatctaagcatttgaatacctcgtaatgaataagttaaatgatcagcaatgaaccactataacaggccttaaaaatcacaagaagttccataaatgttagtaacattcttacgcaggattacaattaaataagacttacagtgttttagtaaaatatgaactgttttaccttatgtgggttaactttagtaatataatctcaccaattctgttcagagggaaaaaatcttaaaacacattttctctttaaataggcatttcactctacttaatcccaacctaaaagatgattttataggtcattattaaagtatacttctaaagctctaatttaactcacaggcattccttatcaaatggctgtggggtatctgctttatagtatcaagttcttttcattaaattattattcttacactaagttctttgggcttttagatgctttgactggtctagtgtttcaaatgtgcaaatagtaatttaggtaatatctatatgccaagtgtataatctttgggaaacataaataatgtgtccattaagcagtttatttgtttgagagactatggtaatgtatgggttaatcttcccaggacagtattcactatgagcatctgaggcatcagaaaataattttggttgcagaaaaaaagtagctctcattttacttgaaaggggttgtttccatcatttcattttcagttttctgtccaaaggaagatagaacattgctttgtagacaactcactaaatatctattaaatgtaaacttacctgtaaagtgattgaaattgtccaagaaaaagacatatctaaacttcttttttctgtgaagggtgggatattggttattgtgaatatgtaaaaattatagttctcctatcatcttaatgaatattatcttgtcagctagctcgtgaatctgccatcataatttactgtcaaggctggttggaccctaaagaaagtcttgaaattccttttctttaacttaaggtgttttatatggatgaccttccttagctctgatttgctgcgtgccactttgttaaacaacttctgttaaagcatacatgttatataatttatggcttttgtaaagaacattcatcttcacttcaaacttatcctttttactctaactattcagatactataaaagcttctgtgttttcaactttcaagatgcaatgtaaccatgtttttcagaatacatgtaatgattccagagaatgattattgatatttcattaacttttccagctaatgtttcattttctttagtcaacttcttccagcgtaaggagaataaaaccctatgcaaaataaactgagaactagatctttttttccctcctgatggacttagattctgtgaaatatactggtaatagtttcacaaagattgctttgtcaatgcagattcattgaacactttccacctttttttcctgtgatttctccacccctttcacttctgtctgtgtttagagttttgacaatcccttattagttccagagtagaacttatgagagctaataagggtttacattacagctctgacagctggcactaaagtttaatagagagcaattgtaaagaagtataagtgttgataatatttgatgaaagtgctcttaaagaaagagccttttggaaataatcacataactagaaaagctgcatatatgctctttttttgtagcttctcatcttccagtatgcggacaaaacatcctgttggcagatgactctgtaattgcttatggatgccttttctaggaacagaatccagggtcgttaaaaaaacaaaaacaaaaacaaaaaaaaactctaaactttggtcatattcttaccgctatttctataaatctctgaaattcatgttaactgtcctttagaaacacaatcataacgtggacatctaatcgcagattcattctgtgagaagagaccccagggattccaaaggcgagtcattgagatcatgaaacccataaaccccacataatccaccacagactttttgtattattaaaaataaacaaataaaaagcaagaatggcttcaaatatagaaagaccctgagtgtaaaatatttctgaattctctattcaatggtcagttgcaatgccacaaaaggttaaaagaaaatgctgcaattgaaaacagctgtggcttttttaacatgaagactaactttcaacaaagagaaagtatatgctatgagatgaaggaatacctgaatttattgtgcaccaggaacatgtaaagttttatgaaactgagaagtgaatctgaatatataaataattggtaaggaacatttttgcttctctgatagttactggagaggaaaatttgtatttcagagatttagattcatttactgtttatctcatacttctacattgaatataaaatatttcaatccatctatcatcatgcataaatgttttatggcatacagaattgattcatgtattgaattggggggaaggaggatatagttctggctgtaaagcatcttggattttattattattattattattattatgctttaagttttagggtacatgtgcacaacgtgcaggtttgttacatatgtacacatgtgccatgttggtgtgctgcacccattatctcctcatttggcattaggtatatctcctaatgctatccctcccccctccccccaccccacaacagtccctggtgtgtgatgttccccttcctgtgtccatgtgttctcgttgttcaattcccacctatgagtgagaacatgtttggttttcttgtccttgcgatagtttgctgagaatgatggtttccagcttcatccatgtccttacaaaggacctgaactcaccattttttatggctgcatagtattccatggtgtatatgtgccacattttcttaatccagtctatcattgttggacatttgggttggttccaagtctttgctattgtgaatagtgccacaataaacatacgtttgcatgtgtctttatagcagcatgatttataatcctttgggtatataaccagtaacgggattgctgggtcaaatggtatttctagttctagaagaagacatttatgcagccaaaaaaatatgaaaaaatgctcatcatcattggccatcagagaaatgcaaatcaaaactgcaatgagataccatctctcaccagttagaatagcaatcattaaaaagtcaggaaacaacaggtgctggagaggatgtggagaaataggaacacttttacactgttggtgggactgtaaactagttcaaccattgtggaagtcggtgtggcgattcctcagggatctagaactagaagcatcttggattctaaaggagatatgaactgaatctatcttaaaaggaggcaagtatcctattcataaggaaaaacatggtctggtaagcatgaaagacaaatgttgtttagagactcataatctgcttctaaagtgtcatcaaagagttaaagagttaaggtttcaatctccatggagtttaatatttcatcatttacccattttttcacaacaacatttttttttttttcgagatggagttttgctcttgttgcccaggttaaagtgcagtggcaggatctcggctcaccgcaacctccacctcccaggttcaagtgattctcctgcctcagcctcctgagtagctgggattacaggcatgtgccaccctgctcagataattttgtgtttttagtagagatggggtttctccatgttggtcaggctggtctcaaactctccacctcaggtgatctgcctgccttggcctcccaaagtgctgggattacaggcatgagcctccgtgccctgccccccacaacaatttatgagtgtctgctataccaaatgtcaactggaaatgtggcactaaacaaaacagaaaaatgttcctgccctcaaggaacttagatttgagtggaaatattaagaaaccacatgttaatacagatcattccagggtattacctatagaattctggagtctacaccagtgttcctagcccaggtgatgttacctccaagaggcatttggcaatgttttttttttttttgttttttgttttttttttttttttgagacggagtctcgctctgtcgcccaggctggagtgcagtggcgggatctcggctcactgcaagctccacctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgggcaatgtttaaaaatatttttggttctcacagctgaagaaaggggttgcttactggcacctcctgtttagatgccacacatgttgctaaatatcctacaatgcacagggcaatgtttatagcaaagagttatgcagaccaacatataaatatgtagtggaagggttgagaaactctggtctagtttaatcattgtcctttacagatatgtctattaaggctaaaggttcgaattatacattagcagagctcgaattggtacttgacatcttgtgattgtgcttcaggacacattcgttcaggaattttctttaaaattagtgaatttttgaaggcatataaagtcttactaactacttagattattggaaagtgacacctctgcaagaaaaacaaaactaagatggatttttttctgggagaaagaagaaagatttcaggaatagtgacatgaagatggatattttaaaactgaaaaacaaaaagttacctgcaaagagctggttaaggtgactgacgttcagcgggtagagtttcgtagtctaagaactcagaatgcgaatggagtaataaaagagatatcaaatataaagcatttggaggttgagggtgtttccgtatggaaacagttcagacagctgttacagagttagtttcctttgaggatattctgacgtgctgacatgaaatcaaatctaacatttgactcccttttttctgtaatgtgatactaatacaaaaaatgacaggtagatgtggttctattccaggacatattgtgttaatagtctttgtataaaaagtttctatgctttagttttagtactggtcctttgacaattagagtggctcttcgatatcagctgtttcttttaaaaatagccatttctttcctttagcatgtgactgagcttggcacttcatttaatcctctcaacaacatatgagcttggtggaatcatgtctccattttgcgtgatagaaaactggaggcttagaaaaatcaggcaattgtccaaggtcacaattagtaagtggttcaactggaatttgaatggtaaaactggaatttgaaagtggaacagatcgcttgtgtgggaccactgtttcctatgcttcctggcagagagaggctgaggtacctgaagctcatcagcctgctttaccagaaatagtccctgaagcgcagagtatgtttactgtaaggatgcttctcaggatgttattcaatacttttcattgtgtcctctctctgggaccaatcacggacatttacttctgactccaagggtgggagtgattgtgttccttaagctattcacttgtttttgctttttggatattgattcacgtaatggtcatcgtatcttgtttgcattccctatagaagagcagaaaattacgtgtcttcctgtatctgaaaaacatacatagatacgctctcttaacatgccttctaaatagtaaactcactgttttatttattctctttatgtaccctttttggtctactcttcaccttctaaaatgtattttattgtaatctattccatcttgaattgtgggaatgctttctcaaatacgaaaagccatacatacatttaaattactatttattgattgcctactatgtacccagtgaggaatataccatttgatcctcaccaaagccttacgaggtaaatcttattatcgttattttatcagaacaggtctaagaaaatttactaatttgaccagtgtcacaatgccagaatgtaaattcaggtctggctgactctgaaacctgatgcttttcataatataatatgtcaataattttcatctgaaatgcttctgcaagtcaccataatgagaaaatttgcaagttcctgctgccaaggggatggttggagaaattggttataagagttgagaaaaaaaagattggcaatggtggtataaaaaggcaaaaacctcatattaattagcataacatctctttctttaacataggattaggtaagcctctaacacgcaaatcttttcacagggcatctctggcctttattttctaggcatgtggaactgagccacacctctaattgcttctgcttctgtttccattgctcctgctgttgctgaggacatgattgataggagatgatggctagtggagaaccagggctcagaaagacacttgctatgtgcccaatgtgtatgcttgcacaatatgcttcattattagcttgacagatctccaagtggcagattgggaatgaattttggacctggctagcatttctgttacagacattgggtttttaaaaagctcataaatacatatacatatatatatatatatatatatatatatgtatatgtatatgtatatacctatgtatacacacacatatatacatatatgtacacacacatgcatgtaaatatatatagatgtacatgcatacttgtgtgtgtatatgtatatagacataaaatgcaaaataatatatgtattatataaatatatataaatatatgtatgtatagatgtatagatatgtgcatgtctatacatgtccatacacatatatgcacttagcactatatacttagtacatatacatttttagtaaatgtgtacttataagtgtactttaaattctttgtttctaaaaaattgagaagggtgaaggctgtaataaaatatcacatcaatttctggtggtattggactgctgcacacattcctacatttcttttactgcttttagaatgaggcagcacacaaaatacgttaataaatataatatgtataacttccaaaacttgaagtggtaacacatactgatgaagctttacacttcattaagtaaatgaatgtgacttaaagttgcagacttcttaagtatctgacctggttgttctatacaaggatcatgtgtggaactaattttctttgaaaatgttattggtgttatagattacaaacttttgtgttgctgttaaatatttcttagtcttttaacctttacaaaatctaaaagcttatttaaagcaaccctttcattaacataatacaactctttaaaaacactgatagtcaagaacagaagtaattaccaggggctttcattgtttatacttgttatactttcatgacaacatgtatgctgctttaaaatctattttttctcctttttaaaaaactcctcttacgatcattcccagtaaatcaaaatctctgcaagatgatgggtggcatcatggtgttctatgagtgcttcagtgcggaactattaggaaagggaggctgaaaggaaatgctgactccatccttcatacggttgatggttgctcttattagagatgaaaagaaaatgagaaaatgcattggcttgctttttattaagcacagtaggtaaaacagatgaatgcttgaaggctcattgagctgccataaagaaatttaaacattgttcatattggctagtcgccaggctcatgctgtaaactccagatgagggtcatgattgcagaggaatcgtcagctctattggtagacagtttctgtacgttcctagactagtaataaacctgagatttacccagcagggttggtgggattatgtttgttgtacatgacttggtatccatcttaattcctacaaaataattaagatttcttagcataaaatgatggcgtgacttgactttatacatttggattttgtttgtatcattgtattataataccttatatgtgtgaataaatttagcttcctcatatgtagatctagaataatatctaagagtaagagtggagagaaaatcgtataataaagtactaaaatatggttagtaaatatggttctaaaatatagtaacgaattttttaagttaaaaaataaagctttgttatcattataatttgtaatctttctaagattaacagtgtgctttccacttctttttaaattctttcaatgcctggttcaaaatctgaacacagcttttgtgtgaataatgatgattattttatcgatcaatatttttgcttctttattaataaatgtactataacaatatctaacaaaaaatgtgaagcaataagaaaaggtggataactttcttgaacataggcacacatgggagatgtaaacctggacatttgttacactctcatttgtagtttatttcagagatttatagcatctctcctatctacacaaataatttaccatgaaatttattcaaaattaagcttcataaaatagagacataatccaaatatttggctgagtgatcatgcggttgactaaatctttaaatattgaggttgccagggcaaatgagttgggatagttaatttacaataaaatgataaaagaaattctgctgtattaggtaacaccaaatttgccttgtatcagtttaccttttttcaccttcattttatttttagaaagttacaaaagaaagtaataagaaggtaactgtttttatttctgaagaaggaagatggttagaaacagccattaatttctattaaaggtagagatactcttataaagcatacactttttggtcagacacggtggctcatacctgtaatctcagcactttgggaggccaaggcaggcacatcacttgaggtcaggagttcgggactagcctggcaatcatggtgaaacactatctctactaaaaatacaaaaattagctgggagtggtgtcatgcatctgtaatcccagctactcgggaggctgaggcaggaaaattgcttgaatcctggaggcggaggttgcagtgagacaagatcatgtcgctgcactccagcctggtcaacagagcaagactctgtctcaaaataataataataataatgataataaataataataaaaaaataaaaagcatacactttctaaatactctttgatgctgaaaaatatagacgggaaaggttaaagagtggctgtgattagtgagattagctttccagtttaaataaaaatttagcaatcaaattcagttaaaaagaaatggattactttaaggatgtaaaaatgtgaaagttatttggaaattatcaagttatttacaagtgaaattatccatcttggaatagctatgttaagatctaaagacgtgaaggtagtaatttgtaatcacattttatttgctattatttattcactggtcagtcatggctatgattatgtgctactgcttcgatgcctgtaatgatcagaaaaaaaatgcctttataatccagtggattctatgactggaaaagtcagtgaaaatattctatgaatcctcggaaaatactctttacttactccaaaagattttggtgtgttcgaaacaattttctaaaattacactagatacgaaagtaaaccttgtggaacctttacattttcaaccaactgtaccatgttatacatctcagcctgttgcatattgctacatttctcttagcttaatagctattgtgttctctaagatggtgccagtttataaagtttggtcatagtagcctaatgtattttcaaagaaagttgcattttttccccaaataattttacagaaaacgtctttggtaaaattgctaagtgaggaacacaggcttacaaatacatcccctaggtatgccataagttcatagtgaagttctttacactttcaggaacactgaggctgcagtcagagcctaccctattttaggtacatagttttaatatgctgagtaatttggtttcaaagctcataggagatgaaaatctgaaagttgaaaggggtaaagaagtacatagaatgagtatagtaaacatcacaattggcagcctgagaataggaaaagaacccaaggggctatgataacatacacacgtgttcaagttacatttgcctggggccactgtgggaccacagtcttctatgcctcagtaaactctgagtgttcacaggactgcaaagtacataaagcaaataaaaatattcgtagttgtggccttgagacatcaataaatgtttaaattatattcactccactctggtaaagaatcaaattgttatataatatattttatatttcctccatggaaaacaaagattagaaacatcattgctttaatcagtataaatggtatataaatcagaggtcctcagggtttagcttggctctatcccttatttgctatgggactgtggacaaactatgtaaccattctgggtcccagtttcctcacatataaattggagctaacaagagataacaatagcatctccttagtagtgtcattgagaggataaagtgacatcatgtttttaaaatgttcaacacaggtcctggcacctaacaagtactttataagtgttaggtttatcataagagggataaatccttactatggggaaacgttagctatctagaaagtctttttcctaaacgttccaggaatccagacaactgaaggtttattatacatcaagtaaaataccaaaataaacaaaataaaatttcactaaacagtgtacaatttgtcataacatacagtatttctgcactctaatttaagagctcttcaatttttaattatatttagaacttcaactgatccatgattggataggttttcagaattaaataactttacttggttcagtaattggttctgatggtctgtctaacatggttcaggattgtttcttttaaaacaaggcatgtcataccattctgaattccttataaattctgaattaccttgctgtgacagtattttttttatcatgtagaaaaccagtccttattcagcaccagataattagctactttgcaaatgtcatgacgtttgaagcttaggcatgattactgagacttaatcacactaaaatccttcatatacattccattgcataagattgttgagtataaagtggaggtgcagggatatagatggtgatgtgtctatgaataggtaggaaatcagaagacattttgaggcagacagagagcacatacaccttacacaataaatttggttaaacatagtcaaaagagaaaaaccagtgaagacttgttactcaggtgtccatcaatattatatgcaaacgttcagtcaggtatataatcagtaactgtcctgaatggcatgtgtattcatatttttatatgttaaacatatcatttctacatttactttttattttttcctctttttctgcaaatagaccaaagttctcacattgggaaacatattatggctacaaaatgtttaatcatttttaagtgaattatttcaaaatttctttgagaaacaaataacagctactctcttggaggttctgaaaattgacttcagacgtgggatgtagtcctgtttagatattgaggatctaagcccaagggatcacttgcaggtctctaatccctcatggatgaatcatgcatttcctgtgtatttcttgagtaaatattaaatcgaagtaaagaacttgtacgttacgagagactgaatatttaagtcggtgtttaacacattatggaaaacatgtataagtcatggtataaatgtaaatcctggaatgtggggcaaaatttctcaattaccttgtacatatccaggaacaactagtgagtcttctatttgtgcatagttaggtactggagggtgattgattcatagcttcacctgtgatttcagaaggctgagtattattatttttattaatttaaatacttcaggtaaattcactataataattcagagtaaggatatcctagaacatgatggctgttattttgggcagtttatttgtaacgttccatgtccaagaatgactcactcttatattaggttgtttaaattggaaaggtcaaatgacttaagcttccaaaaattggtttggcaaatttcacacttactttcagcattgtagttcctttcaccaaggtacatgcatgttagggctctatgtacagagaatttacaaggttaattaaagtgtattgtgcataacacagtcgtttagttggtagttcaatattatgtttggcatgtgtgataacattgcagagtagatctgctgtaactttgactttggtatccttagttagaaacgactactctggtagacacatgctccccagataaaatgcctactcagattcactgttaaacaataagaaaaatagtttctgctgaaaactgtttcatccatgggttgatagtcacggacagagtgtgtataattggcaatgtgtatttaagtgttctacaaaagcagaaaagaaaactgaatattgaagatgatatagtgttcctttgaaaaaattggacaaaataacaatgagaaagcctgccagcacagttataaaggattaatttcctggtattcacatacagggctgataaatatagtctatctacaacttcattatgcatagtgctcttgtcattcaacgtgttagggaatgaatatggagaagcataatgacaatgtcatattgatttacataaaaattttgtgtgtagaataattatatacactatcatatggtataaatttggaaagataaatgctatatgcagtcacgattttaggaattattaattttatatatacatactgattaaccattaaggcattatacaaaatactgtgtaagatgtaacacctatgaaaaatgtgccgtgttctctagatatgttaaatctagtggatgagtaacccataaacataccagagaagtatgtaaggacgtatgaatggaaacatacacttgatattgataaccaggaacgtaaacatttttttaaaagttttctgaagcccagagagcagcagttttcaggctgaagtacatataaactaaagattcacagagacttcccaaggcagtacatgagcttttgtggtttaatggaaattaatgtttatatcctcaactttcatatgtagtgaagttaacatgtgtgagaatttgactatgtttaagccgaagctcttaagctagttctccttcctcacttcccttttcactatttctctttccctattttctacagaaaagcattcttctcatttttctgaaatcttgctaagatgctttgttcgtaggatgtaagtgctaaacaaaaggaaattttaaaatgtgttaagagtgtgaatgaatgtgaatcaaattacatttcaggtcaagtggtatcagttcttggctctgattcaaattgaagaaagacttactaaaattgtcagtgaataaagaagtaaaaatcactttagtgataaattactctgtaatttagcatataactcaagtttgaagaacttccactactatagaaaaactatttttattcctgcctaattatttatgtaaataagattttctggtgcttgcatttataacaatgaaaactagaaaatgaattgattttcagtgcataaaaataagttatatctatcttaaatgggaaaaaagcctagctcatctcagtatgacatcaatttctaataaaaattttattttaattaaaatagtttaaaaatatatatatttaattaggtttcatgagttatttactaaaaataattataataagaaaatttaggaagacaatttgcaggcttaaagcatcaaaatttaaataaataaactattaagttcaatttcaatatttgattactgcaatatatgatagattcatcaatatgagatgttcaaacataaaaaatataaatccttagcataatattttaaatggcgagttaattggaaatatgaacccaagggacagaaagcaaacaacataaaagttctgactattaaagaagaacttgatcgtttatttttacatggatgacattgagttacaaagccttggagtatttagattccattgggtgcatttaggaatagtgtaactgttttattttaaaatgtcaattttagaatatgttagaaatggcataattttcaattgtttacactcgaggaaacattttacataccaccttgaaatatataagtcagtatgtatgagctttaaaaattattttagagtgtatatgagtaataaaagttagaaatttacagatctaggctcatcactttatattaccagtgaagagaggaagacccagagcaattaagtaaactcaccaaggtcattccagctctttgtagcagatcccaactagaaggaagggactatggagaatagaaaggtttcaagaagtgggtaatacttaaggtaaaatttttctgggtgaaaatggcctctagataggaggagtttttgcctaggtgtatcatctccatcaccaccaaaccacagaaaatttcacgttgcctaaattatgaatttttgttggaatgtattggaatgcaagagtgcaaagttatgttggaagtacatggttcaggccaaagattttaaatgctcttcagacattgtatgtggagtgagctgtggaatgtttttaagtagagtgaaggagaaaagtagtatgaagctactataaaacttatggatgaacactatggtaacatggttttgatcatctatccaaattcttctttctatagtattatgattatactaaataaaaacaatatttttagatgttgttgtttagttgtttgtgtttcgggcagtatcagggaaagaattttgatcaaggtgctatttttataaaatcaatcagttattactttacttcgctttatcttccttcagattttatagtacatctagatccactggtatggttccacttcccaatatacatatttctctctctctctctctccctctctctctctctctctcacacacacacacacacacacacacacacacacctttgcttttatctgctccccagaagagctttatttcagactatgggctttgttttgatgtacaggcatggtcgtgcccatcattggctttctccatggctaagtatctatgaatctgtaatattttttaataatattatgtttattctgaataaaagcaatatattaatcacacacaaaactcatttgttgtacattacccatcaaattttaaaataattgaatttatgtaatgggggaatagacagtaattaattcttttaataatttgcaatgaaatgaataggataagtttattgacacaattaattttctgtcatttaattggagaaactatttacctgccatttctcttaatatatgacattagtaagttatttattatacaaaacattaatgaccctattagaccaaactcaattaatgatcacattttaggcatgttgttatattatctagtgctttctatattgtttgaatacacatctaaatatgtatgtatctaaatatgtatgtacctaaatgaaaacaacctagattttaggtaaaaccactattttctattaaatacctaatttagagagaaagcaatttgtttgctatttgcctttttccttcttgcttccttccctcatctagctcctaattgtgttgtcactgctcttgtgtgtgtatgtttgtttgcgttttggacaatatagaatagtgcttttcaaacatcatgcagatggataacctggtgatcccgttagaagtgcagtccttaggtttggggcagggcctgagattctgcctttctaacaagctctcaggtgatatgaactttagaagggaaaaaataatatcctttccccacccattataaagtttatggctgacatgctgtagcaaaaacagattaacaagaggaaataatacatctatttaaacaaagttttatgtgacatgggagtcttcagaaatgatgacccaaagatccagggaaaagtgtatatttgtatgcttcagtttgatgaagaatggacagtcatgtagaaatgggattagaaaggttatgatctaataataatggtttacttaacaaggctgttaatggacagttctttttcgtcttccttctttcctccaagtgcagggcaggacacctgtcacacgaagatctgaagggcagaagggaggagagattctttatgtaactcacaggagaaagacaggagaaggtcagaaggtgccctttctgcttgtgccaagatgttatattttggggtgtcgtgttctgagccccaatgggaccacagtttagtaaggcttgagagactaaaataacacatatttccatttgcttataaaaaattccttaaggaattttaattcacatgtatatatttaaagaatgaagagcaaaaaaattggtggttgggcaaggaagactcatttctggccaggctgatagattagaggaagctttattgctgggaggatctggaggccaggctggcggaggcgggagcagcaggtcttaaggtgtgtcttgtcaggtggaacaaactgggtgggaaaggacagactggtgaaaggccttgacaaaccaattatgttggaaacagaaaggtgtcagagtcttcaaataatttttaggagaatagcatgcttgctatacataggttccatgtaaaacaatataaccataccttcttttggagatatctttctattttaggttaatggggaaatttaaatactagtggggcaaggtgaagtttgtaacaattcaatttaggcaaaaatgccacttcttaattttatgccagattaaataatgaaaggcaattaattttacaatgtgttatacaaaatggcctctcaaacttggtaatattcaaatagccaagaagaaattgaagtgctctataattaatcctaaactttgtattcctatactctaagctagaagagacttagctatttgcctatcattcattgaggtcatttcttgtaccaaaattagaaagataacaggcaatgaactttcaattttattgaaccgtagctgttagctctcttttctccctgtacctgaattcatgaataagcagtttccttttcatggtgtcagaaaatgaactcctactttatatccaaaaatagtcaagttgaggctttactaaaatatggtaattttatttcagtatgcaagaccacagagatctcatgtctaaatacttacgttacaaggtacagagacatctcagataacaaaaaggttagaatttaggagaatagctttttgtccagagtatttgaaatatatatatatacacgcacatatatattttagcctatgtctgaagatgaattatttagaaaatcaaagaaatattaaaaagaaaaagtggaaagccttgttcatgggtaactattttttagtgtggaatagatgcaataataatgccatgaactgcaatgcttcccccaagacctacattgtccccccacttttctgcctttggcattgaactagtgtgcgtaaatgaggttgctctttttgtccagttgttaaggcatgagcagcggggcttgcctttggtactgaggctattcatcaaagcttttaaaaatgttttcattgttattgttgttgacatgactttttgcttctacctcccctgctgagccagaccctaagaactttgcaccggctgttgttttttctcatgtactgaattgctgttggtttgaagactgcaaggggagagtgaaaattatatcggttcctcaattggtgttggctataggtcttgcacaatttctaaccaaaggctggagtatagtactagccctctttaagggaaacggtggaaggcataactgagataaatggatgcattttggagtttgtcagctggagtgtatgttttacacatatattcttatggaaaagctctgtggtatgtgatacttttgtaggtctatataatgatgatttgctattttccaagcatctgtatcaggtgcttataaaccaaattactagtgtcatagttaagtgactgagatttttctattctcttatcctttgtgaaggcaggaagtatgaccattttgggcttgcagttaaagtgggtttagtgtgaaagtagaatgattgaagaaaaacagcacaaatctgagtggtaagtcttcatagttacaccttttagagtttcacttcttgtaaacaaaaggcaaataacatagagtaggaatttaacaaattatgccatgaaagagaaaaatgccactttgaagtgattgtaaataaaagatcaatttaattatacagagcagtaaggatgaaatatataaacaagaatataaaatagaatagaaattgcattattgaagtaattctacaaaatcataatatcaacagaaaggagaacttactgtttactggaaccaaacattctggtgttactcattttccatgtgacagctgttttcatgtattttaatcaataaaatctcataaagctctgcaaaactgtttggaaaactaattatttgaactacacagtcatgtaccacaattaatctatgtgaatgttttttatttatatttcactgtttattttggccaattttgtaactgggtaattttgatgggttaaaatttgaaatccacatggaccaatcaaatgtgctggtgtcttccttagtaatggggaatatcaattacatctagaggtgaatttcagtagtgtacttgagttaggagattatgaggctttccatcatgctacagtgtttggaggggatttatttcttcctttcttcctttcctcctttcctcctttccttccttctttcccccttcccttcccttttctttccttccttccttctttccttcccttccctcccttccttcctccctctctccctccctccctccttccttccttccctcctcctttctttccttcctttcctttcctttctttccttccttccttcctcccttctttccttctcttccttcctgccttcctcccttctttccttctcttccttcctgccttccttccctcccttccttcctccctctctccctccctctttcccttcctccttccttccttccctcctcctttcttttttctcttttcttttcttttccctccccttccctccctccctccctccctctctccctctttctttctttctttatttctcttttttgtctcaatatttgtagttttagtagagatggggtttctccatgttggccagtctggtctcgaactcctgacctcaggtgatccacccacctcgacgtcccaaagtgctgggattacaggtgtgagccaccctgcccagcctggattttcttgacaataaatgtaatcctgacactcactgatagatttgtagattttaaaaattttcattaaaagtgcattcttttctttaatactgtttcgacattcaaatagatgaaacaaaatgatttctaataacaatctagagatgtgagcctaagatcagatatattttacataaatatatcaacccatgtgccaattctttactttcttagtatagcgtcgtaataaatcttgatatctgaaacagaaaaactctcattcctgactttaatattatagataattcttgcctttcatttcttcatatgcatgtaagagtgatgttattaaatgccatgaaaatctgtattgagatttttcttagaattctacaatgtgtagataaatttagaaaaaaaagagtatattttcaatataccataatttttcatgaacatggtgtatctataaacctattaaaactaccctattttttcatatgttttatcatttctcttttaggaaacttgctgaattcttaacaccacaatttttatttatattaaaataaaaaatcagtttacatattttatacattttaagaaagtaaaaaaagttacaaactgagagaaattattctcacacatataattgaaaatatataaagaatttctatgtattaataaataaataataaaaagtggagtaaaagttataaagtagaattccccccacaaagcaaacatatatattcaataaacatgggaagaaatgttccatatcattagtggtcagtgacataccagtcaagtcaagaaagcaatgaattacaattttaaactgtttcattgtgaatatatacatttgtttattttagatatttcaaggattgaagaagatgtgatttttacatcttccatctaaatttaatataaattgtaggaatataaatgttttaactactttaggaatctgtttgacattatcatcttgagtaaactaagcctttcttctcctaaatatataccccccaaaaaacccttgcatatgtttagcaaggtatattttcataaagcactattaaaactatataagatctcaaaataatacaaatattattaaaaagagagtaaatgaataaaaggtggtatgttaatacaatgaattactacactacaatcaagattaataacaaatgacattaaaactgtgtacgaaatttagcaatatagtattaagtaaaacaatcaagattaataacaaatgacattaaaactgtgtacgaaatttagcaatatagtattaagtaaagagtaagtccttatgagaacacatggacacaggaaggggaacatcacactctggggactgttgtggggtggggggaggggggagggatagcattgggagatatacctaatgctagaggacgagttagtgggtgcagcgcaccagcatggcacatgtatacatatgtaactaacctgcgcattgtgcacatgtaccctaaaacttaaagtataattgaaaaaaaagagtaagtccttaaattcacatctataatagtaatttttttaaataaaattaaagaaagctacatttttttatatctaaaagcaaaattaccatgtaaacgtgacttagaatatcaatagcccagtgtgtagggagacagggatgaagtgaggaagacaatatgattagatgcatgtagttgttatcaagtgtacattctgcatgatagatttacagatacttattgcagtactgaatgaatgtaattatgaatcaatgaatcaatgcatggatcgaatggataaatgaatgcatggattgataattgaacaaatatgtaaacaaatacataaatataagccagacatggtgactcatgcctgtaatcccagcactttgggaggccaaggcggttggatcacttgaggccacgagttcaagaccagcctggccaacaggccaacagggcaaaaccctgtctctactaaaaatacacaaaaatcaacctggtgtgatggtgcgtgcctgtaatcccaggtgctcaggaggctgaggcatgagaatcgctcgaaccaagaggcagaggctgcaatgagccgagatggtgccactgcacctcagcctgggtgacaaagcgagattctgactcaaaacaaaacaaaacataaatatataaataacggccatacatgagccaatttcacaaaccaaggattatgattaatgtagttctgtgaatttagtttcaatagaaatagagatatccataattgtcacaaaatgttactttttgttgacttttcattttttcctaagagtttctgccctatgatttcaactgacttgtataaaaagttagttggtggtggatgtgtactgttgatatccaagaataacttttatctgttttgttaagtcgtggccaatttttcagtttgtaatgttatgttagatgaggaatgggctgggtgccatggctcacacctataattccagctcttttggaggccaaggcaggaggattgcttgaagccaggaattcaagggcagcctgggcaacaaagcaagatcctttctctacaaaaaataaaacaaaatttaaaaaaaattagctgggcatggtggtaaattcctgtagccctagctacttgcaagactgaggtgggaggattgctagagctcagaagtttcaggatgaagttagctatgattgcaccactgcactccagcctgggctacagagtgagaccatgtctcaggaaaaaaaaaaaaaaagaggatatgacttttacacttaaaaccctacatgaagagaaaagatcaattggctctcagtatattaatgtcgaattccaaggcagaatttttcttgctgggacattttagagaacagcaatgataacatgcaggacaatctttaaataacgggtattcactattcaccagtatgttgattattttctcaaacattaagaaaagtatatttttaaggggaggtaattacgcagtatggggtagccagatggatatgtgaaaataatttctattcactttggtagttggttcaacatgctctgccaaaaaccaacacaaaaatattatataatcatctcatcaagtaacaatagagaatttggagacttaaaaaattttattttgctagtagcttgaaatctcatagaggtatgtgagcccaattttgaatctgataattgaatttttttctaaagatttcaatattgtattttatgcctctgctgttagaaccacagttaagtcagttccagcatgaagaaactattcttctttaaccacagttctaaactcaattcttgagtttaacatctcttactttaggaaagtatttcattttactgtttttaaaatgtggataattgtcatttatgacgatttacctgtaaccaatgtaggtttcgggaaacactgttgcccaggaaaatatgttaaatagtggcctaaaatatggaattgatcttattttctttagagtgttgttaaccttaacaaatcacttacttcatttccataactttaaatgccaaatacttgtaaaacaatagcaaatatttaaaattaaactactcatagtgtttataataaactatactgtggacttgattatattttagggggaaagaaagctttctaagagttatttggtatccatgaatctaccctttattaatctcagaaacagaaacctattgtattctgtctcaaacagctaggtttatattaggttaaaaaagtcatactcagcatggtataaatacatcttaaatttggccacattcccatgctcaagaatatgacgtaagaagtcacacagtatgcgagagtgattaaacatctttaatctttggtccttctaggctttgtagctcaaagtcaaaaagaaagcccatatgatctatctctaactgtatacactgcactatggaatatcaaaagcagtcagtcctcactcaaagaagattgcactgctcaaagtaaatgctgtcttaccatgagttttattgctgaaagcaattcatgtaaataaaatgaggataaagcaacacaggaatatttcaccagtgatttcatttctttccacatttcaaaataacagttgtataatttggataattcctctaattcctactgatttaaggaaatagcccagccaagccaacagaataataatgacaataataataataataataaatcttacatcttagggatattatatcttgctgctggtgctgtaaattttaaaaccaaagccactatttgtgcagtatatattttaacatgacaataaaatattaagttttgaatgaagtaaatgggaattcatagtagcattttaaaaaatcaactaggctttctgaacttgtaactcaggattacagatataaacacatcacagacatttatcaccactattcttctcttttatgaccttttgaaaagaacataatttctcaaaaaaatatttttcagtaatctctgcacaagataatttgccctttttctaatcttcaaagtgacagattgcataggttgagcctttctgacttacatcacagagagtttcatgtttcagtatgctttcctgtctcactggctgacttgattgataatagttgaggtagtgcaaaattaaaaattaattaatttgagtgaattggtaataaagaggactgagcagttgtattgagatgctaataggtctattccagacctattctagccatctgatcctctggaatagccaacagctgtggtaggcaaaactgacaactgagcacattcaagggtaagggtcaagagtttgtcatctaaccccagtggggccaaagcaggggctgttcttcccaagactctagttctgggacaaaagcaggtcgcatggttgaaataatacatttgtatggcattactagaaaatatttttataaaataataatatagtctcagatgatgattttctgttttgttttttgtgtttgcttgtgaattagaactttctgagcaaatttctgtaagtcctccagtaactataatgcctgcttcattcactattttatcgggaaaaagcataattaatgcaattaagactagtagaaaaatacttgactggtattttgctatacatatagtgttatgcacatatttataccagcctaaaatgcaatacatttgtattattttaaaggatgaaaggcagttaattaagaaaattacatttcatgacacatataataaagaatattctttattttatgatagtcaaatatttcaactatccagtaaaccagtaaagtaggaggtttttatatctatcacaaaactaatatatagtgtgtatattttttataattatgcagatagtacccattcatttatgagatttttaataaaaattcagaatatttttagaaaataaaaaccattcgcattctagttaaaattatgatttttttgtctatctaactaaactatagaaaaataatattaaagcagaagaaattatggacaatttgttaccaataaaaataacagaaagcacaactgatttaggttatgaagatggataagctgatttgagacaattgagttcaataattattatagagtaaactctgagaaacaaaattttaaattgaaatgttaaattcagagatgaataaaataacacagtacatcttgaaaattaaggacatggattaaaataatcaaatgaaatgtttaatttttactttataaacgtataatttatcttttaaaaaaattttttttttcatttacctgaagaacacattatataccttgtagcttcctagagatagtgtcaccagcctgttaatttgaagcagtcaaatatctaatataaacattaaaaaaacaccagtcattgcataataatatactttttaatgtctctcctatttgatttctttttgtttttccttaggaagaataagaaaaagatgattagctattttactcgaaacccaattacctccacgtgtctggtgggaattttcacaccacacaccaatcagtaaatcagccaatcagtgttgacctactgtagctaaatattaggtatttgaaaactgattggcatttgccactgactgaatgcattcagctaaaatttactatagtggtggtgatgattttcttatattttagcaatcttgaaataactatttctattacatctactaacaacgccaataatgataacatttctactattgtgtatattaagactattatacctgcttattaattccactaccattactaatacatagcatttattgggctctttgtgacaggcattgttcatttgtatagtagtgtatttaatcctcataacaactctcattgacaaataccattattttctccattttaaaaatgagaaaatctagatggtttatcagtcagtttcttttatcacccccctgcatgattttaagagaatgcaacgtacattctttgtttctcatctgaatagtctattatttcttggaacacaactaaattaaaatacagtatatttcaggtttttgaaacagaagattaaaagaaaacatattttaagaaataaactaattgttttttccaatgatagtttaactttatccccctctcagccccgagattaagggatcatcaagcagatttataaaacctcaagccttaagcttatattgataggaaggtaaataaaattatacttctctgcatcagaaaacaagattaaattgtcctttagtgcaataaaatgctgatctcaaacctaggttgattcttttaaggtgctttctaatcaatgaggatatgaaaggaaatacacggttggcagagttgggaatccaactcaaaatctaaagaagacgatctttgtctaattgctacaaatgattgtaatatgagctgctgagttttaaagtgattcaagtcaagaactgtaattctacagagacaatcattcccactgcaggttaaaatccatagaccatttccattaaaaataattagcaatcatgtcttgggagatacacattgataagaatgtttcaaataactttagaatgactgtaagtttcagtgtgaatacaatgtccaagtgtgcactgcaacataatgttttagtattttcttttttgttgttgtttttgttttgtgtttgtttgtttgtttgttttttgagacggagtctcactctgtcgcccaggctgcagtgcagtggcatgatctcggctcactgcaagctccgcctcccgggttcacaccattctcctgcctcagcctccccagcagctgggactacgggcgcccaccaccacacctggctaattttttgtatttttagtagagatggggtttcaccatgttagccaggatggtctcgatctcctgaccttgtgatctgcctgcctcagcctcccaaagtgctgggattacaggcttgagccactgtgcctggcctagtattttctttctttcttttatttttttattatactttaagttttagggtacatgtgcacaacgtgcaggttagttacatatgtatacatgtgccatgttggtgtgctgcacccattaactcgtcatttaacgtttggtatatctcctattgctatccctcccccctccccccaccccacaacaggccccggtgtgtgatgttccccttcctgtgtccatgtgttctcattgttcaattcccacctataagtaagaacatgcggtgtttggttttctgtctttgtgataatttgctgagaatgatggtttccagcttcatccatgtccctacaaaggacatgaactcatcattttttatggctgcatagtattccatggtgtatatgtgccatattttcttaatccattctatcattgatggacatttgggttggttccaagtctttgctattgtgaatagtgccgcgataaacatatgtgtgcatgtttctttatagcagcatgatatataatcctctgggtatatacgcagtaatgggattgctgggtcaaatggtatttctagttctagatccctgaggaatctccacactgacttccacaatggttgaactagtttacagtcccaccaacagtgtaaaagtgttcctatttctccacatcctctctagcacctgttgtttcctgactttttaatgatcgccattctaactggtgtgagatggtatctcattgtggttttgatttgcatttctctgatggccagtgatgatgagcattttttcatgtgtcttttggctgcataaatatcttcttttgagaagtgtctgttcatatcgtttgcccactttttgatggggttgttggtttttttcttgtaaatttgtttgtgttcattgtagccctttgtcagaggagtagcccttcgtcagatgagtagattgcaaaaattttctcccattctgtaggttgcgtgttcactctgagagtagtttcttttgctgtgcagaagctctttagcctagtattttctttataatttttgtcttctttagttaatgcttaaaacacttgaactggtggagttcttaaagccatttggtgagacattatgtaaacgttatcccactgccaggactcatttatcttaccacttgttcttttacaccatcctatacactttatttagtgaagtacaaaaatatttccactcaggaaaaaaataaagcccctcactttgatattgtctcccctattacttctgacaatacttatatttataatttacaaatatggtgctgtgacttgtcttaggaatttgattatttaaaaatatgaaaatatggcccttacacatcattttacatttgtgtaatactaattttatgtgacattattgatacacaaactgtaattctgaaaaaatattattgggggaaattggctcataataaaatatttttatgaaaatcaaacagatttttaagccaataaaatagctaggttaccaggaatattaatttttagaaaatctgaatgaaagtatctttgttatattttgtttatgttgcttatgtgtttaaacttttatcacactgaaatatatgctaatatctaaaaattttaagtagtaagatttctaaaatgatatgagctaatagtattcacatggttacatatttctgtacatccaacatatttaaattttttccagttaaaaaaagatgagtaccttaaaaaatgttttatactatccattaaatttttgaagccaatgtatttatattatttttctgtatttctgtaattcataccaaagtatgaatttagtaattataaactttgaatagtagtattttcatgaatatgaatatgagaaaagaagtattatagaaaatacaaagaaatattttaaattagctctacttcctatattaaaatattatttcagccactgtggtagtaataccagtaatagcgatgtggatatgcagctttatcagtggctataatgtgaacatttcttcagctatatgccacacagttgaatgatccaattgcaggtctgggcttttcaattttgccaaattctggctattgtattaagcattggtttcggaaatgaagtgacacattttcctatgaaaatgcaattgagcagattgttctgggcaaagttcaattgcagttaaccctgcagatgaacagttacgctctcattattcagtgtcactcaggtcaatctgaattattaaagtgtattgcagaaagggtaagtattgttggccattcttgaagaaacatttaaaaaaattaccaaaccagcggtttgtttgcaatggttttgattcactttcattttattgtttcttaaagataaatagcacagatcatgcctatccagaaataattagtacatacatggtcttttttgaacaactttgagttactttaaagatttatgtactctttatgtccttattttaaaagataaatttaaggctagtatagaatattgttaaattctagaattctagaatatccagttatatagttatttgaagaatacttgaaggaacaagagtagaaaatagtaagatatatcagtgatttgtttttcttttaatgcatttcacagttaataatcttcaaaaagcattacgctattttcatgtctgtatactaatcaaaccttatgatatggttttatataacttgtaattgatgaatattataaacatgaaaaacaatattatgccttgccaaataagttattttcagcttgatttcataaaaagagaaagagaaatttaaagattccttatgttgattgttctggtgagatagagcaaatatagaaatctgttggactcccatcattgtgaaaaatcctactgcaatgggcaagattaatttgtaacactttctctgaagtgcgaattaaatctgatgtttcatgatgatctgtagtccatgtggatgcctgtgtacattatagacctggccatccagctggcatctactgttatcagagtgctagccctggctggttaaatggattttgcctcaggttaaaagcctttagggaagtgggtcaaattgtacaaggacagcttttctaattccttgcttgtgatgtaaaggtaagaggataataaggttacgtaaagccctgcaatatacaagctcatttagaaatactcacatggagaatctcaagagaataaattagatccacagttgggttttgcaaaaagtcatttactgaaatggtagacaagttcctctttaatttttttttcatattgtatgactctcttacgctcaatttaaacaataggaatgctgactattcaaagggaaatccactgagatagtgacttatatttcacatatgatatgtgatagttaaaattatgccaccttctgcattttagattatgtgattctgaagattgcagcatgtgtgataaatatcacacttccagtgcagtatggaaacttgaagtttatattttatttataacagaatttagtgttttaggcactcaaaggctgagagaaatcctcccaggaaagaataaataaacacttagaaatcactgaatcccacagttaattgtttatttgatatgtttccattttgagaaaaagtaagtttaaaaagttatttatttggaagatagaataacattttgatgggtctcacaacactttaacatgacataggacacagctgtctgtaccaggatcctctactgaataggtctggccccctgctggcctaactctttgaccctcccactaggttgtgtcaaagagcttgcaagggacacaatgaagttgccatcattcccatgggcaatggcagttcaattattttacatgtgaatatatcgaatatcaattgctactctgccctttatatgatacagtggacatactttcaataacttttctttgatagaaatatgtataatagctaagggaatgaaatatgagttgttgtaagaagaattccaggcttttcagatattcattgctaacatttacattatttaaatctttttttttattttgctccttattactgttgaaataatctggaagtaaggttggtttaatgtcctttggagcagtagattttcctgctggacaatttcaaattgaagttcttgtccttgagttcttactgatgctttatacagaacaagagcaaatgttagcatatagcatgtagcatgtagtgcctgtggtctttactgactcagtctcctgataagagtcttcagtaccattcaacgagtacttcttgagcatctactctttgtccatgtttttctagataccgggaataattagaaagataagtaaatcccagtcatcattaccaaaaagtcctagtttgggagataaagaatagggagaagacaaataaagtaaatcatttcagggcaatactgtagagatatacagactccatcctctgagactgggaaagatccagctcaagttgaggggatggggaataattctaaaaagcagataaacttaaggccatacttaaataattaatagaaaataatcaggcacataaaaggtgaaaatggataaatgaatcttaaataatatcatggcaaagttctgaaggtaataataaggtttaagcaagggaagtatttggtattgctgaaacataaattgtgagggattcaagaacagaaaatgttatctggagctttaactttatttatgtgttgtcagttcaagaaattgtgatgggtttatctagactagttttataaacctgtaaagaaagaagcagaacccaaaagtacataggatttgaagaccatggaaacaggttacttggaaaaagaagtctaggtaatgctgttttctgatcataggaaatatgaggcaaaaactagattgtgaaaaaagtgatgagttcagttttgggtattttgtggccaaagtcattgtgggacatccaagtataataattcagcaaacgaaatttgagtctaaattttattgtaaaagatatgattgacatgcagatttatgatcttcattgataacatagacactgctaaaaatctagagagtggatgaaattgtctatagagactaaaaaaagtagagacagtgctgatgtaaggaccttgggcaatgcagatgcttaaaagaattttcacttccttgatgttctttgtctattgtttatgatacatatatttaatttaccctttctacttgtccctctgttaatgaatacacctgcattctcccaattaaaaacaaaaccccaaatattttctcaatatatcaagtcaccttactatttatctcatttccttaatctagactaataaggcaatcaatctaatcatttccttaaatgcgctgcaacatctactgcctgcactttttcaccatgaaatccatgcccatttttctttctggcactgtatgaaaatgttgttcctggagtttatagcatgagacctccacgttaccagacagatgatgatttttctcaactcatctttcctgagctatctgcagcaagtgctctgttgatcactagactcattctaaaacgtctgacttcctgcaactcagggatttatcactcttggttgccttttaatccccacaatttgggtcaacctagctattttctccagttgaagacataagtgcccagttgccagaactttgtcttcatttttatttctcttcggctaatatttaatatcgtgaattctttaaaatatctttagcagctgaaatgcatttcggtgtagtaatagatacacttagttgaactggcataaacactgtatataatgaatataacattacatctcaggaagtccaaatgatagaagtgtttatacgatagtcaaccagattattcctgttatgctataatccctgcagcttcatcattggtgactggcaggaatttggttgtggcaattccaggcattatatccagaaaaagggagattgtctttctaggtaatcctactaatgaatgtgcagatttggaaaagaatcactttgcttctacataaattcatgttctttaaaggacaaaatgaaaaaccatgtgcacaggtccataacacacagcatacttcaaattcttctgaacagagagaataaggaagtcttgttcttacatgaaattaagtactttttaatcctatgtgtcagtcctcatgtggcagagattttaatctgcaccaaaaatctatttgcaatctccttttcccagtatcccttgcagttatatttgggtccagagggtagttcttaccaatgagctgtgagtaaaagtgactaatgccacttttgggtggaagaagttaagaattgtgttgcttcttcatttgcctattgcctttgccatggagagcttttgttcttgaaacaatcttcctcattcattaattcttcaaaggccctggttttgtctccttcctcattattttataagagcacatgggatatgagtggtcctggcattgagaagctttgacatctcacttcctcttgtttcctgtttgggctttaatttctttacatattgaacggcggtgacattttaatttttgctaaattcatggtttctttgttagtacagtttcattcatcgttattagcttctgatcaagcagttgtttagatttattttttattttttattagtattagtagtgattttgagacagggtctggctctggcacccaggcttgaatgcagtggcacaatctctgctcactgcaacctccacctcctgggctcgagcaattcccccgcctcagcctccctagtagctgggactacagtcgtatgccaccatgccctgctaatttttgtattttttgtagagacgaggtttcaccacattgccctcactggcctcaaactcctgagtacaagcaatctgcctgcctcagcctcccgaagttctgggattacaggcagttgtagcctttaaactaagcatttcttatagtgataagtttttgctgtttctatatctcaggataataacatctgttttgacataattcaaataaaaaataattgtttcctggccaacatgttgccatttcttactataacaaccacaagattcacccaacattcactctaatgctacaattctgatagatacacaattaatatctttatatattatggaaaatgccagagccgaatgcttgtaaaaaatgttacatcaccagacttactagcttcctaaccaaaaaatgtggggtcctcctgttttgtgatggatcttttcacctggacaatttccagttttaaagttcttttaattgaagttccacatttctagtatacattcctgaataaggacggtcacttttgatttaaatccaggaaggttaactgatgtcatacaaaaatcaaagtcaacattctccttatcaaatcagcttctctgagccactttcctctattagcaaagcttctttatttcttgagtggaatcatggaaactttatcaacaaatatgcctatgcatttactcagttgcttctttccatcatatttattgcccttttcccatatcttccatcctgtttcaggatttcagtaattttatcatgtaacatcaaggtattgctattttgttttctgtctcatgtcatcgtacctttatctaccctattatcacctgcaaaattaatcttcctaatttgttgttctagtcatgttactttcttaattaagtcttcattctataatataccaaattcttaaacttggttatccagaatccaatcttggttactttctgttcttatccccactgctaccctgtgctgacctaatacctaaaccaaactggaaatgcctgagttcaacaaactggatgtaataactacatcagaatttccttaaaaggctcaaacttatggcatcactgcccattagcaagatccttttctactaatctctttcttgaaatggcttctggatgtaaaatcctgccatatatttttaaagtattttatgtctaatagcatttacatacgaagccccaactgatcactgtaactaggtaaaatttatttccccttaatgaatgcttggtgatatctttctataagactgtaaacttcacaagcagcattagtcatgtgtgtccaagtaagctctgcagcccttctcaagaggctgtgtaattagaaaggattaacatctttcatggaactgctagaaacattagatatggaattatttctctgagactatgaaataaaaggtttagccttagatcaaagcagtcaggcatatagaataatgtataatgattttgcccttgaaaatttagaagtcttgacaggtttaataaccaatgttcttctggagatacttttatcaaactactagggttttttggtttgtttttttaaaatcagaatcttccagaataaaaaacaaactagaaaaacaagataagagaaaaacaaataaaccctcttgaatataaatctgtgggaaatcacctacctgggggattttttaaatctttccaatagattataatttttttaaaagaggagattaatataataacttatagaaagtgataaatgtatcaatcacagtaacaattctgggccaaataaatttatcatatataaattgaaaatgatatgtgggaaagatcactcaaatttatgaaagcatagtatgtgttagatatgttttgcataatattgcaaccctgaaggaagtggctattaatctaattaatagagatagaaaccacagtcagtaaaagctacaactctaatttaaatatgaatcaatctgattactaagcccctgctctttcaactatcatatgattataaagataaaatatattaagtaatcaagtgcaattcacaataatattcaaatatcatttttatttcataacaatttaaatttttgttaatttttctaatccattggcatgtcttgctttactcctaggatgtgttccaagaaattgtgtgtagaaaaaaaaatcagattgattagcatcacagccatacattcgatttaatagaaaaatataatgaggcattttaccattccaagtatttcaggccatctctattttaaagtatgttttgtatgtttattgttaattgctgtattttgttttattttactttttaaatggaacaagcatggataaaagtaattatggtatatacaacctaagagaaataaaattatgaattattactacgagtcttagtttctatagatcttctactcaggaataataaattataaaggaaaaacatgtcacagttataggaacatttcttttaaaaagaaatatgaaatattttcagagtaaatgtgattccatacacttcttatactgcaaaccatttccaaatttccacatatgcttgccaaaaccaatgataattaatgtttcattgaattctttgagaaatgttgaattccacgactggtttggaccatatttaaacatatattatgctggactaaattccagaatcagagagaatattttatattttttggctatttgtgttaagaaaaattctcaagtggagtacggacgtaaaatagatttggtataaaaacaatccatattctatttactagttgcttcttcagcatttaagaaactatttggggccagatacagtggctcatgcctgtaatcccaacactttaggaggatgaggatctcttaccccaggggttcaaaactggcctgggcaacacagggagattccatctctacaaaaatttaaaaaattagtcaggcatggtggtgcatgcctgtagtcccagctactgtggaggttgaggtgggaggatctcttgagcccaggaagtcaaaggggcagttcactgtgattatgccactgtactccattgaaacattaacctttttctccattcatatttttaaaatattattcaagtttttcatgctcttatcttaagagatgtcaacatcagatacaatatgatttgcagggagtttattgttcattaagatttttaatttatatatataatttttatatacattatacttaatataatatatgatatttcttatttaatggaatagtataaaagatcaaaatagtttaggcaaaacattgtctgaatttaggttctttaattggtttactttaaacttgctttacttctctctgcccccaacttagtcattctccattgccagaggctgtttagttattccgagcaatagagaaagatttatgcattgacaagtggggaggtgaaacgctggttaaaagagttctgcaaatgatacttctgatcccagcaggagttataggcttacagtttttcaaaaaaagcaaagttttccctgttaataactgtaaattatatactataatattttataccttttttctttttccaatgactaactatacctcactttagggataaaatccctcaagtgcatgacagagatgaatacaatatgtttatatttgggaaactcttgagattttctttgaaaagaatggatttatgagattgaaagacacacacaattcatactcacaccatgccctcctcccacctcaaagttacatgttcttttacaataaaagaacaaaagttctcaaaaacatacatggcttaaggcagtctttaagcattagagcacttctctgttccctgagcctctattaagacatgtatatagcttgaacttgaaagtatatgcatatatttattagaaagaaatatccacaggtggaggtcagttgtctaattcttgcaaaaatgtaaactttaaagatattgttttaaagaaatagcaatttaggaagacatccttgtttataaattttattaactgtcatcttcgtttcattttagcttacacactgagtttagtcagttaataaggaagtttctgactaataacaaagctcaaaattaagaaaaaaatctgatttgaaattatagtttgtggttagtttatatgaaatagaaaaaataagaggagttttttttttaagtagcaaaagcatgtattatgggaagctcatgatcttgcattttgatcattataggagttgaaatacctgcttccttttcatattttaaatatactgtaagttttagggcataaaaaaatcagaaaactatgtttaaccttcttaattagaagcctcataaatatatcaatataaatatagccatttccttgtccaacaatgtctacaattaaatacaaaatgatagtagaaaatgataaacaatattttcactgccctttcagccctccgagtttatatgttattctatagtaaaataatctgcttaattcatatttagactcttatacttagtaacaatataaatctctatagcttatattaaaatattttgaaaacatagcttggaatttgcattgtttagttaaaaaatttatgttggcagacctaatacatgcctgaaatcactttactctgcactgatcaaatagtcaataatccttgtacatttacttctgtgattagcattatttccttcagtgatacatttactctgaataatgggaggagccatcgaatggataaatctgtttataattgcatgtctaataaatcctggaattattttctcaggccaaaatgcttcaggcacctctgcctcatctctttctcttaaactccacatcctatctgtgtaaaactctatcttgataacattaaaaaatccaaccacttcccactctgtcgaattgtactcagctaatccagtcacatttaggtctggtcaagattgcaatggcttcctaactcctctccttgcttccaccccactcccttatccttataacggtttaacatttcctatctatatgaataaagcaagttcttttgaatgaccaacacattgatagcatttaatagatttagaccatctttcaatgtgtgactaccactttcttgatgaatgtcctaaattactaatgttcaagagagctggaagcttcagtgcccatcagaactggcaagacatctcatttctgaactctaaagggcttcctatagggaaggcttgttttaaatagcattcagtaacttcagttgaactaaattgctctgttgcctgaataatatagcaaagagaaggagacttctgttataatattgtgtcagtagaaaaatgctttctgagattcaaacaattaattcataaaaagttttcagatcagaaatttaacaaataacttcctttcataaaaaaagtttatgtaaaataactttcataaataatgtttacttaaaagaacttttataaaatattcagatattagaaaattcttatatatagcatatacttaaaaatttatttttagaaatattttacctcaagacggaagtctatggtagcattttattacacgtatgaccacacatttcattgtcagcaatagacctttttttaacatttgggattctgatattcttgctttaactctggtttcctatatcatggccaaagagagagagagctgcccttagtctgttcatttgggacttcccttaaattagggcttggtaaactatggcctagcaggccaaattctgcctgccacttgtttttgtaaatacaattttattgaaacaccgacatgttaatttgtttagatattttccatggctgctttcacatgacaacatcagtagttatgacaggggccatatggcctgtaaagcctgaaatatttactatctggctctttactgaaaaactgtgtccaaccctgcccaaataaaattccatggtctgactgggtgaggtggctcatgcctgtaatcctaacactttgggaggccaaggcaggtggattgcctgaggtgaggggttcaagaccagcctggccaacatggcaaaaccccatccctagtaaaaatacaaaaattagccaggcatggtggcacatccctgtagtcccagctacttaggaggctaagataggagaatcgcttgaacccaggagatggaggatgcagtgagccaagatcgtaccactgcactccagcctgggtgacagagtgagactccatctcaaaaaataaataaataaataaataaataaaaataaaaaataggccgggtgcggtggcttacacctgtctgtatacccagcattttgggaggccaaagccagcagatcacaaggtcaggagttcgagaccagtctgtccaaggagttcaagaccagtctatccaacatggtgaaaccacttctctatttaaaaatacaaaaagtagccaggcacagtggagcgtacctgtagtcccagctactcgggaggctgaggcaggagaatcacttgaacccaggaggcagaggttgcagttagccgagattgcaccactgcactcctgcctgggcagtagagtgagactctctctcaaaaaataaaaaataggccaggcatggtggctcacgcctgtaattcccagcactttgggaagctgaggcaggcagatcacaaggtcaggaattcaagaccagtgtggacaaggagttcgagaccagcctggccaacatggtgaaaccctgtctctactaaaaacaaaaaaattagctggccgtgttggagtgcgcctgtagtcccagctactcgggaacctgaggcaggagaatcgcttggactcagaggttgcattgagccgagatcgtgccattgcactccagcctggcgacagagtgagattctgtctcaaaaataaggaaataaataaataaataaataaataaataaataaataaataaaattctatggtctagtcctctaagtatatccctagatatgtcccatgaaggctaaaggaatttcttgtcaatgcatgaatttcaagcccagagtcttgctgaatatgcaaaaaatattttcattcaatagcaaatgttaagcaattacattgctctatcatttgtctgtcttttatgaagaaatccatgggtaacatagtgaaaatacccagggaaaaatcactttataccatacggtaatgaatctgaatctataggaatcttaatacatatgagcacatgtccttagaggaaaaataaggatgttgctaaaggagaatctctttcacaatctaatggtatttttttgctgatacagattgtaaatattaaagtaacagttcactgtactaagtatgtatgtacacacatgtaatactgaagataataaaactggatgtttcaatggctaaattatttcaccatgtttgaacaacttcaaatggctggaaaagcaaataattcacaacactgaacttttgaactatcgatccttctcttattgcacctccttccccaaattcccttcttctagcagctcagaccaaaacacttgaggcatctctgcctcatctctttctcttaaactccacatcctatctgtgtggaactctaccttgataacgttaaaaaatccaaacacttcctactctgttgaattgtacttggctaattcagtcacgtttaggtctggtgaagattgcaatggcttcctaactcctctccttgctttcaccccactcccttttccttatcccactcccttctcaaaacaacaaggtgatctttgccacttccccacacaaagggaccagggacttttggagaaatagttgattcctcatttgaagcagagaaagtttgaggtgattcttgagtatcttattatttgaaagccagaaagtgtttgaagactaacgggaatatagcaaagtcacaggggcttgaagtagcttccattggccaaacagcttaacttgacaattaaaagaaaaaaaatacaacatgttaggaaataataaaaataacaactggaatgacagtagtaatacaaatatcaacattatcaaaaactcttaagtccacactgatcctaaataaaaggtggtaggagtgagatgagagaaagaacatcttcacagagtgttagtggacaaatgcattatatttcaccaaccaatgtaataattaacttagataagcattatcaatggatgctaaaaccactggccaacatggatgctaagttaaagatgctgagaaacagaatattcacgtgaactctgtgtcactccataaatttttaaaaattaattacaaagagaataaactatctttaaaagcgaaagatttaatgaacactaacctattcaacaaatttagcaggactcatgagataaactgctgctctatgcctcatgctatgatgcagtaggaagtacacaattacttatctcatgttcttgctgaaatgtccagtcaaaatttgatcaggaggaaataatcagacaaatccatccagattgtaggacattcaataagtaactagcttatgtcctgaaagacaaaaacagggggccatgggggagacatggagctatttgtccaggatagggatgacgagagaaacgacaagcaagtgtgatatgtgatcttgactggatttttgatttaaaatttttaaagaatattttaagacaatgagagaaatttgtggcctatatactagaagacattgtatcaaagttaatcttggaaggtgtgataatgttgtgcttatgagacaaatttccctattgttagatgactcgtgtatttagtagtaattgccattgtacatgacaaatttctttcaaatggctcaccacatagagtaggaaaaacaacatgaaattgaaataatatatatggaaaaataaaacaaatcaagtaaagtgccagtatttgaaaatacagacataaagaaatacagcggttcattttattcttttaacattctatagatttgaattaagtacgaaaacaaaagaaatacatacattacatataatatagcagattatgccacttatttgctcaaaatcttccaaaggatccccacctcagtcaaagataaagtcaattccactaaaaccaatgacaggtggttgatagaggtggggtgaacatgtgacaacaaaaggaggacattttggggagcaatggaacagttttgcaccctgagtgttgtggtatctccataaacctgtacatgccacaaaatccaaacaagtttacaccaaacaacaatgaaaagtcaatgtatgggaaatctcttggcgcctgaataaggtctgtatcttagtttattgaattgtaccaattccatttttctggtcttaatatatatggttacatatatattatcattgagggaagctgagtgaagagtatgtggggatgctgtacagttttacaaattctgtagtctaaatttatttcaaaatattattttttaaattacttgcaagagtttgcatgatctgccctagttacctctctgacctttgctactctcaagctcaccagttcttcttcacctgtggccaccttgctgctgcttgcagggacaggccatccttggggctctgtgttccctaaccctgaccacctcctatcacatcacagtctttttagccattatgtccatcatctgtctttttggctaaaatgaattttgtaataaaacaagaatctttattttgttgaaggatgatattgcctgaaatatgcttggaacatgctaggcgttcactaaataagtgttgaattaactaacaaatcttgaaatgtctgcactggaagtttttgtgtgaaaagtggggcatgccatatttcaagagaatactgttttttaaaaaaggtaaattgtattgtgtatatttgaggtttaccatatgatgttatgggatacatgtagatagtaaaatggttgctctactgaagcagattaacatatctgtcatctcacttagttacattttttaaacacagaagctaacatctacttatttaacaaaaatttctaatacaatataattttagtcactgtagtccttgtgtcttacattagatctttagatttgttcatattacctaatctgttactttgtattatttgacctacatctccccatttcctttctccccattccacccatgaaaactgctgttttattttctgtctattttttcagatgccactataagtgagatcatacaatatttttctttctgtgttttgcttatttcatgtagcataatgtccaccagctccttccacattgtcacaaatagcagcatcttctttttcaaaggctaagtaatgttcctgcctctggatgtgtgtgtgtgtttgtttataattttctttatcctttcttctgtcaacagacacttaggttgtttccattatcttggctattgtgagtaatgctgaaatgaacatgagagtacagatatctttacaaggctgtgattccatctccttttggtatatacccagaggagagattgttggatatgtatggaagttctattgttaatttctgtggaacctccatgctcttttccacaatggcttttccacagtgtacattttcacccacagtatactggggttctcttttctccccaccctagccaacatttattatctcttgtttttttgataatagccaatctattgggtatgaagtgatatctcatagtggttttaatttgcatttccctgatgattactgatgttgagcaccttttcatatatatgttagccatttttatgtcttctttggagatatgcctgttttggtcttttgcccatttttaaatcaggttatttatttttctgctattgagttgtagggttttttaatataaattttggatattaaccccttatcagttgtgtgatatatttttccagtctgcaggctgccctttgtttgcatttggttgcattttgtcagtggttttcttttctatgccaaagcttttagggtgtaagatttacctaaagctttaacaacaaaatttaacaatattcttcagcttgctctattgacagaacataatattactcctttctttgccttttgttttgcacacagtcaaaatcaccctctgtgctgacttccacaccagactgattcatgaatggctgctttttcccattgtttcctgttaggactctatggtcctccacagcatttccactgaaatctttgaggccgtcctgctatttctcaatacatagcagctgctaagctatcctgctgtcttccattatctgcacatttccttctgtggagttatattccaacaaaggttcctgacatgctggctgagcttgctcttcttacaatgccatttgattttcagtaaggtttgctagcagatgatgagatggcagaggaagccagttatggtatttgctattagactcagtcttcaagaggctgtaaggacttccttgtttgaaaatctgctaaaaattattttatattcttcagaattatttgattttattgtgacacttgtatattctttcttcttgatgctcttagaaaagtcactcgtgcctcagactgtctttatacctgcatttttttcccatcagaatgctgacctcctgccttgttctttgtatgttcagctcctttgaatacttcagccttcagttaaaagtcatctgcactgagagctgtttccttacccctggattgaaaatacacttttacttgttcttctccatgcggaccttgcttagaacttgttatttttcatgtatttttaagttgtgtgcattgtctcttttccaatggcatgcatgctctataagagcaaggggatctttgactccccactgtagcctgtcacccagcacagggtttgtatataataagtgctcaaaataaatatatcttaaataaatggatatttgacaaaagtaatttctggatgctattagagcatgtacccagaaaataattatttgaacccaaagtggccacaagtatcagatacgcactcatttataactctagtatattgtccttaacattgctctttgaaagccattttcagtcattttatattttcaagtagttttttaaaaagtgatactattagtttggtgcaaaagtcattgcggtttttgccatacttttaatggcaaaaaccgcaatgaattttgcaccaacctaatacctttgaccaacacacagacacccacacatacatatgaacacacacatttattttatagcattattagtaaaatattgatattatttaattggtttaccttttcgaatgcctacatccaaagataacacaaaatatgcaatagtttaagtcacaattttagttttcactggaaagaacccaaataatattataactactatcaaaaggaactctcgtattcatatctacatggcctatgtaatatcaactccaactgttcacagatcactgtcatcagtattgatagtaataaaaataaaaatatatcagaatatttactctcatgagaaactgtattagtttcccagggctgctataacaatttactacaaactggatgacttaaaacaacagaatatatttttaattgttctggaggctagaagtctggaatcaaaatattggtggggccatactccctctgaggattctagggaaaatgtttcctttgcctctttctagcttcagacagtggctggaaatccttggcattccctggcttgtagctatgtcactctcatttttgtctcagtcttcacaaggccttattcacagtgtgtgagcattttcctgaccactttatgaggacactaatcattagatttacagtctaccctaatcaatatgtcctcatcttaatgtaactaattatatctgcaaagacctttttgaagcacggtatttccccgacccggtcgcatgatgcgtgacaggggtgccttgtttactcagcccacctctctcaactcctaacaggagggagtgcgtaagtgaacacagcggtaactggagtcagaagcactggaaccggctggctgtttcggtgcctgcaggatcaaactctattcactcgcacccactgcgttccacccaccgtgagagggagtgcgcaggtgagtgggtgcaggagccacagcaagcccttttgggcgcctgcaggagctaactccgttcaggcccctcagcagcatccaagcaggatgcatgcaacttccgaagtccccgagggcatgttacagcgctctttttttttttttttttttttttttttaattatactttaagttctcggatacatgtgcagaaggtgcaggtttgttacataggtatacacgtgccatggtggtttgctgcacccatcaacccgtcatcttcattaggtatttctcctaatgctacctctcccctagtcccctgacaggccccatgcgtgatgattccctccctgtgtccatgtgttctctcacatgtgagagcatgtggtgtttggttttctgttcctgtgttagtttgctgagaatgataatttccagcttcatccatgtccctacattgctcttttcgctctgctgtctgcggatggcttaagtgttaacagctcagtaggccctttgcctttttgcgtgaggaggctgccctccaccagcaagggcaaaaggccagtgtgataggcttttgtatccacacttgtggctcccaagctcttgtacagcatccatgaaaaatgaggttgcacgaacgaattgaaggatggtaaatgcgggggattttatcgctggcgaaagtggctctcagcagtaacgggagctgaaaaggagatggggcaggtaggtaatcttcccctgaagtctggccatctcgggccagattcatttctgaagttacgccgtcaagctgtctctctgaagtcaatctgcttctctctgaagtccagccatagtccccaatgtccagttgcttctctctgccagctgagtgtggggtctttctaggcacaggatgggagtggggtgggccatgggtagtttaggaaaagacagcattcaagcaggaaaacagggatagaagttctaattttgggccgtggtttcaggctttttggcttgatggtggggtttcattgtggaccctcccttttcttcctagaattgctctgccctctgtccctatcactatttccaagtaaggttacattccgaagttttaggtggacatgaatttctatttcaggggaggggatgcattactcaacccagtagagtctgccctctggcctcaaaaatccacgtccatcccatgtgcaacacagcccaacattcccaaaagtcttaacccattcacgcatcaactctaagtccaaaatctcatttaaatatgtttggttcaaaaagcttcaaatcttatcatctgaatcaaggatggccaagactctgggtgtgatctatcctggggcaaaatgtcttttcatctgtaaatctgtgaaactcttaaatgagctatctgcttcctaaacacaatgctgggataagtataggataggcattctcattctcatagcgggaaactggaaggaataaaggagctgcttgtcacaagcaagtgtgaaacccagtagggaaaattccactgggtttcaaggcctgagaataatcctctgtggcttgatgttcagtcctatgaatctgcagattcctggtcagccctgtcctacgttctcttccccaccaactcctacctccctcgtaccccttgctcagtgaaatcgtactcatttttcagtcttagtttgactgttagttacgtattctaatgtagatgagttctctttttataaattatcatataaacgttcattcttatctttgcttactagaaattataaagttgagtaatttcacaaataaattaatccttgttcccccaagcaggattcaaaggagaacaggagaagcatatgtcttatttgctgttacatccccaaagcataggtctatgcttgccacatcctaggctctcaggaaatatttattgaatcaataaataagatggaattctgtcttaaaagaaaacagtaggagttttgtgccttttgagttaaaataatgtcatgggcaaaatacctgatttcatattgaagttccaaagagtcattaagaatattaatgaaatgaaaatgtactcttatgctttaaatatttttcattaatttttgtgggtatatagtaggtgaatatatttataggggatattagatgttttgatataactcttatgcttttaatgtagtaattttaagattccagacagaattgcagacatttaaaaattttaacatatcctttggaaattgattaaaaattaaaaattatgttcagcaacaatatagagagactctcccataggtgttttggcctaatataatttttgttattatcatcattttctactgtaagtgcatctctgacttataattgtaataaataaaaaatgcaacaaatcttctttccaaagctacatttcccaaaactggtgtcatagagcatagcatttatttagagatgcatcaagaaaaatggggaatccctgaccacataattttgggaaatgtcatattcaatatcctccttcaacaattaattttcatgaagttcgttaggtgatataaatagctctgcgtagttctacagaaaaaaagttattttctaaaaaatgttgctccttcaaaaacttttattttaatattttttgtaaatatcttgatacaccattattttataaaataattttggcaaaatatgtaatgcaaaatgtgatatggcttttattatttaaattaatttatattctcatttaggataaagcagtttaacaatgccttctttcaaataaatataatctgatttcttgttatttctgtttatttgctgaaattataatttcagagaaaagtatagcagaaccaattgcttaatttctgacccaagtgcagacatcaaggagtaagcaatgcatcactccttttgtcatgtggacattatgaaatttagtacattctcggtaactgtcaagtcctgagaatgagcactggttagatacctgggcaaccttctttttgtaccctcttcctccatgtcaagtttctctgcctttggggaatgtgatactaggaaaaaatttctgtaagatatacacaaggtaatttctatttctcatttctactttaaaaagttttaggatttgattgaaaatttgcttaggaacttgttgttactcaggattttccagtctggcggacactaccagaagatatataaacacaattaaattcctagcttagctctgagctctgtcttctggacttcaagataatccagagagacgcaatcctaccaagacactctaaactcattgaataataaaaatagcataaagtatgaacccatttaatattcataaaaattctatgaagtgggcatttgtattgatttcattttatagataaagaaactgaaacctacagttcaagtcactagtcctaggtcacacagttactaagtgaaacagatgagatttgaaaccaggtcagctggttccttactcttaattactacaccttacagccatcatgttcattggaaactattgttttattgaagccagcttagttcccaggtagctgaatttatcttcacattattagactttaaagagttctgtttcacattttagtgtgtcagtgttgaattgaggatttaaattcaattttagcataacacataaatcagtgaacttcaattactacagattttgactaaaagtcttctgatttttttaaagtaaatatttataaattaactctcaatttttctccaaccctaagaatataacttttcttacataagtagcatattcggtcatcattggtaattttaatgctttctttatgtttctttatcctttatgctgtatatttttatgttctcctttgatctctataattcttctgatatttctgttcggactgtaaacaattggttttattaaaaaataatcatttacaaaaacaattcaataacaaatgagtagacacacaaattagcagtgaaaaatatgatcacataccaaatacaaaataacattctcaaaacccattttaacgtgttcaaatacaattttcttcagaaatagaaattcaccaattcaaccttgaaagggctaaaacctctgaaagtcaatgacttaaaaaaaatttcaaatagtatttcattaaaaaaatgaaattgtctaatgttttctaccacttctcatattatgcttggatgcatttttcctcagagagcataagacaatttgcagagtataagcaaactgaatgaatagaaatcagattctttctaaggcagagctagaaaggaaataggataaaacatgtaacagaaggtgagtgaaaacaaatcaggagcagtgggtaaagtaagcttaccttgccaaatgttccattataaaagttatagtatcaatgatagaaactttaggaaatttaagatggcggacatccttacaattttctttgtaagtacatttaaaaaagatgtctgtgtacttcaattggaagggaatgagggttgactcaaagcatataattaattatccttggctattttacactgtggctaattcagatgttactctctcaggaagacagggagaaacttgatttattttgtctggaatcctattcttattaaaaaagaaaggcttaggcatctactgactgacacaagtcacagccctgccattccccctggaagccaggaagcagaatagcaaagaaagggtgtttctaaatgaacattaaaagcccttcaccatggaggaagctacattaaaggtaacgtcttggcaaggaaatattgctgtttagctatttttttttaaattaactttatgaaggctgtcctggtatgttcaaataacacaaagtcaatctttggtttatttctgtttaagctttggcttgcttttttaatcaaaaattttaaaacaataaaaaattaaaagcttagaataaatgaaggccaaactgacttaacgttttatactagaatattaacagttgctgaggtgatgctgagctcaattttgagaaaagaacaacagataaactgacaggataacattttattttaaaacagtgtgattccattaggctacaagtatgttttgttagtaattttaactgatttgaagctctctttgctattgctctcatttcacattgaccttcagtaaagtatgcaaattgttacaatgatgcaaaagataacgtgcagttcctaatagctaggatgggcttactgatataggttaagaaaaattatgaagttaattacttgtggtaggttgatgtaactcaatccatttttcctagggatgcatttaaatgccaaaagaaacaattcacttgccccagcccacacaagtcagtagtagcacagggtggtgtttgagagggattaaaattcacaaattctgacacttagtctactaaaccacatcagtttcaaactgccctcagtagatcaactttcttctttctggaaacatgtgcttcctaatgctattgctgatgaaagatatgtctgttcatgtggctaatcttcattgcttagaaacaataagaaaggttcgctcatcttaaagaagttcagtgcattctcagaaatttaaagggatacttcaagtttctaaaaactccaaattttattttcctttttcttatttcttgatatgtgtggtctatctggttttcatgtttctgtttttttttaagccaccaacaattttatcatataattaatgtgtttgaaatcaagaaaattgaattcacttttagtagtgtagacagttaccctattataaattatatctatgacatatttaaaaagaaaacttaactgctgattttttaggaaaaagaaatcttgtctatagcactttagctatagcagtaaatcagctgaggtattagaattttacaatgttctctgaggaaagtgaaatttattattggcttttatatactccattattttcacaaagtgctataaaataattttacaagtttttttaaaccttcctgtgttgtgataaatgatataatttttcttatttataagttaagaaaaaaaaaacaacctcaggtcaaagcaaggttgtgtattttatacaaggtcgtgtgtcttatacaaggtcataggataaacccatgggcattagttagaattttaaaagtaatatggtattatggcattactacttttacttttctattcttttaaacatcacaatctacttcgagtgttgcttttgtaaatctactgaccaataagatcttttaagcatttaatgtatatcatgtgcaagacccagttttaagtgccttacgtggggtaaactattgaaacctcaaaacaacttatgaagaatactgtttacacattttacagagagactgaggcacagagactttattatgacatgtccatatccaagaaagagtatagagcagtgacttggaacattagtttccaaaatgtgaattccagaccaatagcattgatatcatctgagaatatattaaaaatgcaaatccttggttcctaccccagactgagttaaaagcttgatgtacagggcatagagaatagttttttttataatttattattattattgtagacacagggtactgctttgttgctcaggctggtctcaaactcctggctttacgtgatcctcagtgatcctcctaccttggactcccagaatgctgtggttataggcatgagccacccagccagagtgacaacaatttttttttctttcttttttttttttatactttaagttttagggtacatgtgcacattgtgcaggttagttacacatgtatacatgtgccatgctggtgcgctgcacccactaacttgtcatctagcattaggtatatctcccaatgctatccctcccccctccccccaccccacaacagtccccagagtgtgatgttccccttcctgtgtccatgtgatctcattgttcaattcccacctatgacaaaaatttttttaacaaatgattttgatgcatgcccttgtctgagaactactagttcagaagatagagtctaaattctctgcctttgactcacaagattttcatttacagggtgtgtggcttcaaatcactggtctttcagggtctgagttgggttatctttagaataacactgggaatactagtagctcttcgatggggctgccaaaaggaccaaatgtgaaagcctacttcaggcaggtagtatatcttctgtgaataccaaatccaaaactcaattttattatttataagattgaaactaattattatataaaagattcattaatttaatgtattaaggcattctgcatggtacctgacacttagtaaatggttagaaactgatatcatgttattatttttattactactactatgattcatcattatcactgtcagtcattatttgagttgtggaaaactaggctattggtttacctatgacctttatactcagaaatccctttccagcctccttctgccaggacttccacgcactgtctactcatttgtgtctgtctgtctttggccagctgttagtccacctgttttagtcatgtagacagcttctcctgatctacagccagcctgatcctcacttctgtcttatttccttaaggagagatgcaataatgttttaaattgtgtagcctgagtatgaattcagtccaccataaataattaaatgcatgacctctcttattgagtgtttcttttcattgatgttcataaaacttaaacaaatacatgtgatcaatcttgtctgtgccccagagttgtaactttttgaatgaattcaatgtcaacttgcaaatattatttcttcaaaatttcctctgtatgttattttttcttctatttatttctgataaaaattgtctgtgctttttgattaaaaagcaaacaaaacacactgggctcctctagcaaattatttctcaagctacatataaagtaaactagagaaaagaaaaagttattaagaaaatcataaggaagaaaaaatatatttgctgtttattaaatcagagtagatcatcatagcggtcatcctcattgtattcacattaagtaagctgaaaaggaggaaggggagggattggtcttaataatacttttctttaatcaagttaaaaaaactgatatggaaagaataagccctccctactatttgtagctattgtacaaacaaaatatagattatactcaacatgttcttccttattaatattgttatatgttctgcttcagcattgagacaaaacatctgtgtattcttattcttcaggaaatgttaggtccaataatgttgaggaaggcataattttacctataaagtcactgtattaccttttgtataagcaagaaaccacaagaaaagccgaaaaaaagaaaacaaagcttagctagaaatggcaatgtaaagtggggtttgttaaaatgtgaagaaagtattataattcccttgcagagtacagcaaagttaggtatatttctgaatggtgttcatgataaatgtatttttctaatgtttttttaatggctgaaattcctaaggtttgctatgacatggaggcgtcaagaaacctgcagcaacttggctttctctcacctttagtgttcttgaaactgatcatgtctaatatgctttcgatctctggctttatattcaagtcttccatttaactggtagtatgtaaaacaaaacgtatactgtttttacctgcctctatttatctccatccataccgatagctgatggttgattgtaatatgttgaaatagaagaatagcaatagaaacagaaaaaggaggaggatgagaaggggaaggaaaagcagaaaagaagaaggaaaaagaaaaataccaggaagaaaaagaaattactagaaattaaaaatagaaaatgccatcaagcgagtcacttttatactgggccctcgaacaacatgggtttgaacttcacggtttcacttatacatagattttcttccaccactgtcacccttgagacagtaagaccaacccttccccttcctctttttcagcttacttaatgtgaatacaatgaggatgaccactatgatgatccactcccatttaataaatagcaaatatattttttcttccttatgattttcttaataactttgtcttttctctagtttactttattgtaataatatagtatataatacctataacatacaaatacgcattaatcgactctttaagttgtcagtaaggcttttggtcaacagtaggctattagtaaagtttttgaaaagtcaaaagttatgcatggattttcagctgcatggggaatcagtgaccctaattcctgcattcattgttcaagggtcaaccgtactaccattttttttgtaccaaatgtattaccatttttttttggctatgatccttaaaaatgaaaataaattctattctttttaaaaatttaaataaaaatattttataagtcatataatttggctaatatgtcacacagctgtggttgtattgatagattacaaaaaatttcatcagctttaaaccaaagccctctcttaaaaatgatgcagtgtatttcaactttgccttgttaaagtgtcaagaaattttaatccattaagagttgttaaaatgtggaaaataaggcatgtgctatgccagatttttaagtgcccatgtgtttgctcttagacaaagagttgtgttaagtagaatcgtatttctcatttttctagttgtatgtgataattgcactttaaactcctcaaattcacttctgtctgacgtggctttgatcttttacttggtccacattttacttactctttttctctttgtccatgttcatactcataaccaatcatgtttaaaagtaactatggaacacatggaaagttggaatattattgggataatgaaagaacttattttttacaacttgatgacataggatttaaagtaaacgtaaatctgggaggtgcttaatagaattaatgttctctgatggtcactgtaaaacacttaagaaaccatgtatctctggcttaaaataaattctgactacattatttattacaaaattataatctacttacattggttaagtgactattaaaggaagtgaatatttttcttatctaagcaagtagcttgtaggccaaaaatacatttggtttgatgggaagataaattttcaacattttaaagtaattttttaacgtttgtatgcattgtgagccaaaatatttgatttcttattccaactgctttaactctagccatgttcttttgaagacattactttctctgagaatcactttgcttatttgttaatggaatatggaaatgcttgtaaatacctaaaaaggaggtacaagtgacataaagtaaaaaaccttaaaaggcagtaggaatgtaagtcattgttattttctttgttgccatttctgtattctatctattcatgttatatctctcactgtttataccttagtttaaactttatattaatagaacagtagccaacttttctttttgcccatttccatcagtcttatttgcacaatctaacttcgaagagagtttttaataaatataattgatgtgaatggatgcttgtgaagtggaaactggagtagcaaaaaatatgccaagagtgagaagatactcagttgtagtgtttacagtaagttttctttatccatggtagttatattgtataaagttgctgtgactattgaattgctgctcctaggggaaatacaagtttagcttcctgagggcacctggttacaacattgtcatcaaatgatcaatacatagtcttattttatgtatgtttctgttttaaggcaccttatttaatatacagttgattcattaacattaaaatcatggccaatagcatgcaactactgccagaaaggatattttctaacatgtattttctctgtaaggcatattacagccttcttgcatttaggaacactggctgacattttaccactgtgctttcgggccattttatacagcaaaatcactaacaaaaagcacagaaatgtgaaaaatgaggcactaaatagacagttatttacagtgtgagagttgaaataagaaggcagagagttgccttatttgacctcagctgagaacatgcatgtcaggcaactcaagtttttgccattctgtcatgtctacaaatgactagaaagtgccacaagtattgacttttgggtcacaaataagttttagcaaatatgtgaatttgcaaatacaaagtccccaagtaaaagatcaactttgttattttctatttacccaccaccctcccactttgtaccagcctcaacaataattgatgttttgtatgctgtgctttaaatttattttcattttaaagattcaaaaaaaatcattccatctctgttatgtcagtactctagtattttttgtttttagcattatttaatactttatgaatattgcaaacactcaaacattaactgactgaactaagtaatttctaagcaataagcagtatatttagggaggagaagagtaagggaaatttatttaagtgtaatcattagactttgtctaatgatctgtgttaaattcttacattttctaatgagtaaggaataataccctcatctgaaagccatagatttatgtgaattaatagagaacagacaaatatgtttaaaagagatatcggttgtatcataattaaaatgacttatctagaagtgaaaatcaacactcttgatagagccatcagtttaatatagtaaattgaatgcctgccttgtaccttgggctgtcaaagttttccgcacttttggagaatggacagcgatttagaatcgtaaccaaggagggaagaaaaggcagattaaccaaaaaattttaagaagattggagcccaataatcatgcataatcttcaccaagccactcctcccagtacaaagataatataagtgaaattgtcatctttcctgtccatatgtatcaacaaatttcatattgtcatttcactagcatgacagatatgtcaggcatgtcatttttactttataattctagtgctgttaacatcctgctccatagacattaatactttcagaactttgctaatgatgaaactgaagctttgagtggttgtgacttgttcaaggtcaaatagatagtaagtagtttaattaaaattgaagttcaaggctgagtgattccaaagtccataatttttccgctacatcaggttttatatatatcaacccaaaattcctactattggatatgctatgagacagtccttgcgggagcaatgtcaattctacacactcctttccctggagattcatgttcttcagaaatcactgacagctcctaaaatcaagaagctatggtggaagaaagaaaactgtcggcaccagagccccgtgattttcctaatatcagcatcttcatgactcaggaaactggatttccctctacaactatacgttccctaaaccttcaaagtgtgtagctgggaaaatgtggattcgtagtcatactaataaagttcttaatttgtgagagctccaaaccctcacctataataagtgaggattaggtatcttatctctgtcttggacactaagaggttcaaatgagatattgtaagtgaaaatgcctttcaaaatgcaagtccataacccatttacaaatgtgctcactgccaccagattcttttccaacaccaaattttctcagaaatatgaaaattcttcaatattttccacaagtgatagcagacagggtgaaatagaaagtttgtgcattttatgtgcagctttcatatttggtttaagttttctgactctgtatcacggaaaaatcttggtttattttattcattgactcaatatttattgaaggcatactaaaagctacgaactttgctgagagctggtactataataatgaataaagcaaatctcttccctcagttaaagggaatgcaatgcaatgcaatacaatataaaccatatttttcataacccaggaaatatacttggccaaattttggggagttgcagaaggtgtctgaactagaaccagcagggtgaatagcagtcagtgaggcatagtacgggggagaaaaagcagaggtagaaacactcaggaaatagaaaaatggctgtgcttgcatttttaaaatagatgctctcaaggataggcatcttctaaaaatgtccatactctcaaatcatatacaggtaatttctcccccagaacatactctgattgctttatcaatgtcacaggatgtcatccataaaaatatgtcaaccttttaaagaagtggaagtatgaaaaggctcataacactttctcttaatccccttccctctcagataggatgtctatcaagcattgtactgtacagaatgaggatgcctctgcctgggtacttaaattattgatcaaacctgtcactagcaaattctttaaactggatacattttgattgagtaggaaggaatgtttaaatggatgcctgactgtgaagagaatggttttgcaaatgtctccacagtgctcctaattgaagttctgataatatagcattgcaagataacttgttctcctctatttttaatatggcaatttaaaatgtgcatatatattaaaaaacacaggagtagaaagcatcagagattgataatactcctttcctctcctcttagatgttatttgggaaaaaatatgaaatatgtttgactgagtgagaaaataagttttaccatgccttctgtattcaggagaaagatttattattctaatccgaatagccttctcaggaagtctaggttcccatagaagacaggaaattaagtgtttttctatagcactaaaagacacataatgtattaaagagaatatctaaaagtccgtctgttttgaagctatccagctgcagtattctcttgaaaagatcatagcaacttttctcttatagtttccaaagtgatgttatggatcaatttaacagttttcaatgagtatatcccttttaaaatgtcatcttataaagttcatgattaattgcatgaatatccatatgaaacagcattgcctctccttaatccacctccccaatgaaaagctaaatgcatatggactagccaaaactttagaagacatggtatcttcgtgtgtttgctactgaattaccaacttgcatgtcctaggaatagtttaatatgaaggcatacaatttctctgaaaactactttttcttatctctaaataatggtttcttcatctcaatgcaaataatattaaattaaaaatgcatactgtaattctgaattttaaagtgggagaaatatacgtttaaagaagtaatgatacctaaagtccaactataaagtaacagtatgagaaatcctttaagctcttgaatatatttctagctaacattaaaatggatatttcattcagtacaatattcactatatagccatatcatagacgactagatttgatatttgaaattttaaagtctaaattggcaattcaaagataaatcttctccacaaaactttagttcagaactagatagcaatagtaaaattgttctagaccactgaaaacatgattgttttaaataaagtgtttttatttatgcatttaaagatatgtcactggggtagcatactctggcctgcttttgttttataggtttataattcaaactctaaagcacccagtttaatcagaaaaatgatcccagtatattatatttttttgtcataatatgatgccctagtgttctattgctcttttctcaaaaatttccggaaactttattttccagtgactattccttttcccatttatgaaaattccctatgcattagctaatatgatttaaagcaattttgttctgttttctcctttttaaacatctttcacacaatgattctcttttggaccctccatggatggtgaatataatttcaatggggtgtttaactcttacttctcataccagagtcaggaggttgccttcagctgccttttcaaggaaagttcctgaggtttgtctcaaatgtatttgattttttttgacaaagatctgtgcttttacaagctttatgatgggtttatactttctgcaagttgcctttctaaaaacatgtgtaattccccagcagtcctttaaaatagagtcaaaatacttttcttttggagaagttttaccccaaaggctagtatgttatatatatttcctgctttacttttcattttaaaagatttattcttaatcccaggcatattgaaacattattcagacagggtatcatgtttgctgggtctctgtggcatactggcagcctgcatcttgccacaagggtagctagaagcaggtctctgccctgtaggtggctgaagccagagaagcttggctcttccaggtaggaaatcaacctgtcaagaagagtcatggaaacacgattagtttactaacttcattaaatgaaaacgtttgcaacacagggctccctttgctctcagtgtctgccgttgctaaacaatccagtgtttcatggggcgaatggaatgccatgtgtactcccagcaggaggacattccagaaggccatgggcttcctttacctggtgatcttgtggacttcatgcgcaatggcctattttgtgacgctttctcttctgtatttctcaataacccataaccacaggtacacaaattaggaataaaatgaaatagaggtcgctctgctattttcagatcttgataaacctgatttaagatttgtatatataagctatcaacttcttgagtaaagcatttctgacgactaggcccattgccccagaggtttgccttaatttcccaaaagaaatgtgctaaaatgagtgcaaattaacttccaaaaagaggatagatttcattactctaagtgcctcatgctgggagaaaggtgctgttgagctcatatttaagggtgattagaactgcatctttttaactcgaggattctcaagtatgcattcaacttacttgctggtagtttaaactgtggaaaatttgaaccaaatgtgtatatagtgtttttttcccctcacatttttaaatagcagactgtggaagtgtggatcatttaaattctaagagtagtcttttattttaaatttaaaattgttttgcaagtaaatagctaagtcaagtgaattaaaaattgttttgcaaacacatagctatgtcactgttccttagagttttttttaattaacatacatacacacccaggaaacctcatttaggtaggcagaaatatgttctcttaagtaatgagtttgaaagaaagtcttttcttttaatggaattgacacactctgtttaccattctagaaaaagttagagaaaaggtcggtggcctgtacttgttctacactttaatatttataatcattgaatacattatattcataataacttatgtttgccatcattaattaattttaaatttttgggtttttcaaacaaaatatatagctacctattgtgttattagctaagaaatatgtctaagaaatgttaaaaaatacatgatactaaaagttataagaaattacacattggtattcagtgatgtgagctagtctgcaagtttatttttaatgtaaaactttggctaattgattttttttctcataccagataaatatttcttcataaggccatctttttctagagtgggtcctgcaacacttatttggtgcaattctaaagtaaaggtagtacaaacatattatatatttgactactaatttatcttctcattaatttggttacagtcctccttgctaagtagtgaacaagccttaaagaaaaataacaataaataatatcaaagggttcagtattattatatgctgcattgggaaaagccactctaaatataacacaaaaagaaggtaattacttcaataataagaaatgatctttattaaacacattaagttgtgaactatattttattcattcagcttatgaactcaggggaaaatatatagagttattgatcacaatgtttcaacaattcttgtgtgcacctgtgtgtgtgtgtgtgtgtgtgtgtgtgtgtgtgcattcatgcacatgtcagagatgggaacacggtataatattacatcaaaatagctagctacagaattgatgtaatggcataaatattaaaattacagatatttatttcctgcaaaaatagatttattcagtaagggccatatttcataataacttttgaataccatttcatagaaaatactgatattttgagtggaagttggatggacttttcaataggattcaagaagtgagtaggtatagacagtctgtttacaaatctgtgcttcaggtatatatagagagtatctcagagttaatagtaatcaataaaaagcctccagaggttgaagtaaaaaaatggggttggggttaggcaaagtgtggcacagtcgtcacatctcctctgtctattatacagcttatacaaatcagagcacttggtttgtgacaagggatgtttctattctcattgattagtgctgagtgaactattctggagggaatgattgttttcagagagtcacgtgtggtataattgggttttagttgcattgagcaatgcatcaatgtagttacaagacatgcatttggtactcaaaggcatctgcactgtatttatgcatgtttcatgtatgtacacatccataaaatatatcaaggatgtaccacctaggaataaatatggcacaatcatacctattatgtgagaacacattaacaatactgactatattacaactatatcttgctatctatgagtagggtagattttgagttattttccaagaatttgaaacaaattattgtaaaacagctaaagtctgtgacgtaatcatgattctcgtgattagaattgtatattttgcttagaatagtagcttataataatactaggtattatttactaaataccatccatggtgttcacatattatctaaccatatgaatcttacaagatttttattatttatttatttatttatttatttatttatttattatgacagagtctcactctgtcacccaggctggagcgcagtggtgcgatcttggatcagtgcaacctctgcctcccaggttcaagtaattatcctgcctcagcctcttgagtagctgggactacaggcccacgccgccacgcccggctaatttcttttgtgttttagtagagacgggtttcactgtgttgcccaggctggtctcgaactcctgagctcaggcaaaccacctgccttggcctcctaaagtgctaggattacaggcatgggccaccacaccgggcctctcacaacatattatagctgttttacatatgagaaaatcagagagggtaagtatcttgcccaagaccaaaaaccactagcagatttctgagccaagatatgaatgcagctccctttgaaatggaaacctgctctaattctgctgcaggaggttttctccattattgatactgtgccctaaaatattaaccaaagatgcattatgtacaaatgtacagccagatactgtctgtagtccatccttcctttcaacaaatatttactgtttaatattcgtataaataatatatgcaatgcaaatattaaaataagtaattttatttaaaaagtaatgttttcaagatgttccactggagatacagctttgttctatagtacatgggcttcaaggagaaatttagaacatatttacattttacattttgcctttctgcaacaaatcttgtgtcccctgaaactctccagtgggaatagtgaacagggaaggtgccacactaaacatctctctcgattttatgcgcactgtaaaaaagcatacacatggctaattccaatcattgtacatatgtgttagaaaatggtaatatagttctttcaacacctatttttaacagtgtctagttattgggctgatgtgtcagtttcaatttatctgataaaattatgattatcaaagatgcagattatgtcaattatatattaaataattcactgatttacctgtgaaagtttattcgtgcagtttcattcagtagttttattaaacatctactatgagtcagacatacatctagagtcagataaaatggtgggtaaatataggcactatcttggcttttctgacatttctcatgcttgaactaaaacaaccacaaagtatccaactaataatttattcagagttatgatgaatgctataataatctactttctaaggtcactgagaagtgacatttaagctgatatcctacaaatatgtactgagcacatactatatgccagactttgttttgagtattgaggaaatagcagatatttattctccaatatagaatttatcatacttgttgattaatcataagtacttttttgggagaaatatgtaaaaagcataggtcatctgctatatacttttcatttgggagtttcttttcccaccttttttttgtagtttccacttccatcatcttcctacacatggaagagcaaacctccattatctattttcatggaaatttatagttcattgcctttaataacaggccataattttatttgattgcataccatgttttcccccgtatttttatttactttattgatattcttaaaagatttacaatcaattataagtaccaatttggggatttaaatgtaaaaagtgaataaatgtgaaaaatgaactgggttattgaatcatgcgtgatctgtagccaatagagtgtcttttctttatgagaaataaacagtctcctgcaccaaaactgaaatgtgttatgactttttcaatataataatttaaattactgtgagccatgatgattattttgatcatgttaactgaaacatgaataataggagccactgaaaggctttgcctttatttcgttgtattaatccttgtgttgtacaatctttgttgtactaatctttgtataaatatcactttaaaagttgacagtttctgtactttatttgatacaggagaagccaggcaaaataattatcatggatccaatcaatacaaataactactcttggaagtgcaggtttaaggagtttgcttttaggtgcagtaacagggcatgaacaagttttaactatcattatgggtaatggaaagaatttattgttgatgaattagaatcaacagcaaagtgaaaaaagtttaaactgattagtggtattaggttttttgaagattcaagcccttgtgtaactgaaacgtcatggaattctaagtaggtagcttcctgaaacagaggaaaaacataatgtttcattctttctgacatttatctggtgggggctggtgagggaatatggtgggaaatagagcacctgaacatagaaagtaacaaaatggagtaaactactaataatattataagggaagaaaaactgaattacgtatttttacttcgtagaaaacttctggctaattttctgacagaagaataaacaaccaattctaaaatgcgacaactcttttaatctcaatatgcatttcccaaccaatgatgacattttacatatgcattgccacatagtgaaatgagagcagaagcaaagtaactgaaggacaggccaaattaggtcaaaaagagaacccacttctatccagttttattttatcatattataactcttcagatacaaatcttattgcacagcacggtgaaacacaagagagaattgatgttctataaacatggaggtgctcactttgctgtttgtgtaaacttgaaaattcattctttcccttgtaaaaatgctctaaaatcaaacaaagaaaataattataattaaacaaatggaatatgttttgtcttctctttattttttaaaaacagaagttttccatatcaggtttataatcaacagtttttagttatgtattttagtggaatactaaacatgaatacagagacatttgtgcagtcacaaatgtttaaattcctactgccacaccataaaagactaggattttattaataaaatttactttatacacatgtataaaataatgatcagaaactgttatcaaagtaattccaaataaatgaagttagatttatatctaaagcccacatttgttgttataggaatgtgttctggattatgtaacacctattttcactttttaaagtccatactcatttacattaattaactacacatttggggtagttctgtaaattcatcttgctacgtttatgatagttttttaatagactcaggtagagtgactggagtgattagtgaattggaagctattgaaaaaaataaaccatttctggtgatgagactgcggataaaccaatctagaacattcagaaatatctaacttttttacaaagtcagttcaaacagtgaaatttttatctaccatcacctttttttttatcagttatataatcttaagtacttaactttataattttcatgttactgattttaaaaccttgagtttgatttctcctgattatttcctctatgtagaaaataacaatttcctgccatacaaatgattatttagaataaaatcaaaacgatattttaaaacaaaataaaattatattatttcccgtaatctatgcctccatcagaccccttcaatggcactttcttttgcatctaaagtgaaattcaacttattaccatagcctaaaaggccccaaatgaattgtcctctccttccttctcagaacttggctcctttgtctctcctctttacttaacttactccaaccacgttcttccactttaacatagaattagaacaattattaaaatgtgttagccgatgcggtggctcacgcctgtaattccagcactttgggaggctgaggagggtggatcacttgaggtcaggagtttgaaaccagcctggccaacagggtgaaacccatttctactaaaaatactaaaattagctgggcacggtggtgggagcctgtaatcctggctactcaggggctgaggcacgggaatcactaaacccagggggcagaggtgcagtgagccgagatcatgccactgcactccagcttgggcaacagagcgaaactctgtctcaaataaataaatacaataaaaaaataaaaatatgtcacatcactcctctttttgtttaatggctgacagttttaaaggtcattacatctgcctagaatagtctgtgcctcaagtgtctaatgatccatctctctcaatattttgggctcagagaagtcttcctggtttaccttcatttactctttcatttactcagtaaatattgggaaaacacttaggtgctaggcaattttctatgcaattggaatatagcattgaatgacagacaaaaatatctacactggtattatttataccctaacagaaaagagataataatacaacaaaataaatctattaggaggtaatcattactatgaagcaaagaaatgtatagaaagttctagggtttggggatgcaattttaaagaggaccctactaaaaaggtgacatttgattaaagtcctgaaagaattgagtgggcaaaccatgctgataaagggtgagcatgtcagctatttacaaatgagcaaaggccctggccggaagagttgttggtatatttcacgaatattaatgtttccaaaacaccaaagattctgtctaggtcctgttgctcaatgcacagaaagtcaatcactgagacaacaagtattgccagggaagtagtcattattttattatactcctggtgatgtcagcagaagacaattcctaaatctgttcctacctcccaactaaagttaggagtttatatagcaggaaaggaatgtagctaagtgtggggaattaaggaattaaggaggggtaaggaagaagcgttggtcaactggaagcaggtgatcaggcaatcatgatagatgaggtctctgctgccttaattgtctgcatatggtgatcttgttagttcagtcccttgatactgtctgggaggcctgagagtcagtttcctgaggaaggaactcagataaggcaaatgtaagtttcaaactttaaactaggaggatcaatttctacgtgtgtgtgtgtgtgtgtgtgtgtgtgtgtgtgtgtgtgtgtttccataaacatcagttctatgggacccttgggctggttccattaagaaagctagttttcctggtgctacgtgaagtagggagagaggagtagagcgtgggacaagtgagtaagagaagtgaggcagatcaggtagggccaagcagaagtacatggtgagacttctgataatgttctgtgtgaaatcagagccgttgtagcctttgaactgaggaggtccatcatctgattaatgtttcctctggctctgtgttggaattaaacggtacattggcaaaggcgaaagcagggagaccaattaggaaggttctccagtagttaattgagagattatggagtcttggactatcatggcagcagtgaaagtgatgagaatgggtaaaatactgagtatgttttgaaagtagagttgacatgttttctgctggtttagctataaaatgacacagaggagtcagaatagttccagaggttgtgttcttggcaatggaaaaatgtcatttactgtaaaaggaaaagactgctagtgtaacaggttttaggaagataaccaaattatatggtatgtttgaaagtcatttttaatccctgggcttgggtgaggaaatgaagaagtgtacataaacaaaacagaaataatgtgttgattcacttcaacatcaagaggtatgcatatcagcaagtaaaagcacttttccccccactcccactctcctacactcttattctctgcaacatgtccttgttttgttttcttagttgttcttatttctacctgaaaataccttattttttagactcactttatatcatctttttgcctccactggaatgtaagctttatgaaaacaggaacatgttctatcttttcatagaacctgactactggcaagtcctccaaaacacttttcaaatggattacttaattttccaacctatttttggttttaacaggaaaaacatttcaagctgcagaacaattacgaacagaaaaataataattagcatttattgaacgtcaagcacagttcttagtctttacatgtaataaatctaagccacagaacaaccctgattggttagcattatcattatcctgattttacggatgggagaattttacagatgggatcataggaatactaaataccttgccaaagtttatgtgaagaatggtcagagaattgaaattataaaccaaatcagtgtccttttggcattcaagtgagtgtccttttaccatcatgttgataattctcaatgaaaagaaatgataatgatggggtcaataaaagcgtgacatctacgaggtttggagattttcatgggctgactcagttaagggaaggtgtgttgtcagctaagaaaaagaaagaagcattaccatccagagtaactctagtattctgggaatatatattatacaggcaagaagttaattaaacctcccaccaaaatacccagggacaaaagaaagaaaataaggaagagtgagccaacatatttaaatacacttaatttagtattacattttttagaagaaaattttaacaaaaatcactgaggtcaacactcttatctacagatagagaaattgtggaaattagttcatgttacacaagtagatattgacccaaataagtgctgaattttacctcaactctcccttcttcccactcaagattctcccgtggtatgacattgaccttgtgttttctttagaagtagaagaaaacacatcaactgtccatcttttattttttctgacagctaaaaatatgtctgtatgtgttaatataagtcagattactgtttcagctacatagggttatgcctacctgacaggaaaacataccagaatttattttttttggaataaaaaaactagaaaataacctaatatgtgcatgctttctgataaaagatgattactcatcatcttttgtaagattctacaaaagaatgcaattacaaatttaaaaaaaacacctggtgaatgcttgcatataatagttaccatcatgcaaaacaatgtcacgtagtcaatgttggatattcaggctagagtacatatgaatttttaaagtacagtgctctctgtgagcaaaccatctttctaaatggatgtgtcacaccattacttggtaggacatgaatgattatagccttaaactggtaatatgccttcctgacacaaatatagagctatgatgctgtataatgttgacatttatagccacttctatagacttcacctcaaatctttgagtggatacagaatgtactgtatatctattttaaggtgcctgtatgtggacaagcacagcaaccattaagtgattaaaagtgttataggcttgagtattctattactgcatggttttcaggagccaatagagataccgacttgaaccaatacttctatgtgagtggaaaagggttgctatcacccagtaatgttctcagatgaaaaatccaagtaaatattcccatcattagtttcatagtaaatactgtttgtgtgagcctttgaacattattaggcatattaaactcaaaagcaccataatggttgcataaatgatattgcatttcttcagtgttacaagaaaaggaggcattgtggttgagaaaatggtcaggtaattaaagtgtaagcttaaaaatagaaagcatgtttatttaacctgagattgattaaaatgcttctaaacagttttaaaagttctttggccttaataaagaattctgaagatactttcaattcatatggataacaaaatatcatttatgtatacattaaatatactttgacaattaccatcgtaacagcttatattaacatggcacctactatgtgtcaaatttctatgtctttacctatactaatccaggtagtcgtcagaagaaccctatgaggtaaacactgttacctggattttacaagctaaggaactacaacagagagataagtgggcatgctcatggtcacagagctagaaagcaatctctatctaccattggtgataactgaaacgtacaggacttaacttttctgtatctgatttccttcagcgtggaggatctcagctagcagagagaagctgaggcttggttctgccttttactctttattcccactgacagtacaggatgctcattaagttgccttatggctggctaaatttgatattaaagttggtactcaacattggtactaaaaattaatggtttcagaattaactcctgggggtgttctatgaaaatgaaaaaaaattatatgtagtatattaaagtaattcatcctgtataatgggatcctggagtagacaggctgtgctaagcacatttatctgagagccttgagccaactgttaaatttctgtatctgaggtatatataatatctttatatatatcctgtctgtacacacatatattaataggtactgtattgttagaaattaaaattttatctaattttataagttcttcccagtgacaggtaataactcagaggttcaatatgtgcgtgcgtgtgtgcatgtgttcatgcaaggggtgacagagagagttgagactcacagagacacgcacaacaggaaagaaatgtgtggaggagctaaaaggctgcgattcctaccccttgccactctgccattcttcctttgtttccactcaggtttgattaatagaaagtggatccctttatactgcattttagtcagaggcctttctgttgagtgaagccattgtgggtaaagtttaggtttctgggttgtgaacatcaaagaaagcacagcctcagaggtacctaatgtaacagaccatgctgttttgccttcagtttaggatttatcctctgaatactcacctgtgttttatcaaagataatgtcaaataatacaaactgtgaggctgccaacagcttcttgttggacggttcttctgttgtggttctaagagttcctttctggaggttttatcaccttttcttcttatcattctaactacacacttctctctgaggttttatataagtgcagataagcaaaaattatatgttcctttacaaacgtatcaaagtaatggatgtttaattattttaaccaatttcatcatgaattcaataatcttttgagaatttctgccaaacttactctgatatattcctcgctcctctctgatgaatcaacgaatgaaaatactgttgaacatgtggtctcatcagaattgtgtggggaggaaaacatgcttttacacatgtagcatacatcatatggaaagaatgggtaccctctcctccaccaaaacacttgaaaacaatacaatagtaagttatgaaaaaggaattgtgacaagtgttaattaaaaattccttattaattattactttgtttttcatttttagcacaatttaaagctaagtgtcattatgtgtttggttaacagtaaaactgtatcttattgcaaaggaggttgaggcatatctataaataaggatcacaatctctagttaattttaggccctgattttcaaagctttagcactgctgatgaatttgtttttattgtcactgtgtgagttttcaggcacataaagttcagttaaagtcattgagcaggcagctctcttttgagcactcaactcttttttacagttgggtgtcttttataattgaaataaattattaaatccacaagccaagttgttagatgtaaggttattaatattttgtttgttatgtatttttaatgacagatttatttaagaaaagaacaatgaataccaagggtatattgagttgagtgacagatagctcggtttcttccctgccaggctcaaatcacttggatgactggattggtgccatttttctttatataccctttgtagtcagcataatgtttgactcatcactggaactctctaattaatgaatgaatgcagaaagggattcaggttcagttaaagcatttactcactctgtgaccttgagtaagtcactaaatctctttctcctctaatatcatcatatatattatggggttggtctagtttatctttggagttcctccaacttctcatgcagtttattggattttatgagtcagattatatatctaagaaataattatggaggctagaaaactactgtacatattttcatttttgtgttgtattatagagaaaaatgagtgtgtactatggtatgttatgcagtatacaaaattttcagtattttggatttcaaagtattatctagaaattatgtaatgtgacaaagaaaaagatagagacagatatatagagatatagataaagaacatttgcttatgttttaagaattaatggttggtttaggaaaaccttccataatcataaaaagatgaaaaaagataagagttatttacaggattcttgagtagtaaaatcaataagagagggcagatgtaagataacttatggtcaattgtaggcacttaaaactgaagacttactattaaattgctaactgagggccttgaagtgtgatgttgcatgagattgtgtgtaaggatcatttgctccactttatgagtctgtcactttaaagatcagaactgttaccctgtgatgctcacatttggtctggtttataggacatgtgccagctggctaggctaaatgaaaatgtctacttcttcaacaaacttgtaatctatgatccttactctacttttctaagaaagattactgtggatgtatggtagcatcaatgtctaggaaacagaggtgatgtacattacctggcaattaaattataataatataaagttgacaaattcacatgctccagtgcccaatgaaactttagtctctctgagaatagtaagaccaattattctatagttctaagaaaaatggaacaaagacactataattccttccagaaatctctgtagtaaagataaagatcattttactggaaagtaaggagggataattcacttataagaattacagttagcgccctgtatccatgggttctgcatccacagattcaaccaaccatgaatcaaaaaagatttttaaaaagaacaacagtaataatacagcaataaaaataacacaaattttaatatacagtataactactatttccatatcatttacattgtattaggtattttaagcaatctagagatgatttaaagtatacaagagaatgtgcggaggttgtatgcaaatactatggcattttatataagggactggacatccacgaattttggcatccacaggggtcctggaacgagttccctgtggaacccatcccttgcggatgactataatttagtaaaacttttacatggaatgtagaaagcatacctttattgaataaaatgccctccttgaaaagactttattaatccaaattttgattttccaatttgtaaatatgtaaagaataaaattcttaactctatttgatctatagaaagcattagcatatcaattcagaaccctatcttccccagtaaactctgcaaatcccccaatatttcatttattcgtttaactttgttcttttcctcttacacacacacatagaaaatgactactgaagtttattacaaatttcaaaagtctttgatttgtgtacatatttatgcacaaggccttatttataaaggtatgtttcatttcttttggataattatggaagactgggctggctaaatcatgtgacttttacacttctaacaaaatgtcgacatgttttccatagcatttgaaacattttgtatctctgcctgctgtgtatgagaactctagtttctttatatcttcaccacccctttgtattgtcagtctttttaattttttgccattctgataggtatgtaatggtatcccattgtggctttaatttgcatttccataaagctaatgatgttgagtgtcatttcgtgtgcttatattccatatgcatattttctttggtgaagagtctatttaaaggttttgtcctttttgagcggggagattatttttttaaactatggaattttgaaagttctttgtattttctaaacacaagtactttatcagattataaatcaaatgatttataaatacttttttcccagtctgtattttgcttttcattctcatattagaatcttttgaaaagcagaattttgaatgttgatgaggtccaacttatcaatttaacaaaaattattgtgcttttgctgttatacctttgcctattcaaagagtcggggaactttcttttaaggggccagataataaatagtttagactttgtgctccatacaccctctgtgatatagtttgtatctgtgtccccactcaaatctcatctcaaatcgtaatccccatgtgtcaggggacgaacttggtgggaggtgattgggtcatggggacaatttccccatgcgtttctcatgataatgagtgagttctcataagatctgatgatttaaaagagtgtggcacttccctccttgctctttctctcttttctgctgccatataagatgtgccttgcttttccttcgtctactgccacgattgtaagtttcctgaggcctccccagccttgtggaaatgtgagtcagttaaacctcttttctttataaattacccagtcttaggtagttctttatagcagtgtgaaaacagactaataccgtctgcctcaactaatcatctctgtagttgtagtgtgaaagcaatcacaaaaatatatttaaatgaatgagtatggctatgttctaataattaaaatttgaattttacataattttcatgtaatgaagtagtatactttttccattccactaatcacttaaagatctaaaaaaagattcttagttcatacataatagaaatacaggtagagggtaagatttgtcccattggccatgggtaggttgccaacttttctcctaacccaaagtgacaatgattttgtcttatgttttcttctacaaattttatagttttaggttttaacattgtctataatttatttttattaattttgttatgtgttccaaagtacgagtcttagttcatttttgcaaatgactatctaattgtttcaataccatctgttgaaataaccatcctttctctattaaattacctttgcacttttggagaaaatcatttgttcaaatattctcccccaataccattgagaattacagttaaaaatgcattactaaattgaagtagcccaatgctcttcacattttaaaatgctttttctctgtgttcttcatttttggtagtttcatttattccttgaactttgttcttttcctcttacacacacacacagaagatgactactgaagtttattataataatacacatagatgattgctatcctttctcaagctcatgaaaattttcctgtataatatttaatctgccaccatccaattcaatgtatttttcatatcaggcattttagtttttatctctagttttatttgggcctcctaaaatatattccttatttgtatttcagtatttggacatatagagcacagttatattcactgttctatgtccatgcctactaatgctaacatctatggcagttctgagttgattttgactgattggtttctctctctattatgagttgtatttccttgcatgccatgtaattatttttttggctgccaaacattgtgaattttatcttttgcatgcttcatatttttgtattcttattaatattcttgaacttttctatgggacacagttaaattattgaaaaacagtttgatccttgtgagttctgttttttacatttgttacatggattcagagaagtgtttaatcaaggtctgatcattcctcactcacacttgtatgtatacacataccttggaaatattgtggatttattccagactatagcaataaagctaatatagcaataaaatgagtcacacaaatgttttgctctcccagtgcatatgaaggttatgtttactctctaccatagtctattaagtgtgcaatagtggtatgtctaaaaaacagtgtacataccttagttaaaaatactttattactaaaaaatgctgatgatcatctcagccttagtgagttataatctttttgttcgtggaggatcttgcctcaatgttgatggctgctgactgatcaggatggtggttgctgaagggtggcacccttcagctgtggcaatttctcaaaagacaataaggttcactgcatctttcacgaaagatttctctgtagcatataatgccatttaacaacattttctccaccatagaacttctttcaaaattgtggtgaattctctcaaaccctgcttctggtttatcaactaagtttgtgtaatattctaaatcctttgttattatttcctttttttcctatattttgagacagactctctctttctctgtcactcaggttggagtgccgtggtgcaatctcagctcgctgcaacctctgccaccgggttcaagagattctcatgcctcagcctgtcaagtagctgggattgtaggcatgcaccaccacacccggctaatttttgtatttttagtagagatgagtttccctatgttggccaggctggtctcgaactcccaacctcaggtgatctgcctgcctctgcctcccaaagtgctgggattacaggcatgacccaccacacccgacctctttgttgtcatttcaacaacattcatagcatgttcaccaggagtagatttcatctcaaggaataatgttctttgctcatccataagaagcaactcctcatccactgaagttttatcataagattgtagcacttcagacacacattcatgctccacttcaaattctagttctgttgccatttccacaacataggcagttagttcttcctctgaagtcttaaatccctctatgtcatccataaggattggaatcaacttcttccaaactcttgttactgatgatattttgacatcttctcctgaatcacaaatgtttttaagggaatctagaatggtgaattttttccagaaggttttcccttttctttagccagatttgtcagaggaatcactatttatagcatctatagccttacaaaatatatttcttagacaataagacaggaaagtcaaaattactccttgattcatgggcttcagaatgaatgttatgttaacacgcatggaaaatctttgtatgtacatcttcctcagagttcttgggtgactaggtgcattgtcaatgagaagtaatattctgaaagaaatctttttttgagcaataggtctcaatagtgggcttgaaatattaagtaacccatgctgtaaacagatgtgctgtcatccaggctttgttgttccatttgtagagcacaggcagagtatatttagcaaaattattaagggcccttggattttcagaatggcaaatgtgtgttggtttcagcttaaagtcaccagctgttgcattagcttctactaagggagtcagcctgccctttgaaacttcaaagctaggtattgacttctcctctttagctgtgaaagtctcagatggtattttcttcaaatataagactattttgtctacattgaaaatttcttgttacgtgtagccatctttatcaattatcttagctagatctcctggataacttgcttcagtttttctatcatcagtacttgctgcttcaccttgcagttttatattatgcagatagcttctttctttaagtgtcatgaaccaacctctgctagctgtcaacatttcttctgcagctttctcacttctccaactttcatagaattgaagaatgttaggacactgctcaggattgggctttggctaaaaagaatgttgtgaatggtttgatcttctctgcagaccactacaacttctttcatatcagcaataaggttgttttatttttctatcattagtttgttcaatagattagtaccttcaatttccttcaagaactccttttcattcacaacttggctgtttgtcattaagaggcctatcttttagcttctgtgggcttttacactcttcctcactgagcttaatcattctagtttttgatttaaagtaagaggcatgcaatactttctttcacttgaacacttacaggccattgcagggttatgaattgggttaatttcaataatgtgtctcaggggatagggaggccagaggagaagcagagagataggaatactgctagtgaatggagcagacaatatttatcaattaaggttgccatcttttatgggcatggttcatgctatcccaaaacaattacaaaaaggaacatcaaagatctcggatcatagatcaccataaaaggtataatagtaatgaaatcatttataatattgtgagaattaccaaaatgtgacacagaaacatgaagtgagcagatgctgttggaaaaagtggtgcagataggcttatttgatgcaaggttgccacaaacctttggtttgcaaaaaactcagtatctgtacaataagctaagcacaataaaatgaaatatgttggccaggcatggtggctcacgcctgtaatcccagcactttgggaggccgaggtgggcagatcacttgaggtcaggggtttgagaccagcctggccaacatggcaaaaccccgtctctactaaaaatacagaaactagctgggcatgatggtgcatgcctgtaatcccggctactcaggaggttgaggcaagaggatcacttgaacctgggaggcggaggttgcagtgagatgagatcatgccactgtactccagcctggacaacaaagcaagacttcctctcaaaaaacaaaacaaacaaacaaacaaaaacatccacctaacgccccatgaatcttgaggttttctaatttggctggtgggaacaagcatttttccatgtcatgtgcgagcaccaaatcccatgcctctactacatttggatagttctttccctgacctcaggagatttggtcacacatgggttgattggcactctgctaaaaactgaaggggaacttttgcaaatggcctttctctctctctgtgcagctttcttctccctggtgttctctgcaaaaaaactctagtcatcttggtctccctggactttcatcttcatttcctaaaacccaagaattttctgagctctactttggttttctgtcctcctgtttcagcctagaaattcttacagcagtaaaatattgcaccatagggtcatccatttcccttttgttaaggatctctgttctttgttgcctgatatccagtgacttgaaaactgttgttttagatggagtttttatttcattttgtttcttattttttgttttggttgtttcttgtgagatggtaaattcagtctctgttactttttcctgaccaggattcaaggattaagttttgttatgtattaattcaattaaaggtattttttgtgtttttaaaaattatacattggagatgccaagacataaaatcctataaaatagttaagtgtgctgaaaattattttaacatggagtacatatatgggatatgtaaattaaatattataaaacaggttaaagtaatatatgattaactgtcaaattaaagatggtaaggaaaagaactcaaaataagaataatttattgataattatatgtttagagaccccttcatgggtctctactatcatcatgaagatgataatacaggaaaactcttgatagctggtatggaatattttcataaagtccttttatgcaggtaaatgacattatataaagatgtgttgtacaaaatgattaatgaagagattattttatgtcagaggacaataaaggattaaatgtttgaagacatatgtaaatatcagattttagaaactttaagtttgtctttttatataaaggcaatagtaaaccattaaaatttttggcattcatttgtaataagatggtgaatgccactttgaacaagaataatcaggaggaagtgacaaggaagcaaatactagacagactagaaagaaaactattatacttaatcaaggtggattaaatcattgtaacaaagatgaaaagaaaagacagagcagcattacattatataaatttccagtagttggtgactaattatatgcaagaatgagaatatgggaaatttttaagatgaatgaaattttaatagaaagagcataatgaaactatcaacagaaaaatgtaacatccatagcctataaaactaaaataaaagaacccaggaaaaagtaacggcatcatcataaaatataaaaaataaaaaaattatgaagtgtgcaataagtgccagcactattaagtctttacatggaatacttcatttaatcactacagcattattatcagcttatgtgattgtctttctgtaatttaaaagtaagaaaataagtattctatccaagatgataggaagtgatgggggcaggatttgaatttcaatatatccaacttcagaatccagtctcttattacagataattactaaaacgttataggcatagttttaaagaaaatgtattgggcaggagtttgtctaacactgtatatgaaataggaaaatatagttgatttgtgtgatatccagccttaaggaaaatttttgatagccgtaagtaacgactactctcacagttctgcctatcaacaatctaagatagtattgcaatgttctacatatttaagtgtcgattatattaatttttcatttgggcataataatattattttattttatttatcatgatttggccactaagccaaataaacaacaacaaaagaatttaaaaatattaatgctagtacttaccaggacttgattcacagtacatttatgtcttcgataattgggattacttaactttctttattatttagctactcagtaaatctaattgacaagaaactactaaagtctcaaatctcataatgcattttctttacacaatggattattatttttttaatcaggaagatagtattactccagttatatttgttttctgtaataaaagagttatagttagtgtcactataaactactcttacagcctatttagaattgtcaaaatatcaaacttatatgtaaagttatatattaatatgtaaagtatatgtttcaaacttatatacgtaaagtttgatatattgacaatgctacacacacagagacatacaacacacagacattcacaacacagacatacaaataaacacacaaacacacacacaaactaataagcagagagaaaatggggggactgaattacttagtacatgctatgttacagacaccatgctaaacatttttatttagattatctcatttattactttaaacaattatctttattgtctgaaatctgcccaatgttactcaggtaataagctttggagccagatttcagcctttgatgtctgacttcagagttcaagttcttaaccacaatgtcatacggctctgtactccaagatatactgagtcactatagtgtctgccatttattttaataaaggatatcctgtgtggtgaggccaatttttaaaaagggaacctctcaaataaaatgcacgcctgtttctccttaccatacagccatacctgttctctagagatctctgagtttctctttcctcaccttcatttctgagttacctgatttgtgagacatggttataaagcaaggtagctgatgtttccatgaaagtaccacagatgtcttcagcacttttgtctccctgaccactctaaattaaatgcaatagcaacaaattctgatttttgcttaaggtgatttcacttttcatagtgcttgtcaatgatctagagtcaaacctggtggctaaaagaaatgaccaaataagaaataccatttagggttaaaaatacatgagtcatggattttaagcaccaaggaagtattctcatgtggctcataaaatgtctctcatggcgatgcagaaaagaattttcaaaaatattttgagtgtagcaacattgtaggacgaatgtacagccttctcaatctttcattttaaagctgccacaataatttggatttatatataatgggaaaatttttgagaggaaaagctgataatgtcactttttagtaataaaatatatgtctactcctaaaagagagggcattttgtgagctcactctgagactaaacagagactagtacattactagacacagggggttaataaatgtctttcagtaataaaattggatttcatattaattgaactgaatcacatgacccctcaatttacatatttaagtattttcactcctcatgttggtggatgtttatgatgatttcagcaactattttcacagaataattttagttatctaaatcttaaatataaaatgttaggtcactggaaagtagtgtaaattgagagttaagcatacaatatcagaggatacttatttggagttgcaatcctgacctctttcacaaaattgcatgaatggaaatgtattctaattttttattctctaggaagctccacagaatagaacctgccattaaatgatagtccggaatattatgatatgggtgttgataaactctgtaaaagtcagtggatgatgtttaagaaaaaatggcagggacataggaaactgaaaccaatgtgatatggctattttttgaatactaaccttttaaactttgagtgtactcaagtaaagaagggaaaataaaataaaatgtggctacctcactgccttagaaaagttataaattcttcataccacggaaggaatcttgtcctatgcggacaatttatttcatggataaataaataaaataatgttttaaaatgtaaaacaaatttttatgttagaggatggcatagtgtcatcttaataattttatgtttaaatctatgaaattcaaaaaaagttgtcatctgtcattgaaatagcaacctccttcatattctaaaggcaatcatattcatattgtatcataattttacatttttagtagtaactaagatctatttatatggtgacatggttttccctacttacagttcctttcccttcattcataacctttttttgtgtgttttatacagtctgtctttatactttattctggttgatataaaagaccaaaaggtgttctaacattcaacttgctctgtgggaggtagaaaattcttttattttctatccatttgaggagtttgactctatcctaagtcagtagaagctgagagtaaggaactgaggaggtggaaatgattacagaattacagtcaggggcaaagtggtgaaagatattgtatgtgaatgaagaataccatatggtattgatttcatttgtatgtcatgactgcttatttttctaatacccttctctccacatgttttaagatatctttaaaaaatcttcaaaatgtctatattttctgaatttagaatccatagaatccttgcttgctaatactcttctaaagtttagctctatacaattgttattttatgtctcaagttctgaataacactagcattataaaacatcagtattatatggtccagtagcaatattcatttattgtattacaggattatgcatagtaacatagtaacacttgaacttattctttttttattttatttaatttttttgagacagggtctcactctgttgcccaggctggagtagagtggcataatcagggctcacagcaaccttgacgccctgagctcaagtgatccttctacttcagcttcccgggtacctgggattactggtatctgctaccacccctggctaagttttttctatttttttgtagagacagggtttcaccatgttgcccatgttggtcttgagctcctaggctcaagcagtccacccaccttggcctcccaatgtgctgggattacagacttgagctactgcacccagcctcttggctttagtttaaactgtatttcttgcgttttaaaataattttaattgatggtatttgccctccatactccttattgctttttctatttgctatttccataattattattttctgtctattgttcactgtcttcttcaaaagcttctatcccagcaccagttataaatataaatattatttatatattttctctttaattcaaaagaaagatcttaaaatgcaaaacctgatatctataaaaaggcaaaaaaaaaaaagaagaggaagaaaataaaggaggaaggaggatataaaatgagggaagaagagaaaaggaagggatagattattaaattagaataggttgtcacatatagttttattattcctacacatgagtcaaaaagatcgatttcttatacaaaaatatgaaagaggcaatttagtccacattaaaaaattgatttttttctatatcaattatccaggagcattttaaagaaataaccatgtcatgctgctttgattagtctctacaacatatttagaattttttaaaataaagcaactattttttatgacatgaagaaatggaattctcacaccagaaagaaagcaagtgactttagtacagagaacttcctccatacatacaaatagttcagatgactctttgtgcacctctgtgtttttatgtccaaagtgactaaggggagtttaaactggctatcccttcatgtatttctgccaaataatagtatgagctcattctgtgtgggttttgaaccagacttacttttcttttccttgctgattttcaaactattgaacatctttagaccattttcttctacactggcaaactgttgaaatctgtaactaagagaactcttagtctctgttgtatccccagcccccacttcgctactcacttggtgtggaaatttaaaggtccttgaatctttggaaccaactgtggttttccctccaacttttatcaccagcactttcaccagacagcatttcagcaacaaactccccacttcttttctagtccagtatgaactgtatttcagcctcgatttcagccattcttaccctctaccatttattcccaacgtagacatggtgatattatttgttaaaattagtcaattgttgtttctctccacttccctccaatggttttcccatttattcagaattaaagccaaaatccttacaggactttgactaccatatacaatttgacttttgagactcgttactcaccccatcagtcctaccactcgaggcacactagaccccttgatgttcctcaaatatatcctcacctttgggatttgccctggctgttcactaggccaggaacagtcttttccaggtgtctgtatgactaatatcctcagctcccttaaatgtttgatcagatcagtggtgagctgacttttattcaaaatattccattcacatatcccttctttatcttcccagtgtatttttcatttttcatgttaattattatatcatacaaacaatgtaatatgcatatttattatgttcatgatagtttgtctatttccttttcctctctcccttttcctgttttctgctcactgcatactacaacataaactccaaaagggagaggttctttcttctacttactgattaatcctaagcaccttgaaaagatcatggaccacaattgccattcaatacatatttaaggaatttataaatgcaagtatttccagaggtgtcattaggttaataagcattttattttgatgttggccttctttagccatgcaattaaaagattgttcatttcatggattatttttcaattttatttctgattatttaagactgtgttggcatagcaatttttatgtgatccatgaatatctcctgcattcggaattgttcctattgttaaggaattctccatagatacttgcaatactttccatattctcacaagttttttctttttgttttttaacctctttctattaaaatcatcttcctattctgaatacatatttcagtcttatagttttatacttttcaacatgatgagttatttatcatagcaaataaaaattatcatttaatgaaaaatgtaacggccaagaaaaatattattttgcatggcaaatcatgccatctgttagcaaaatacagaattgacaagctttcactctagttttattctgtgaagacttgcacatttaaagtttacaaatacaggcacttttttgcatccacctgtaaggtagaagaagttacattggattgatatttagaaaatcttaaattaaagttgcttagtgttactatattcttattatgtaatatgaatatgtcatacctccaaaaggtattctttaatatctcctttacctctaaaattcagtcattctatatttgggtttcttgattgtaaggggaaaaaacctataatatgttttctgaactagtgtgtgccaccaattttagtgttgaccccattaaccccttggctgcttccactttcacattatcgctttcccatgtttgactccagtctcccgactatgtgcgttcaaccagactacttggccctattttataatacagagaataaaattttgtgttaatcaacttccttgaatgttttccttatttttctaacatgttatcgatgaaacaccagcttaaatatcataccgaagtaatttttatggaaagttctatttcctagagtaggagaagtaaacagaaaagaaaaggactacatattatgtgcaatgatcataaatggagtcaataggtaagccttcccagatgtggctataaacgtctcatcgtcattgtcgtcatcatcatcatcattactgtccttatcattgccagtgctttctgattgcttactacattccaggcactgttctcagtaccttaaatttaataatgattagtttctaccacggtggtactggggagttaatatttcagtccattacacaaaagataaacctgaggcacaaagagattaggtaatttttgaaaacgtatatagcttgtaaataataacaccagaattctaactgaagtgtctggcttgaagcccatgttcttaattactacgcccatttttatttcatcttagagcaggaaatttaagtcacctcaagacaagataattaactctattgaaatcatcatgaaagaccaaagtagaaagcattagatgatgctatgaatattctgtggctacagtagaattaatgttaacagtggctttcagaaaatttaattttctattttaaccatcttaacaaactttctctaaaagtattaaaataaaattttgaataacaagttatagttgaatgtggcccaaccttctagaaacaaaggaatgggctgtacaatggcagtaaaattaatgatagaaatctcagctctgatacattaccagactctctggcttctccaggctggcttacctaagctcagtctagccatccattcatagcaaattgtgaataatgctgagaaaagccctgtggatttggatctgtttggtcagaaccgtgctgtggtttggctagcttgaaagcaaagagcagaattctgtctttcaatacttgtgaagtggatacttgccaactatgaagttggtccttcgaattggatataattctttgtagatgaagcacctttcatggtttctttggttagggataaagaaaaatgtctcagaattgaaaacacacattaacatagttctctgttattctcacatttcaaaaatcagacataaaattatcaaatttaaaagaacactaatttgacattaaaacatagatgaatatatgcataatgatataagttattactttttgctaggtttcaggaagtttgataaattcctattcctcatgtgcattgactatggtataggttttcaaagctagttctctaaaacaaaaatgttgaaaataaaatctagcataaccatggaaaccaagaaagcctaaaattgtcttgaatgttttcaagaaggaaacataaacttctttgtagccagcatccataactagttttggggaagccttaagattttcaagcgcagagtcttggctaaaaggattgagttgctaaacctaataaggaccaaataaatcaaaacccatgaaataaattaataaaaaaagacgaagtctgaagaaatacaaagtttaaaggcttaattattcagctggtagcattattcaactggttaagtgtgtggaaaaagtcaagaggctaaccacatacaaatattgtctaaatggtatatatatggttaccagaatagtaacagtgctaatgtttgttggattaggatcatctctctctcattttataatttgagacaaggtctctgctgctcaggctgaagtgcagtggcgcaatcacagctcactgcagcctcaacatcccaggcttctacctccacctcccaagtagctgggacagcaggcatgcaccaccatacctggctaatttttgtatttttttgcagagacagggtctgttcatgttgcccaggttggtcttgaactcctgggctcgaatgatctgcccacctgggcctcccaaagtgcttggattacagacatgagtcactgttccaggcctagatcatctcttttggattgtttaccttttttccatgtacttccaaagtttggtttaatatggtaagtttaaccatataagtggaataaaatgtagctgacagttgtgatttacgatagcatctagaaattattgctattgaaaattgactctttagagtgtaatcattaaacgcatagtgattgcctgaatcatctaatgaggtcttggtgattttttaatgttctttgccaattaagcaaccattaagtaatggttgagtgtgcattatatacttggctttgtgataagttgtgtgaaatatttaaaagaaggataaaatggtattaagtctcccttttcaaagaacaaactgtagaagagtacgaaaaaatcctacacatgaaaagtagtacataactgtgtataagtaaagctaagttgcatgatacaaacagtttgattatatgacattaattaatacatgtaaaataacacaaagataagagcaaaatagtttgagaagggttagcaaggtcaactgggaccatcagagatgaaaacataacaagaaattaaaaagggaagctggctataatagtgtgtgggtgggtggtagaggcaggagtgcaagaagaacatcaggaaccctggcataggaagcagctgattatgctgaagtgacggttatgctaagaattctgcttgcacaagttaggtagaaacaactaaaaaggggacacattatttatggactacagccaagggaatttttttttttttttagttttccaataatttgcaactacagattttgagtagagaaatgacattcaactcagcaaacattataaatcctcacctgggttatagttggttatagtcagtataagtggggtgttgagattttgaaatagtggaaaggtttgtgtaaaggaatctgggaataacaattttaatgaaactcggtaatcttttgtagataacattgaattaacgaagaagattcatactgaatgcatatataaaatggattagatgacaaaggcaatggattcaggaagatattcagtcttttcttagactacttttccattatgattgatcacttcttcctaactacagcatctgggaggcaaacagaggaagattctgagaagtgttctagaagttggacagtaaaatgagagagtggtgtcttagaagccaggattaggaaagctttaaagatgaagaaagtagtgaaagtatcaaatgttgcacagcagatcaagtaggctgagtgaagaaaaagagcctttggatttagcaactgggagattatttttgacagtatccaaatggtttcattgaattggtaggagttagagaatgaatgggtataagaaagtagaaagagaaagaataggatactctttccacaaatattttcaagacgaaaacttaattgttacatcagcattttgatacggagaaggggaataggagagaatattgttttgtttgcttcgtttaggaaagttgtatcttgagcctatttagaaacctctggaaaagagattaacaaatgtgagagacatcaccttttatggtgtctaacatgtgagaagtagagagggtatgggagagggaaggaataattctgagttttagcctctcaaagtcatgagatgttctattatttctgccttgcactttcaacttcctgccatgtacccacacaggcacacacgctcacatctaacagtacttttactagcctatcccatattggggcaccagagcactaagcgtagctagattaatctactttactgttgttattattattctaattcatttatttgataggcttcaaatagaaatatttttggtttcaggccaaacctatgttccctaggtcaatagtaatatgtcgaatttctaaacattcaagaaaaaaatgtttttagtaaataattaaatacaaatttaaagaagaccttaagagatctttgggcccattccttctttcttctcttttcacaataaaatgccaccccccaccccccacacacaaacattccatttcataatgccattctcatatcctgtggtttttattactacaagttacaaatcttgtgaattaaaacttggaagcaaactaaatgcatcacctcagaattaagattcttataccaagtcaggtctctgatggaaaactcacagggtgagctccacatgcctttaaactctctgttctctatagaaaacagtacaattgttaaaatgttcactgacttctctcagcagagtttttaatgagctggtacctgtatagccctttgagcagttcaggccagggttctttatatataaagcagacatataaaagtaaaaggcaagtgagtaaaaagcataatagtccatgtgagtactaattgtaagggataggaaaaagatacaatataatagctttaaaggaaaaatagaaattgaagaccttatcacaattatccttataatgcacagaataatgtcagactgctttggaaaattcattaattttttttaaagttagtattgatacgaatttttggggtatatcttctcaatgataagtaggttaactgaaaagcactttgatttaggagatgaagtctaatttaaattatgttaaccccttcctttcttattgtatacttagtttttacattttttcatagcctgggtcttacatcctccaaataccttacctattcacctctccaaaaaacagggacacagtctgttaagtaagtctaacagaatatagatattatatataccatgcaatttaatagatactctatatagatgtctatatagatattcataatatatattaattagaagtaaactcctaaaggtcaataaacaaagtgaattccctgataattcatcacctcatgacttgtcatctgtttaactataagagctagataatttaattggaatgcggatgttttatgacaaatatatgaagtatcagcaatagtaaaaaagcaaattttagtcttctgaagctgtcttagcctgtatttttttgaagcacagtgatttgttgcacagtctttgaagccaaaatgcctaggttcttatcctgactctgccatttcctaactagttactccacctttctgctatttggttttcttatctgtataatagtgttcatagtggtactgctataaaggtctgtaatgaagattaaataaaatgctggagcgatacctggcaaacagtaagcattttacaaatggttgcagttattatttaagaaattattttaaggacaaaaagtgtatacatatatgatgcccctccctatgttataaaattaaataaaatgcatttcagattatggattacaaagagaagaaatataaaatgaaagcatttaacgtcaacacatttccctttgttctcctaactatgaaacttgataaaagagtgctgacattttgaagaaatggactttttggtgaatattacaatttctttgttcttgcttttgacatttactatttcaaccaacaatctaagtgaaaccatgcaaactttggtgcctaaaatagggacaaaaggtggtggtgtgatttgagtaacagaggaggattttaaaattctgcattttgtttccatatatatcatgtacttagcctggaaagaaataaattataatcataattgagtcaagatattttcagaattttgagacatgctcaagtttaacattctctccagtgctagccaaaggacccaatggatttagaagattcatggtccaagccatcaactgtctcttaaaattcatgtttattattctggcttagtgaatagggattgtctttcttcagcaaatgccagctctggaattgtttattgagtgtctacatcattaaaacttccaagggactctttgacctcaagcgtatgtttccttggcacagacacttgtattttcaacacttcggagctggcaatataacttggaatattttgtatttaatgtctgaataatatcctgggatttgttgtccaatgtgaaatggccaagaatattgaagagtggctttgaggatgacacaagtaggtatgattttgttgaaaaggtgagaaaagaggggcacagaaaacaaaaacaaaatccttaaagaaaattaaataacaaataaaagacatagaggtagaagtatagaacctatatagtttatcaaatctttgcacctcagttttctatggtcagcacattactccctatgtatttcctggtttcacttctttcaggacttttggtcacatatatttataacctctgataataatataatcaaaatgtaatgtaaacaatattgctgaaggacttagtgcacttaaagattataataatgtttgtctttgatttttatttattaattccatgcatttcaagaaaactctgaagttggggaagacgttttttagagaaagcttaaaatgtgagagttcattcgcagttacgcaattctggttttttttttttgtagatttattaagattttctacatacacagtcatggtttatgaaataaagacagttttaattattcctttctgatcttatctttcttctttaaattgtgtgcattttgcctcagttttttccgtttttagcttgatatatttataagtattattttttcttattatattgatattttcattatacccgttatagtttcttttcttttcaatttttattttaagttcaaggatacatgtgcaggtttgttacataagtaaacttctatcatgggagtttgttgaacagattatttcatcacccaggtattaaccctaatatccattagttattttttctgatgccctccctcctcccacctaccatgctccagaaggccccagtgtgtgtggttcctcaccatgtgtccataccttctcatcattcagctcccacttataagtgagaatatgcggtgtttggttttctgttcctgtgttcgtttgctgaggataatggcttccagttccctccatgtccctgtaaaggacataatcttgttattttttatggctgcataatattccctggtatatatgtaccacatcttctttatctggtctgtaattaatgggcatttaggttgattccgggtctttgctattgtgaattgtgttgcagtgaacgtatgtgtgcatgtgtctttataataatattatttgtattcctttgggtatatacccagatattattattttccttgaatccgttttgtgcaataatagagttatgccaattattttattttacaatatgcatagtaatcttctttaatctttccactttcaaattatttttgtttctaaatttaaagtatctatcatttcttacagatagcatataattggatcttgatttttaaatttaatctgacaaattctgctatatgtttgaaaagtttcattccctcacatttaatttaaacagtacatttggctttaggtttgccatttgctatttgttttctgcttctctcaatgatgtttcgttcttctgtttttcctttaatcttttgtttttgttacactgttagtttaacaaaatgattagtaaatatgtaattttcaatcctccattgaccttcttgcattatctgttcatattttctctagtgatttcaatgtttatctgtaacttattacaatatacttcaagtgggcactaaattacttctggttaaatataggaaattttcataagtctatgtcctctgtaggttccatgctgttgtttccatatgtattatatcatatattttataaagccaaatatacagtcttatgtttactttaaagtagtcatgtgacttttaaacaatttgaaaagagatatattagtgaatggtaacaaaaagtgaataaaagcaaaaattatcacttccccattacacctgtcattccagcctctaagtactacatattgttgtttaaaactgtcagcagtaaaataaaaagaaatattctcttgttatcatggcaggtatatattttttataaagtaaactattcttttaagaatttaaaatttgatttttttagtgggaataacttagaagtaagttaattttaatattaatttgatgctgtatgtacacacacacatgaagaattaatgttgtgtaatacttttcatttgactaggcatctcaacatgcccttgtccatttggttatatttgaggtagctgctatcatggaatttttcacagaagtcaaatatgttttgagaggtcaatttcactatctcaaatcatatagtcaaatttcaaattttgtcaaatttagttgctatcttcaccataaaataatcagcacaaggtcaaattaatgtttgcccctatataaaagctacttttctattttctaaagtttctgatcagtattttaggttttgtttcttctcatagtgatgttagaggtatgtgactaacttttttatataaattatgaggatcacatgggggcaaataagatttttttttcaaacaaagatctttaatagtgtgggaatcaatgctaatgtgatacaaagcaatctatactgtattaatcaaagatccaaagcaccctgattataaagagtgaaagctcatgcaaataaattatgaaagaatacaaatgaagacacacttacatgactgcctcatttccagagcctggtgacagtcctgctgttctcagcatgctgcttcatgatgacctcatcagtaacataagatgcattcagctatctggcacctagatggcagcctacaaaatctaaacacagtgatttcaaatggaccataaagcctggctaaaatcttacaaattagtaatagaaatacctgttacatcatgacatcatttgggtacactcagcaaattattccctgatggaaattatttgaaaaaaatatatatgcagttatgcgttacttaacaacgggagtacattctaagaaatgcatccctgggtgattttgtcgttgtgcaaatatcatagaatgtacttacacaaacctagatagtatagcttaccacatactttggctttatggtgtagccttttgctcctaggctacaaatctgtacagcatgttatggcactgattagtgttaaggaaataataacacactggtattgtgtatctaaacatatctaaacatagaaaaggtatagtaaaaatatggcattataatcttatgggtccactgtcatgcacgctgtccatcattgactgaaacattgttatgtggtatgtgactgtatatattacatatatgtcatatatattttttatatatatggtttgtgtgtatacaatgtgtgtgaatgtgtgtatgcaaaatacttattccatttgttaaaatataatatcttataatgacagtgtatgcctacaaagatgaaggtgaatagaacagcagttaaggagcacggtttgtttctgaatcaactatagtatgtgatgagacgtggtgtaagtgctacagttcagagctcagggaacatgaacacttcagggcaccttcagggattaatgaaagctctttttgtcctgtggatgatagcgattcatacaaatgtgttaccattgatttggcttaaaaatcacatttaatcattttttaggagaatcttccctaaagctaaataaatatcactatcccttttgatttaggatgcttgaaatctgtgaagagaaatttcctttttaataaaaaaaaaaaaaaagcaatcttgtccacttaaccatctcagcttagcagttctgaaagggttctttttcttcaggcctcatgctggatttgccttgcagttagtttcatggagaaaaagcaacaatgctaaaattataggtgccagtaagtctaattgtgatagatgatgcatggtttcagaaaagggatttattcttatttcagaatgtcaaatttagttgacattattccttgagaatggaaagttaggacctggatcccctgaatcatctctaaagtattataagaaaaatctgttccctgaggtacttatcagtcaagggacagcctgagtgtggtgacccacatgtagagtcagggagaatggatgaatcataaaaaggtccacttgaaatgcctttttaaatacttaatataaatgtaaaaggcactccttgaaaaaataacgcaaaaaataagttgccataacccacagcttgcctgggacagaatatgaaaaagaaagcgttcatcagtgctgtttcaaatactatagctggcacgaaagtaggcacaggaggagaaaatcaccctgaattataaatgttgtgtgctattttcatggcaccaggtgggaatgttaacacttaatcagtctctctggcactatttcccatccatattgccagctttatcaccatgaaagatgctttgatcctcttctgtggtgtcaaaaacaacaggccacagcatcaatgacattccaatcagtggggcatcactgcgcattagtttctatcagatatgacgtttcactaacgcattttgacaacatctggtacaatacagaggtctttcagagtatacactgtatatatatgtgtgtgtgtgtgtgtgtgtgtgtgtaatatatatatatatatatatatatatatatatatagaaaagggtatatacctttttcctatgccctaaaaaggagattaatcacaaagcacttctcttttactgttgtagattttgaaagcaggaggaaaagttctcttttaaatatgctacagttttctctttggtgatacttaatgctctcttatggaaaatgaaattcttagatttctaacatactggagagttaccttatgttaaaacaatgcctttgaaaataggcattgttaagatttgcacggaagtatcagttgtgaaatataactgttgtgtaatggcaaaatctttcttttagtaagtacctcctttgtatcagacactttatgaatggtcatttcaatgttcacaaccactctttgagggagatatttttgtactcagtataaatatatgaaaataagttcagagaggctgaataacctttctaagatcacttagaaagtgtccaaactctgatgctccctgagatccaacttaccgtaccatatccatcctactgccactcaaggctgccctcctttttaaaatctacttaaccaaacgttaaattattctataattagacaaatagaaatttttggccataattaaaggaaaaatgttgcaacatgatatcaaatgatggttatagaaaatcagattaaaatagttcaaaacatctcaacaattagatttttctcttggtttgtcatttcttttattgtttactgataaactcactaggtttatcagctagcaggaagaaagacaacaggacttttcctattgatgtggagcagatgcaagatagatctggagcacaggaaaatttcagatctggatgtgtttaaatctggccctgcactgccaataggaagagcatgacattactggcaaatgggggtggagagggatatgtgtaaatagagggataaagcaaagtagcaaaatattataaaatgaactcacaacatactccctgattccattaaggccagtcttaatctctatctataccatgataagctgtatcttgccatatattgacctgaaaagttagacctatgatatattgtaggtaaaaaacaaataatcatttttgcagtataacatcaaagaaatgttaaaccttcctcatttcctgccccaaatgtacacattttaaaaagtaatgcaatatatttatattaatatattctatccattcaatatataaaagttagcctagacacttttatggaatatttttacaataaaaaagttagaaagagaacattttgtattagatcaaaaataattcaaagaaatgaggtaatgcattcttttgtatcacttctacataagcaatagtctttgaggtttctaagtggcttaaaaagagatttgataagttaaaatattgtcttttctcattttatagccagagaaaaatagtacttgtctggaatatatataatattgcacacggggttaattaggttaggaatgaattaatttgtaacaatttccgttatttgacaggcatcaataatatagcagcatattacatgcgttccagacatcagcatacttccatgacccagtcagattcaatttggaaaaaccttggatcatatgaatattttattattgatttttgtaacatcatattttacaatcagttctggtcataaaagaccataataacttgaagagatattttagaaagccatattgttgatgaatggaaagtatgctttctgcagtgaaaagaaaacttactgtctttttcctgagacaaaatgtcaaggtataatttgtactttattaacagctatcaaggaagttcattttctgagcaattttttcatcctttgatttgatattttgggtgtggggcatgggggtatgatgatagtttgtatttcttggttgtcctggctactttcaaattcttttcatttcagactattttctgttgaatgatttgacttctcctaaaaatctttccggtatcctggccctcaatcatttgcacataataatccaataaagtatcaaagtttgcagtaaatggtcagacggccggccagcttgatacagaaaggttatgttgatggtacccatgtttaaatgcatttcatttccaaacacatgcttacattcagcagaaacctaattgtagaacttttgcttatggagatgctaagcataatctattgaccacgtataaaaatacaataatgacatctctaaagaatggtagagtaaatcacaagacttgatattagttatgagttttcttatactgtctgtatttgaaaatgtgtaatacttgacacaaatactgtgttagttacatttaaacaattttgtgaaatcagaacacacacacatccttccccagaggagtgcaaatattgatgttctgtaggctcaaagaatgattgctcaaatccacatttccttggttttcttacttaccatatgttattcagaatattttgctcttagttatgcttttgatgaaatcattgatctctactatcagtattcaccatttgtcattttctgaatctccttgccagtatcacttatcttttctccaggttccaaaatgtaagcaattttctgatattctggtctaaatgccattttcttcttttactcctttcttttctactatagaacctaataacttctggggagaaagattgagagtaagagagaggagggagaagagaagtaggagcagagacttatatcatgccatgacatgtatactgagtattatcagtgcacaccaatgccccacacatgtatgcatgtatgtatgcatgaagtttatttgtgtcaatgaataataattaccaattttgtattaggcagtattaggatatccgatacacaaggatatataggacataattcttctcactgaatttacagtgtaatagggccaaagccccgaagagagctaatgacaatacactatactaaaatagaagcatgcacagatgttaatattacaaacaggagagctgcgtagtcaccagagagccagaaagagtggtgaaaaaactgaagctcatagaagctcagcacaatgactatacccatcaaaaccctatctagaggaagggccctctcttatggctcaatttattctgtcaggagagagccttttatcgtttgtgcaaaaactgggggcctcagatgacctaaactgatgccataaaatgttaaaatagctcctctctcttttaatttctaagctattatgtgaattccctataattaaaaattattagtggttttcagtagaggctcatggtgtaacagcttgatcttaatgtgctttctataactaatctggaaacttttaaaactcgtgggcttgtttttaataagtaatggtatatattttatataatgctatatacaataacagaacaaagtggtatttataaatgccttacaggtacctacaggcaaaacaagtatgtatttaagcatgagttttttcagaatgttcacaattctgagcacaagacaatttctgatattgaaaaaaatagcataattctaagaagaatgacttattctttagtcattgctagtcaaaactagtcttactagtaatatatagaagaaagatatacatacttgcaagaacaaagaattcaaaaagaaaataataaaataatgggggaaaccacatgtaagtgccagctcctacagttatcttccatgacacccaagcctttcacttcctctggtgcagcagcatttcagtggcctccagctgggtcagaatagtgttcatctcgtgctattctctagtgtcccaaaggtgtttaattttcaagttacagttgacacagaggaatagaattcagcaaatgcaagaggaacttgagataagaaactaaaggtgactacagggatattatcttcgctttaggggaaacatattctccaatgtaatcattgagccatcttgtgtcatcttctaatcctgggagatgagtgctaaatagatgaagaactctatttactctaggatatgagattttaaatgaaacaatcccatggactttttttttaagccatgaggctacatggcaagattttttaaatctttgtttacacttaattatatgcctatttaggatcttgattaacaaaaattagatattagattgccagcaatgaatgtagatgtaaaacaccacaaaaatatttgaaagtcttttataactcctgaaaaattgttactgaaatattcaaaatgttactattcaccaaaattaccctattcatgtgatgagtatgtaatgatctatctctctcagtagttgctgtgtattcctctgtaatgtgaaattgagaagattcctaagacagaatcaatatcatcttggctactgaaaagtcactcctgtgtgtatagtaggtgatagaggaagaaatgatgggctatgtatattttatgagagactgcctttttttttctctctctctataacaaagttcacaccactggcttgttgtatgacactgttcctggttttcagtatattcacacatgtatgcggagtaaaatatagtcaaaagtacatgcatcccttgttaaactgacccaggaacaatttgttagcttttttttaaggttctatgctgcgagcataatggaagcagcatgtgagttgaagaaggaaggtcttttggcaagtccttctccaccatccattggctttgagatctgggactagttcttaatgtaagacactagccagctaaacagtgccgatcagaagtaatatacagatctgctgcctcctagtctgaagctattccttttcctacatgaaaaatgccattcaataaggaagctgtgcctatatacttcaagctcatttaaaataacttctgctctaagaaatgttctgataccactccattaagtcagttctgaaataccttgggtacagcacttcctttaaatgtctgctattcctttagaagcaccacaatattctccttctcatttgctgattacttgtgagtctaagaaatgtttaacttattaccaagtgcgagcaaatagaaaaaggttggaaagaaactgaaaggagcatggcagagccttataaaccagtggggacaaaagagcatatttagaattataaataaaggtactgtatataaaattgaatcctaaaatatgaatttaataaatgccttaatagcaacagattgaatgttgtattacttttgaagaataacaagaaaaagaaaatttggttaaaataacattctataaatagcattaagcttcttgataaaaagtcatttacaaaactgagctgctgcttctagtatcatggtatttagatgtataaagatgttgtcttccattactttaattctataataccttatgcagcatggaaatgaattatcttatttctgagcttgcatttggtataaagttaactttagaagtttggtagaattgtgtgaattctggtacagattattcaaatgagtctacttcagtggaaaaatccatggaaaaatagtaactgcacacacacacaaacacacacacacacacagaggggggttggagagagagagagagagaaaacagtatatacttatcgcattcaagagagtttcctatttggcaccatggaattattcaagtatccattgagtctttggaaataatgctatgatcacctaaaagagcctgccaattattgccatatgtgaatgtggtttttataatctggatacttatgccctaggatttggactaatagctctaacctttgacttctcattaactgctagaaaaactatgagacagaggagacattggtcagtgtcaacatgatataaatttggacaagtggctgaaagttgagaggattagtatcaccttagcgatggtactgtacttactgagaaaaaagactgggaaaactaaagtatttgaaagtcatacatgtttggaaactatgtaaatgaaggctccttccaaaagtgaggacgagatgtagagggaaggcagccaggtttggaagtgtttgctagtgcatgtggcagcctaagaaataaaaatttataattgccagtattgggagtgggaagagtgtacctatataaaaaagcaaagcagctttgagctacaaagtcaaaggtaatcatttcaattacccctgaggagatccattcagctttggtgcttttaccagcaagtacaaagatttcagagcatggtaaacgtattagatatatgtgatcagatggcctggcatatacaccaagaaccaaaagcaaaaattgctttgacttgtctaatttgttaagttatctagacatagtttatctatggaaatctctaggctcataaagtagggtgtggcaaaggacttgccatatatctattaataacatacttggaaaagaaggtgctcttttgtgatatatctttgtgaattatatttaaaaagtataattttaacagaaaaggatgttggtataatattccaagaaaaagcaaatgtccaatacatctccaaaagtagaagactaagtaaaggcaaatgtggtttaatattgcttaaatatattgacacatctacctatgttgcagattttaaaaatgtttatacacaatatgtaagcatttatttatataaatgtgtgtcaatacttactaatttctaatatgctaatgtgtattagagaatatttatactcacatgtaattcctacaaaatcctattataaagttttcactatccccattttacagacaaactaaagcgtgaggaggctttgtaacttgttcagttacatatatagtaactggcagagccaagatttgaacctgagcattctgaacctgggctcttaacaattaaaatgtgcagatcaaaataatatctcctattgatttaccagcattgaggatgcactttaaattgttggtccaatagtcatgacatgatttttgttggtatgatcataattttttcttttctattttgttataaatagtatttattagccaacaacaacaaaaagcttatattggagttcttaaaacacaggctttctatttttgaagacaagtatctggttcataaagaaatcaaaaccagtattctggtttaataagtactatattctaagacaatgaatcgctcaactcagtaaagatagtttatttttcttacgtatcagtaacgtgaaagatttctccagcaatattttattgaattatttttacatagaaattatgtatttctagatcactttggcttctctagaaatccatatttttgctaaccaacttcatttagtgtcaataaacagaagcctatgtgacaaagaaaactaaatgtggcatttttcataacatgaaaatattggaatccatttttttttgcagtacaaatactataaataccacacgatttactacagcaaatgctaacttggcatttcctattggctaactcaatgtaacacatccaaattataactcctgtgcctttgctcatatagccattccttctgtaactcaaaaaataggaatagttcccaactgctcaatgtggaactttagatgtcagtctttttttttttttttttttttttaatttttgagacaacatctcactctgtcacccaggctggagtacagtgatgcaatcttggctcaccgcaacctccacttcccaggttgaagcgattctcatgcttcagcctcccaagtagctgggattacagatgtgtgcaaacatgccgtgctatttttttttgtatttttagtagagacgaggtttccccatgttggccaggctggtctcatcctcctgaactcaagtgatccacctgcctaggcctccaggcgctgtggctcacgcttgtgctgggattaaagacatgacccacagctcccagctagtttatttttttattttttttattttttattttttttaactagtttatccagatttattttttctacttctattgctatatcattggcaaaaattacatatatttaaggtatacaatgtgacaatttcttatacatacacactgtgaaatgattacaaaaacatatctatcactacacataattaccaacttttagatgtcatcctatttttttataatttcaagttttattttagattcagagcatacatgttcaggtttgttatatggctatattgtgtgatgctgagatttcggatatgaatgatcccatcaccaagatagtgagcataatacccacttaatttttaaacccttacccacctccctctttccttgccattggtccccaatgtctattgtagccatctttatatttgcgagtacccagtatttagctctcagttataagtgagaatgtgcactatttggttttctgttcctgcctaattcacttcgcataatggcctccagttgcatccatgttgctgcaaaggacatgatttccttctttcttatggttgcgtggtgtcccactgtgtatatgtactatattttatttatccaccactgatgggcacctcggttgattccatgtctttctatagagaatagtattgtgatgaacataagagttcatgtgtctttttggaagaatgatttattttatactctcttccactttgcactctgcatcatctaaaatcttcatatcatctacataatgtatctcaaataaatacatttctttctatgtccataatcacttctctacctatgtcttatgatttcttatttagattatttcagtagtttcccatctgttccattcttgactcagtttaatacattttcccgatagaagcaagcataatctctttgaaatgtaaatctgattatggtgtacctcatgcgtgaaacctttcaataacccctgataacacttaatgtagaaaaacaagccaccttaatataagcctgaagacatggcatggcctaattggcctgcatgtgccaccaaattaatctgaggccctcatatcatttcttttccagctatactctttttctttacctttcatttactctccagttctttcctgcctcaagacttttaccctagaattctctgccttctactttattttttccttttacatatcatgtgaatactgtagtactttgtacatatcacagaaaatgatagatctcttttaaaggttagacactgtacataccataaatattattcaactggaaattcacttactccatttcttttctatgccaacttaaatttttatttaataaaaaaagtttccttagtaaatgtaactcatattttcctttatttttgtgatattttctttaatataattaagatttatatacagttaagatattatacatattaagaatttttaaaaatgaaatctttaatataaccaaagattatattaaagaatacaaaattaaaatataattaaagattttgttttaaataaatgcttataggacactgggaagtcctttttttctggttttaaaatgtgattatgatgatcattaattatatatattattatatgttatgtacatattacatatattatacagagttgtcccttggtatcaatgaaggattggttccaggacccctgaggataccaaaatccatggatgctcaagtcccttgtatataatagtgttgtatttgcaaatagcctattgcatgcttccatatactttatctctagattacttgtaatacctaatacaatgtaaatgctaataagtggttgttatactatattatttagggaacaatggcaagaaaaagatctgtacatgttcaatacaagtacaaccatcttttttttgagacaagatcttgctctcttgcccaggctggagtgcagtaatgcaatcatgactcactgaagccttgagtcccctggtctcaggtggtcctcccacatcagcctcctgagtagctaggactacaggcaagtgccaccacaccctgctaatttttgtattttttgtagagatggggtttcaccatgttgcccaggctggtctggaactccagagctcaagagatccacctgtctcagcctcctaaagtgctaagatttcaggagtgagccactgcacctggcccttgactagccagttttttttttttaaattgatctgtggttgattgaatccatagatgcagaacccataaatacagaggccaactgcatttctgtatttagcacctaatgaaacacataaatatctttacaaatttgtccatcctctttctgtttttttaattcggaagcttcttgatggattcatagcatgagactgattatttaaagggaaattagacctactaagatatatgtgtttggttggaccaagtaattgggcataggacatgtgataatggagaattgctgtggagagatgaaagaggcctccattcttccctgaaagtttttcggttgccttatataagccagtcattctagtacatggtaagaaataaaggtaaataaaagaaagatgcccatgaagtgcacttaccttatctatcacactgcagtaacataataggagtggagttttaaacacatgtagaatgtgctttctacatgtgttttatgaaaacatgattatactgtcagtgtttagagtgacaagattgccttacaagatatatcaattttcaactgaatatagcacactgttttagaaagaagattttcaggtagttgaaatttttatctggcctgtaaacacacagatgatgaaatgttaaggcagttagaaatgactgctagaatatgagttcaaatgattttatagaatacttccatgaacttgcctagtcataaaaattttcttttcagatatatccccacactatgtatcatcaaataaactgtaagcgctaagaaaccaagacttactcagaaggaaagtggtacagactctatcatgtgttatactgagggcacgttaggtgtactattagatgtgtttttccagttctaattgacaaaagtgttattggtttgtaaatactttatttaattgtgccaaatgtataatcaaattggtaggtgcagttgggggacagtatggaaagtttttttaggcatcttttctgaagtgcatcaatatacccctgaaagtcttgagaactgtgctttttttttgtttgtttgttttgtttttctctgtattgctttcagatacatggtacggacacatagtagggcgttatatctgtaaatgccataaactgtttctgatcaaaactcaaagaacttgggaggctgaggcgcatggatcacttgaggtgagaaatttgagaccagcctggccaacatggtggaaccccatctccactaaaaatacaaaaataagctgcgcatggtggctgtcacctgtaatcccagctatttaggaggctgaggcaggagaatcacttaaacccgggaggcagaggttgcagtcagccgagatcatgccacggtactccagcctgggtgatagagtgggactccatctcaaaaaaagaaaaaaagaaaaaaacagaaaaaactcaaataatttatgcaatctcactttattactttattctgtcagacgttaagcacactccactaattttggaacataaaatgctttattttttccctctacccaataaagttccgtgtttcgactaataacatgtagtagacagtccattacatgggaagcaggcagatccccccacaaaataattcagcccacaaataccttttcagcaggtttgcataaattaagcattctctactcctaataaagtttctttgcatcagagccagtcacttgactagacctctaagatattgttgaagaaaactactgtgaaactaacagtcactggaaagagataaggtaatcaatttccctgtgtgccttggaagatgtctctatcttcatagtcacccttccattaaattggttacattatttttacagtgcaggattgcatgttaatgctacattagttgttcttttacagttttacatgaataagaagaaattggatgcaaacacagaatacctatgtcttggaagccctcaaacataagtttcatttctgtttacaacacttaaatcttgggataaacagccaatgcacttaatacctttaagccctaaccttctcctcaggaaaaagagataataccagtctcacataattgttatgaatatggaattaaaacacaggtgcaatgctaggcatggagtaggtttcagtaaatgctgctttttacattacctgtaggtatgaactgttctctccaggtacatcgttctggaaaaggtgatgtaaacattgtagttcaatgtgcctgggttttcaaaggcaacaaaatgtgtgccgctgtctaagatgtaacaatctcagggaactaactccctttcccaccctcttcccaatccctcacctttttaggtctcatttttttgcatgttataaaaaggacacaattatcctgaatgagtatctcaaggcaatcaatgaaattctaaaaagtaactccaaagggttaatggaatatgtaattatctctactaagaaatagggtgatggtttaaattcatatgtaaacatacacacataccctcggcgtgtccattttaacacacacaaacacaacaattctctctcctccttctccttcccactccccgctccgcccccaccatcctctccacacttctagggtagcaacactgaatacagatggccaagtctgaggttatgtgacatttccagataaagtgaacaaaaatggcagagattcttctattgttcttccttatggtccacattcctaatgtgtcccagttatttatactatgagtgttttatatttgccaactataagcaatccatcttaatatttccaatacgctattttctcatcttttctcccattcttcctgtcctctaaaaggacaggaagagagaatttcttcctcttaaatggatttaatcattgtattccttttattgcaattcatcttccaagttgaaagtaaagttttagcataacatagtgaagaaaaaaaatggttatctctatatttataaattaaccattttaaagaatgtaaacctgttatagtgcatcttgaagttttgggatattttattttcataacaccattaaatactactatatattgctgtggtatctgcccatgagattgttccatatgcttgagaagtttcttcccaccttcactgggagaggggaatatttttgtgtttctgacatacaaatgtcagtgaatatacaaatctgaaactttatagaggcaagtttttaaaaatatttttattcttagaaaaatattttttattaaataagatagaactcattttatgtgaaaatcaaatatataaatgtttctatacaattacaaatatttatgtctttatagtttcaaaaaagaggattcttttaagatatttaaaaaactcattcagtcaagttttgttgatcccctaagcacttatttatcatggtgtttatgttttccttgagaaatccattcttatctatttagggaataaatttcaggataccttaagtagaaaccccctttccatcttagaacaaatacttaccataaacataaaaataaataaaaaacagaccctaaaattacactaactcttactttatttttctgttacctgataaatgtctgtctgccatgaaatcactcaaagcaaatattgaatacttttaaatgataaacttctcctagttggtaatattatgtgataataaaaatccaatgtataaattatatatcataggttttttttaaatccattggctttttaacaataatattatcacataagtcatagtaataaatttcgaaaaataaagtgggatggaaagctgataggatgatatgaaatattaaggtgtgaatttgaaagctgagttaattcctcagaatagaaatgtatgttaatttaaaataaatttatctaaacagtaaagccaatttaaaggacttataataaaatgcaatgatgtcaccatttttcaaagttccagtttgtcatcttttatttgcagagtggataatcaacaatataactaagagagcaaataattgcacattgtattttgcagcatccacagaaatttgtcgtttatccctctaaattttccgctctgttttcatttaaaatcctggatttaaaaaagtgctatcttctgtatacatcttaccaagtggggatgcaattacttaatctggaaagtgtgaaaattcatgttagtggactatcaaaattttctgtcaattataaatttcctccatgttgcatgtttttgaagggaaaaaagcaagaagaaaaaggaagctcttagatcagtgaaatggaagtaagaacaaataaaaactgtggtgagtggatgtttgtgcatctgtatgtgtgtgtgtagacagagtgagagacagatatggatatgcagatgtttgccccacatagagtgtgcaagtgtgcaatgtatttacatacgttacatgtacataactgcacgcacatgcacccaaacctcaaattatacaaacacacatattctttgactaagatattttgattttttattgtgtatgtgcaataattttacttctaagaaccttttcgtttttaagtttatgaaataagtgatcaagttaatgtttgatgaataagaaagtacaaacaacaacaaaattatatatacatttttatcctgcctttttcctgtaaaaatattatgagcatctttccatgtgagacactaataccattatacaaatgtatgagaatagcataacttatttataaaaatgtgtgaacatagcataatttatttagctgcttttctaatttaggtcatcacactttttttctaatttgccaattttataaatagtgttgctcatataactttgtgtagatgaacatacctaggacctaagtgttcttcctacattcatgtacaatattgatcctttagaaattacagcatctaggttttcatcatttctatctcagactccttctctgggtggcattggacactccaaaattcaatttatggtggtaattctgttcatctaaaattaaattataaaggtggatatttgattggtaaccaaacctcatgttctagttatgattccaaatcagcctgggaaatgctaatttatagtaaagagtattcagatgtagtagtgatttagcatctccaaaactcctttctaggagttttcctatacattccaatgctgttctgatatttaacaaaacaaacaaacaagcaaacaaaacacttcagaaaagcttttcagcactattctgaaaagcttctccaggctgtctgctaatatatcctgagtatagagttgagctttatgcattttgacattcaccttaataacatcttcataaataagactttctatcccattctcgctctggcccttcccacataatcgtctgctcattacatgcatattctgttaattgatctcattctctgagcactgatcatgaagaacggaaaacccaactagtgctactcttaggacatacagttccttgaaagtggacagccaaaaagctggcaaaacaccaccatcctcaggaccagaagctgttttaacattctctttgtggcgaatgtacattggacatattttagtgttactggcacctgtcttactaaatctgatgcaataacaacaaacacaataaagccttgttactaagctatctttgagccatactggattgtgattgattttgctgtgtttaatggtgtggtggcattttgccttaggccttttttatagaacagtggaaggaacagaagaaggaaacacttgatcactttgtaaatgctgcacattgcaggcagagtttaatgactgaacgtagccacttccagtgtattgaaatgcctgggccttgcctcaacgcattgtacctctattcagatggcaaagaatagagttcctgtaacattgtggagtgcagctcattttgggcataaacagttgctgtgaccttgtacaggcaaatagaccctgtcaggcctggaattgcagggccaggaaatcatctgtttagtcagtgctggttctagtcattagtttgtgtttatggctgggaattgctaatatagccctgtgtggagggagctaacgtctgaatactaaaagagacctatttaccaacagctttatttttttaatttaaagtcaattcaaattgaaatgagccttttaacccttaattaggaccatgtttcttctaaaagtcaaccacattagtcaaccggagacaaaattcactttgcaattgaaaggctgccttctttctttcaacagtagccaccatggtttactaagtgcatttgtttccctttcactatggtaactttacccattccctgtatcagcatagttcaaagtcatcaattacaactgtgacaaaaatgtgttttgtgctttgggaatgaggccaagattctatctggaagctcttccataatgattattcattgtataggtagtgctcataatactccctgtttcatacttgtttccatattatttttcagagctggcagtttgctattttacccccatatgggcccacagtgtttagttcctgttttattgtttccccttcataaatatgaaatcagcaggttcccaaaatatttctaattcatccactacaaattggtattattttggcttccttctattatcttactcatatttttagtatttcttaatagaaaattaacattttgcaaaggccttatctaatttgtttcactgtggcccattctgggtgttttttaaaataagttttggtgtttgctcgataatgcacaagcatgccgtcactaactcggcacttaaacttgaagagctgaagactagattagcaagaaaagggtaaataaaacctaactgcaggctgggcagggtggctcatgcctgtaatcccagaagtttgggaggttgaggcggggagatcactaaggtcaggagttcgagaccagcctgaccagtatggtgaaaccccatctttactaaaaatacaaaaattagttggtgtggtggcatgcgactgtagtcccagctacctgggaggctgagataggagaactgcttgaaccaaggaggcagagcttgcagcaagccaagatcacgctgctaattccagcctgggttacagagcagagcaagactccatctcaaaaagaaaaaaaaaaataaaaaacctcactgcagactaacagaaggcaaatgtgctctcttttcagttgtctttttaatactgtgcttatttttcttgtcattaaaagagaaaatatcttatatttttaaaattagaaataattttgattgatgttatcaaatttgatttttatgtctattcattcccataaaattcacaaacttccaaacattcttcacaatgtaaaatgtgggaaggggatgactatcataacatatagttttattatgttattggttatgatgaaagtataacagggaattatttgtttggcagtcaatgtatatcattcagtccatttgactataaaaccaatatgccctttgaatatacactactctgctagaggaaagcactgcaaaatccatcatttctttttcaagtatatttgttctcagccaggaaagaatttcatttccttgttctgttgccatatggcattttataatttcaatggctaattttaatccttaaagcagtgatgaacatgaagttaatttgttcttttatctccacttagaaagtgttactaatcctacagatttgggcatacagggtattaacattttaaagtgtctaggctaagaagagtctttagagataacttagttaacatctgtcattttttaaatgaggaaattgaagtcctgataagacaactggttgcaaataattcactcactttaaaaattcatctcattcactgctaggtgctggatggtgtgccagatatagggtgcacaaaatgaataggaaataactcctgtctctgtatggctcaggctctaatctgggaatacgtaattacttagggtagaaccttagagttatttatagaagaggaagtcactgtctcaaacacctcattaaagtttgaagatacctgatcagtaaatctaagccaacacctatttaataggaaaagctagatcaaaacatgccatttcccgcttcctagtccagtgcttttcctctaacatgctgaagacaacttgaagtattgggataaaaagaagaaatttcaggaaattgcttagtgaagataacatataagtgacatataaaaacgtatcttgcaactccaattctcaggtgagaagatccatttataaaataaccatgatatgaaactgatctcctttttaaaagctgggattttgacttttattactataagacacaataaatggttgttttcatttctttgggctgctatatcaaaataccataagctggttagtttataaacaatggaaatttatttctccctgttctgaaggctgggaagtccaagatcaaggggccagcatattcggtgtctggtgaagacttatttccgggttcataggtgacacctgctagctgggtcctcagatgatagaagggacaaggcagttctctgggacctcttttataagggcactaatctcattcatgaggactctgccttcatgatctaaacctccccaagatcccacctcctaaaaccaacatattgttcattagatttcaacatatatattttagggaaacacaatcattcacatcatagcaagtgtctaggtcattttaggaaatcgatacatgtttgataaaagtgaaggaatgaattcaaacattatgtgaacaaatacaattcgtagcaaatccaggatgatatctagtaaggcttgagaaggtgctgccttccattttaattgttatcaacttagactcatggatcatcttacttgaatatatcaatataatgttaaagataagagttcctgccacaattaactagtttaaaaatcttcttacaaaatgggagaaagcatctctggagccacataaaaaggtggcaatttgcttccacttgaaagattttaaactattcaatcactctttggttttgctatcctggggttaagatccatgaataatttttccacgtgtttgactgacaagaacatttactactggattacctgagggaagacgtaaatcagaattgtgtcattttggcagcagctttttgatatgtgtgtatctgccttagttaagtattgatttaatagctggtctccactacagacaaccttgactgtatagctggggctttgtattttaaaatttgtctctggataaatcttttttccacccttcttgtctaatctcttttttctttggtattctctaataagttgactgggacttattttcattaacaaaaggaaagaaagcacattaatacatctactttttatttcctacttttattctcttatatgtgcaacctccttcagcctataaaaatgcttaaatgagagaaatgtgtagattgttactcactagttttacattcaaggaaggaaaggagatgttttcaatatacaatcattgtctttgctactataagcaaagataacacacacacacattcacacacaaacatagatgctccttaaagtctttaatactcaggatgattttttgaaggataaagaagacatgacagacagacaggtaattgagcacaagttgatttactgcaagggagagagattgcttattgatgatataaatttaaaaattggcttgttagagaaaaatacatttatagagattgtttctttataaaataataattttatacattctccactcatattctcaaattcattgaacagttttggtggagaattgagatactacttggacaagaaatggaaaatttacttatatgcctcccaaatacagcatgtcactgtcgtcctactcgtgaaattgaaaaattcccactgcccttccaactaaaaggacacttactcatccgcccataccaatgttagacatcaaatagatagcaaatcctagagaaaggctgggtgcagtagcccaagcctgtaaccccagcactttgggaagctgaagggggagaaactcttaaggccaggaattcaatactagccaggtaatatagtgagacctcatctctactaaaagttttaaaaattagccaagcatggtagaatgcacctgttgacccaggctgaggtgggaggattgcttgagcccaggaggtggaggctgtagtgagctgtcatcatgcctctgcactccaacctggacagtagggtgagaagagcaagaccctggctcaaaaaaagaaaaaaaaaaaaagaaaaacaaaaatcctaaatcctagagaaagacatgtacgagagagcattagcctttctgtgatgttttctcacttggaatagatgacaaagtcttgcaatttttaattaaataaaagtttaaatgactatgtttcaatttcatatcaacagtttagaattggtagaaaaataatttgtgttttaaggaagtaatttgctttcaatgattgatttttataaaattaaaagaaagattccttccctgttcaaactataccattgaatttctttgttatcttgggcatgctgtcctttccattggtgcttcaattgtacagtctataaaatacacagactgatacctacaccgataatttcaatagaactttgataagatttaattgagatggtacatataaaagtcctaccaaagaagtaaagacatctacaaaaattaaaatgttattatagaatctagcattttactctgcatatagttgacattaaatgactatctattcattcgtggttaaagcctatcagctagttatcaggtgtcagatgttgcaatgtctgtccctaaactgtgtgtcacttaactttctggacttcagtgacctcagatgtaaaacacacatacagatcaatgtgatttctaaggatcttttagctccattaggctattattctatttaattagcacatctcaactgaatttcctattcatctagtcactcaggtatgccgtctgctacaagtaaaagaaacctaggccacagtgacttaaacaaacagggtattgtctttctgacattataagaaatcttgagattggtggttcctggatcaagtacagaaaacacatcatgctgaatttcttggcctttcactcatgatcacatgtaagctgctgcaattccagccataatgtccataatcaaggctggaataacttggcttcaagttgtatttgtacatcttgttagaaaacaaaaaggtatcacaaatattttaatcggacttctgtgtacatttctttgcccacctttttgtccataactttggccgttcatctctagcttcactggtctaaggaaggaaggatttggctggcttcatctgtgagcaaaatcaggattctgctggcaagaagggagcagagtttgggtattgagtaccaacactacttgccataaaattctatgtaacagtttgtatttttcatgttgatttatttgtatattgaattatgcttcatactggccacttctactatctatgtatgatctttctcaaatggcgctccttctgtggagtctcttccaaccaccaatcacaatgaagtgattgctcagcatgatttgtattaaatgcccgctgcccattttctattgcaagggccctttgggcatgggcagaattagggacatttttgcctttttgggaatcaaagagcccaaacaagaatagatgtttgacaaatatttatttatttatttatttgttgagacggagtctcgctctgtcgcccaggccggactgcagtggcgctatctgggctcactgcaagctccgcctccctggttcccgccattctcctgcctcagcctcccgagtagctgggaccacaggcgcccaccactgtgcccggctaatatttgtatttttagtagggacggggtttcaccgtgttagccaagatggtctcgatctcctgacttttatggtttttacaacatttgttatacaggtattcactaaacactcagtcactttttgtttctattacagatggctatactatacgatacttgaaaagagagtcacataatcacttcctaggtactgcacaaattatcaagattattgatagtatcttgaaggtagctacagttaataaacctaaaagttaagaatgctactcaaactagtcactagactttatccaattatgactaaataataaccctgagataataacagtaaaggatacgtaggcacatatacatacagcttcataaatatttgtcggcctgtggcggtgactcacgcctgtaatcccaggactttgggaggccgaggcgggcggatcacaaggtcaggaggtcgagaccagcctgaccaacatggtgaaactctgtctctactaaaaatacaaaaattagctaggcctggtggcgcacgcctgtaatcccagctacctgggaggctgaggcaggagaatagcttgaatctggaaggcagagattgcagtgagccgagattgtgccactgcactcaagcctaggtgacagagtgagactccatctcaaaaaaaaaaaaaaaaaaaagaaagaaagaaaaattataattgttagggcagtagaattgactatatgtaatggatctcagtgtgacaccaaaagttgttcaatacattggaaattggtcctacagcagccattcttggtaggaactagaaaacagtaagactagattaatgattgctatcattttaagttattccagtagtttattttggcagtgtatttcccttgtcttattttaagaaactttcagtaagaagatagtctaccatggatatattgtatttcttttcagaaacatatttagtgattataaatattgatttgttcacacaggttttactttaatgcaaataatcttctcttcacaatatgaagttaatataagaaaattctagaatgtaatgaccatctatagggcctattctgtatataagttctgtaaatcatcaagtctatttaagttctgtaaatcatcaagtccaaatgtggcactgaaattgagctttagaagttttagaaattattgacttccaaggatcatcttgaatctaaaatttacatcccaaattccttctcaaatgaattactagagacttcttggaattttcactatgattttagttctcaatgtaattataaaaatgcatcaaaagaagtaatgcagcattttgaattttctatcagacaaaatgaaaataatatagtagaggcagttttaggcatatctctgtaaaacagtacatagatgctgaaccctaaattataagctgaaatcaatgttcgataaccagttcaataggcttacaaaaaccattttatgcagagatatggccagaaattaaaaagataacacagttattaaaagagctctcatctagtaacagttcataagtgtattagtttaaataggaactgtatatccctctgtatttcagatatagacaaaggaatatatttaaatctttattttaggccattgccataggaagtaaggaaaagtactgtcaagccagaaaaaaatattgtagctcatgaaaattatttatcaagaatcttaaaaatatacgtgaagccatgatctcttctttcagttgcttacactttgtgggacgaagttgtacccacagagcaattagaaaactagtcaatgttaatatactgcttgctgcagtgcagatagtatacacattgcatcatgttttaaaaagggaattactacatggtgacatggttttgctttattttctccacaaatagtccaatgccaagtaaagctgtgaaaacacaagctggaaatttcatcatacactagtgccaaaataatctaaatcttgtgtgtgtgtttttcttcttaacatttggtgcaaattcaagcatttatgtagaaaaactacagtaggctctgtcatttgcttctgtaaattcttggaggaaaaaacttgatttttatttataataaattcatattcgaacttacttaaatctgttttacatattttcaaaaaaattatcacagacttttaaaagagagtcattttgtttgtagcttgtcgaccaggtttctacaaggcattggatggtaatatgaagtgtgctaagtgcccgcctcacagttctactcaggaagatggttcaatgaactgcaggtgtgagaataattacttccgggcagacaaagaccctccatccatggcttgtacccgtgagtagttttgctgcaacccatgcctccatgtttgttttgttttcttcttgttactgtgctgtttgtttttgttttaaagcatttggcccatttccttctgttgcccgtgtgcaaattgaaagctttctctgcttcactccccatgcttggctcaccacaaatgcaacatttatcacacaaaatgaattaaattttaaagcacttcctgcaacacaaccccctgaaagagagaacattttctgtgtcttgtttagatcctgcattacatatgacaggataggggaggttatagacaggggatttatgtttttacatttctattccctcttgctgtatgttggtcataggtcatagggaaaaaggactaagagttataaaactaatactaaagttttcataactattcacaagggttttgaacatagtgatgagttactttgttagaatttgtgaatgtatccttacctttgagttaaaactccgccattcacagcttggggaagacagtgttcttgaatccatgtgtctataatatcatggatcctctaaggatgaactgaaagttgataataaagaaaggatagttatttacctcattcagttccattgtaaattatctatttcccttgtagtagaaaacagaagtgaggctcattaatctttgttgaactactttgcaggacctccatcttcaccaagaaatgttatctctaatataaacgagacctcagttatcctggactggagttggcccctggacacaggaggccggaaagatgttaccttcaacatcatatgtaaaaaatgtgggtggaatataaaacagtgtgagccatgcagcccaaatgtccgcttcctccctcgacagtttggactcaccaacaccacggtgacagtgacagaccttctggcacatactaactacacctttgagattgatgccgttaatggggtgtcagagctgagctccccaccaagacagtttgctgcggtcagcatcacaactaatcaggctggtgagtacatactagatgcttcttactcttatcatatcacgtctgagtaatggttttgactctgggtggaaaactgggcggaaggaaaaaaagattttatagaaccccaggattttgccttctaacacatttaaacagttatggcacattaaataatttaattcttcaagtgagaataaaccatatttgttaggtgatttttaaactagtttatacccattgtttcccaatttgaaatccttaaatatttgaggctctcagatagtagtagaggggctccttgggggaaacatttttatatttcagagaacttaggcaatgaatcttagctttaaaaaaagttatgcaggatatgaaaaattgtaaatatcttcagcttagttaaaattaggtattcctttgttatttcatacttctaagaagttctgtgtattataactgatagttataaatctctgattgcttaataataactatgtagattacttatggattttacttgtgggattttaattgtgaatctctcaaacatataaatggattatatattacatagaaataatgcccctttgagatataacaatcatttttcaatattgataactgataaatgagtaataaacagttttcttttgtattcaaaatgtcttgtacaaagctaaactgataggtatttgttgtgcttaaattattgctacaaaatgtcagaattaggtatacatcccaagaagctcaattcagagatattattgtcttatttttacacatacacacacacacacacacacacacacacacacacacaaacattggagccaaagggagagggaagagagagacaagatgccactctgattctccagagaactaccgattctccagttctctcccaggtggggtcacctctgagctggttgtcaagattgagtataaactcggcttctgctcttcatttggcttacattatggacatccctctggtccctagtgggaatcaccccttgctctgagaatatcagaatgtgtcctggatgctctaggcaaaaggaaaccagaggtgactaaattatcttatcacctaggtcttctagtagccaaatcatgagccaaaaaaactcaccacattctgtttccatcacctggcttactcagaaaggttagttcaactagtaaagacacagagtaagtgtcatctacaaaagcaagtatgcatcaatatgactctgctggttgttaacattttcatctatttatctactggttaaatgtagttctagctgttcctgcaggttattacagaaatgcctctctactggttaatttctcaaatacactgagtagtcccctaagctcagtatgtcaggtccatctccattctccccatcattcagcaaccaaagggataaatctttgcataagaggggtatacagagcctttggctagcacccgtctttcttgaggggcccctgtcttccccatgccaatggatagatattttaaatataagccatggcagagtccatccatattcaaatatgtatctttctgattctaaatttctctttcgtttccactttgcttctggtctcatatattgatgaaaatcttatatttttacattcctcatgatgataagtaaacttaatttgtggaaaatacatgaattttaaatgaagtgcactgaatcattactttaatcttgctcactgtatctataatttctcccacttggagctagatcccagaccaaccagtatatgctttgctttgcttccgttaatggtatttatactttgtaactaatgatatttaaaagtttataacttaggtttatttaactgtcttctatgggaaaaaatgagtactgcaatactgttgctatatattgcatgattatggcttctcatcttcagctaacacaggaattttaacaaattatgatcatgtggcaaatggttttccggagcgctatatttcaagctgatttactaccttgtttaaaattgtagcatcaatctgtgttacaattatctcttaagtcaaacagaattgtataaaaacaaacaagagctccttatttcctatcttatcattcccctctggctttctgacaatgcatttatcaggaaactaatagttccaaatatacacagtaaatgaatctaggcaaagtggcaaccaagatcaggccaagacattaaaaaataaatgagattgatgctttggccctcccagttacaaatcacagtttaagacagattcagcaaaggtgatagaagttacttaccctagtctctctcccatttaaaaaaaatcactaatgtgtttataatatgcaccaccaggcattttatatatttatttcaggatgtctgtatcattttgtgtgcctggggagatagaggtctttgttctatcttcaaatctccagggtaagatatataagcatgattagaagcaatgccttttctgaagggagtgtttctttgttttcctttatttttgttcttgtgaaggttaatggactggtagccttgaaaaataagctccctaccactggaaggatatggctgtgacagatatgatgccagggtgcttaaaatcctcctagcctctatctttgacgtggatataaaggggaagcatgaatgtgtcccttttaatttagtttgtgagatcgagtttgttgattcttctcttgatgacattgtaaaagcattgtgatgatcaaatgataaggcaccttttaaattgtagaagattatgttgtaaattcggatattagttctcagctctcaatactttcacaaagtatgtcagtgagataagaaagtaggccaccatataaagattgtatctgtgaatccatcagtcaagtaaagaaagaattgcagattacaaaacaaaaatcttcaaacttataacgacataaattgctgctttttgttttctttcacagaatgagtatattcatctttttttttcttctggacaaaaacaatcattccactagtggaatatgcatatctgttcattcttaactgccattatagaatctgccgctttccactattctatagcatataatgatctcagactagaataaggagcactaatagagaatgtatgtggccttggggtttggaggtccacctctactcttattttactacttggatgaactgatatctgagaagctttttcaacatttcatcaagacagcaaagttctgagtaaattgacatttcctccctttaccagtttaccctattggaattcagcatgtgtatgtacaatttctatcaaaaaattggattcattcacatgtgtgaaaatattgcaatagtgtgcattatgcctatataccttcacccagatttctcctagattaataatttattccacgtgctttatccgtcccacccccatctctctttctatgtaaatgttacttatttctgaaccacttgcagatattatgaccttttcctcctgaacacttcagtgacaatttcttttttttttttcttttttttttttatactttaagttttagggtacatgtgcacattgtgcaggttagttacatatgtatacatgtgccgtgctggtgcgctgcacccactaactcgtcatctagcattaggtatatctcccaatgctatctctcccccctccccccaccccaccacagtccccagagtgtgatattccccttcctgtgtccatgtgatctcattgttcaattcccacctatgagtgagaatatgcggtgtttggttttttgttcttgcgatagtttactgagaatgatgatttccaatttcatccatgtccctacaaaggacgtgaactcatcattttttatggctgcatagatattccatggtgtatatgtgccacattttcttaatccagtctatcattgttggacatttgggttggttccaagtctttgctattgtgaataatgcctcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctgtttctccacatcctctccagctcctgttgtttcctgactttttaatgattgccattctaactggtgtgagatggtatctcatagtggttttgatttgcatttctctgatggccagtgatgatgagcattttttcatgtgttttttggctgcataaatgtcttcttttgagaagtgtctgttcatgtccttcacccactttttgatggggttgtttgtttttttcttgtaaatttgtttgggttcattgtagattctggatattagccctttgtcagatgagtaggttgcgaaaattttctcccattttgtaggttgcctgttcactctgatggtagtttcttttgctgtgcagaagctctttattttaattagatcccatttgtcaattgtggcttttgttgccattgcttttggtgtttagacatgaagtccttgcccatgcctatgtcctgaatggtattgcctaggttttcttctagggtttttatggttttaggtctaacgtttaagtctttaatccatcttgaattgatttttgtataaggtgtaaggaagggatccagtttcagctttctacatatggctagccagttttgccagcaccatttattaaatagggaatcctttccccattgcttgtttttctcaggtttgtcaaagatcagatagttgtaggtacgcggcgttatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcaatgagggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtatcctcttttatttctttgagcagtggtttgtagttctccttgaagaggtccttcacatcccttgtaagttggattcctaggtattttattctctttgaagcaattgtgaatgggagttcactcatgatttggctgtttgtctgttgttggtgtataagaatgcttgtgatttttgcacattgattttgtatcctgagactttgctgaagttgcttatcagcttaaggagattttgggctgagacaatggggttttctagatatacaatcatgtagtctgcaaacagggacaatttgacttcctcttttcctaattgaataccctttatttccttctcctgcctaattgccctggccagaacttccaacactatgttgaataagagtggtgagagagggcatccctgtcttgtgccagttttcaaagggaatgcttccagtttttgcccattcagtatgatattggctgtgggtttgtcatagatagctcttatcattttgaaatacgtcccatcaatacctaatttattgagagtttttagcatgaagagttgttgaattttgtcaaaggctttttctgcatctattgagataatcatgtggtttttgtctttggctctatttatatgctggattacatttattgatttgtgtatattggaccagccttgcatcccagggatgaagcccacttgatcatggtggataagctttttgatgtgctgctggattcgatttgccagtattttattgaggatttttgcatcaatgttcatcaaggatattggtctaaaattctcttttttggttgtatctctgcccggctttggtatcagaatgatgctggcctcataaaatgagttagggaggattccctctttttctattgattggaatagtttcagaaggaatggtaccagttcctccttgtacctctggtagaattcggctgtgaatccatctggtcctggactctttttggttggtaaactattgattattgccacaatttcagctcctgttattgatctattcagagattcaacttcttcctggtttagtcttgggagagtgtatgtgtcgaggaatttatccatttcttctagattttctagtttatttgcgtagaggtgtttgtagtattctctgatggtagtttgtatttctgtgggatcggtggtgatatcccctttatcattttttattgtgtctatttgattcttctctctttttttctttattagtcttgctagcggtctatcaattttgttgatcctctcaaaaaaccagctcctggattcattgattttttgaatggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgcatcccagagattctggtatgtcgtgtctttgttcttgttggtttcaaagaacatctttatttctgccttcatttcgttatgtacccagtagtcattcaggagcaggttgttcagtttccatgtagttgagtggctttgagtgagattcttaatcctgagttctagtttgattgcactgtggtctgagagatagtttgttataatttctgttcttttacatttgctgaggagagctttacttccaactatgtggtcaattttggaataggtgtggtgtggtgctgaaaaaaatgtatattctgttgatttggggtggagagttctgtagatgtctattaggtctgcttggtgcagagctgagttcaattcctgggtatccttgttgactttctgtctcgttgatctgtctaatgttgacagtggggtgttaaagtctcccattattaatgtgtgggagtctaagtctctttgtaggtcactgaggacttgctttatgaatctgggtgctcctgtattgggtgcatatatatttaggatagttagctcttcttgttgaattgatccctttaccattatgtaatggccttctttgtctcttttgatctttgttggtttaaagtctgttttatcagagactaggattgcaacccctgcctttttttgttttccatttgcttggtagatcttcttccatccttttattttgagcctatgtgtgtctctgcccatgagatgggtttcctgaatacagcacactgatgggtcttgactctttatccaatttgccagtctgtgtcttttaattggagcatttagtccatttacatttaaagttaatattgttatgtgtgaatttgatcctgtcattatgatgttagctggtgattttgctcgttagttgatgcagtttcttcctagtctcgatggtctttacattttggcatgattttgcagcagctggtaccagttgttcctttccatgtttagcgcttccttcaggagctcttttagggcaggcctggtggtgacaaaatctctcagcatttgcttgtctgtaaagtattttatttctccttcacttatgaagcttagtttggctggatatgaaattctgggttgaaaattcttttctttgagaatgttgaatattggcccccactctcttctggcttgtagggtttctgccgagagatccgctgttagtctgatgggcttccctttgagggtaacctgacctttctctctggctgcccttaacattttttccttcatttcaactttggtgaatctgataattatgtgtcttggagttgctcttctcgaggagtatctttgtggcattctctgtatttcctgaatgtgaacgttggcctgccttgctagattggggaagttctcctggataatatcctgcagagtgttttccaacttggttccattctccccgtcactttcaggtacaccaatcagacgtagatttggtcttttcacatagtcccatatttcttggaggctttgctcatttctttttattcttttttctctaaacttcccttctcacttcatttcattcatttcatcttccatcactgataccctttcttccagttgatcacatcgtctcctgaggcttctgcattcttcacgtagttctcaagccttggttttcagcttcatcagctcctttaagcacttctctgtattggttattctagttatacattcttctaaatttttttcaaagttttcaacttctttgcctttggtttgaatgtcctcccatagctcagagtaatttgatcgtctgaagccttcttctctcagctcgtcaaagtcattctccatccagctttgttccattgctggtgaggaactgcgttcctttggaggaggagaggcgctctgcgttttagagtttccagtttttctgttctgttttttccccatctttgtggttttatctacttttggtctttgatgatggtgatgtacagatgggtttttggtgtggatgtcctgtctgtttgttagttttccttctaacagacaggaccctcagctgcaggtctgttggaataccctgccttgtgaggtgtcagtgtgcccctgctgggggatgcttcccagttaggctgctcgggggtcaggggtcagggacccacttgaggaggcagtctgccggttctcagatctccagctgcgtgttgggagaaccactgctctcttcaaagctgtcaaacagggacatttaagtctgcagaggttactgctgtctttttgtttgtctttgccctgcccccagaggtggagcctacagtggcaggcaggactccttgaactgtggtgggctccacccagttcgagcttccccgctgctttgtttacctaagcaagcctgggcaatggcgggcgcccctcccccagcctcgctgctgccttgcagtttgatctcagactgctgtgctagcaatcagcgagattccgtgggcgtaggaccctctgagccaggtgtgggatatagtctcgtggtgcgctgttttttaagccggtctgaaaagcgcaatattcgggtgggagtgacccgattttccaggtgcgtccgtcacccctttctttgactcggaaagggaactccctgaccccttgcgcttcccaggtgaggcaatgcctcgccctgcttcggctcgcgcacggtgcgcgcacccactggcctgcgcccactgtctggcactccctagtgagatgaacccggtacctcagatggaaatgcagaaatcacccgtcttctgcgtcgctcacgctgggagctgtagaccggagctgttcctattcggccatcttggctcctcctgagtctccatatattccagtgacaatttcttaaaaacaataatgcttttacatagtctcaatatatttattaaaatcaagacattagcattgttctatactataatctcatctgaagatactagtcaacttttgttcattgtttcactcatatccaaatggcaaaaacaaattgatgttctgtttacctccagtttctatttataataataacatatactgatataatatagttcccatccataaaaataaataagtaattttctgtaaattcaaggcagatgcaaaaaaaaaaaaaaaagtggagaaggaagaagaccaacacttattgataggactttccaggtgctggatatgatgcagggaatttcagagttgccattccattcaaaaatgatcagcaaattatgatatttaaaagagagaacgtgacttcattttatgtagattttcgatagaaggtgcactaatttatgtaaaggaaaagatctttgaggctgttagctataatgaaggaattcctatcctctgctttagacagaatgacctctattatctacttaatttgatgatcaaagacaacctccttcttttccccttagataaacgccttcctttcttctggctgaaaattgccatccattacatgaagggattaaactggaaatccaataattatttttgtttttaatttattttttggcattctgggactataattcaaaatgttgtcactaatataattttaaacaattaattatttttgacctttaagaccacctatggactcacttactataaaaaacgtttataggctttctcgttcatggttttatggccttttatttcacagaataaagcaatagtatccattcgttaagaaaagtaaatatctttaataaatgttaaataaacaagatatacttaaaaaaagaactgtaaaatattagagccctttgactaaatttagaatccacactaggctaggtgtggtggctcatgtctgtaattccagcactttgggaggccgaagcgggtggatcacttgaggtcaggaattcaagaccagcctggtcaacatggtgaaaccctgtctctacaaaaatacaaaaattagccaggcatgatggcaggtgcctgtaattccagctacacgggaggctgaggcaggagaattgcttgaacccaggaggcggaggttgcagtgagctgagatggcaccattgcactccagcctgggcgacagagcaagactctgtctcaaaaaaaaaaaaaaaaaaaaaggaaaaagaaagaaagaaagaatccacagtatttttttgcatttgataaagaaaatatttctaagttttctgtagtttcattctggaatatgtttcctctagccaccttatttttcttttggaacttagtgtatgtagatatgacaaagaaataactcatgttgaagatatcagtcaggcttcagcatttctgaagaagcaaacattttaaaataaaggtagaataaatgcttagctgaatctgccattaaactatggccacctattggtatagtccctatagaactgtatgttgccgtgtaattatactccttggaagtaaattaaacaccaaaaggatctacatgaattctttcagaacatgaaggtagacatttttcagcgccaatgtagcgaatcggaaactgtaaacataatgaaaatcacctaacaaaataatgaacatcatatgactttagtaatgttctatgatgcatccttctctttgtttcattttatgattaatgaaacctaaaaatcaaagtcttaacattttgtttatctcaacaaacaaatgacgtctgaatttggccctgagagtataagtggttatatacattatgattttcacagtacatcatgcttgactggcaattcagcttcttcctgttttgaaatcaaggcagatacctgtgcatctgggaatgtcactgtgcagtgatgtgtcatagtgtggccaagccttccacatcatttaacacattaatgatgcctctcagccatcacaccctggtatggaggcacattgcgtaactgtagaatgagcaataagctgtagcaaaagcaaaaaccatatattgtcctgacagttattcaaaacccttatatgagcttagaggccataacaaaatggaacatgagctaaggaagacagttggagagcttcatgaatctaaactgaattttcattccgtcttcatttctggttttatatacgactctaattaatggagaagacatgtacgtggaagggtatgattacaactttcattcaagagttttcactagaaaaagaatattaataaccagttagaggagtaaatatagtgttaactaaagcacatggaaattaagaaagaattagacttttgatgctaacttgttgtatgttaactatattcccccaagggcaaaaaatatttaattcacagaaagttttctcatccttattttccaaggagaacatttttagtctcaaatcacaataaaatcatattttatactttaaatgtgttctacctccctaaagttaactgaaatatagtccttaggatataatagcatcgtatgtgagtaattgagaaatttaataaatgcaagtatttagaaagaaagaaaatgttctgtttccaaaagcagatatattactaccactggcaaaactctttcataataaattcttaattatatttcagcatctcccaaagtgttatctcagtgtgaataaccatcatacagctcagcattctgactttataatcctatcaatatagtaccagtgttcaaatagaaaaaaaaaatacatccctttcttaagtgactttatagatatctatcaggaaattattgcaataagtatccaaattacaaagactatgactatgaggtatggcacccctataagcaggggccctgacattctataccattcgcaccaaagtaaaagaatgccaaggccaaagaggtgagaagttcatattttctgctcctttttattattattaattgctgacctaactcttcttgacatgattagcactgcactccagtcctttatgtaattatcttattcaatcttacaacaattttatatggctataagtgaataagtgtcttgtccatggccgcacaactccagagcccctatctacatattctttttcctatgggttgcaaaggagaggctttgcacaaaatctaagtaaggctgaagaaagaaatatataaagatggttattttattatagtaaaatcttgactgcctggtacacaggtggtgtgatttcttctttgaaatcaaaatttcacatgattgtatttactcttaatcaatgctaattcaaaagcaccctcttgacaattcatcatccagaaataacctcttactcctttcccttttcatttcaattggaaaaaaaataattataacaaattgacaaaaaaaaaaaatctgtctctggtcacaagtttttcctaggaaatagctttaaaggcaaggccatgtgcctgagtaagaagagttctggaatgtgtgtccaaagaggtaaatattcatcttgatcccactccaattgggcctcagagtaggtcagaactattgctttatctttctgtgaaatgtaacatttggactagaccatttctaagtttctttccaattatatattctaggaaactaagttaatgcacattgtatcatgtacttaagaaaaaataatccactgtttataagtgaagcaaatatgccttgggaaaaaaaggtatttgaaaaacaaagtggaacaggacagtagcaaaagtccaattgtaaattcaggtactgtcacttaataatgaagtgactattttttgtatttttaaatttggtttgtttatgcattcatttgcaattttgtttagaaatgaatttaagggagttattggactaaacttactggcatctttgtatcctttttgattattggtacagtaagtcctacacatagattgttgtgaggagtaaataaaatgagagagcatttgtgactgggaaagggcttgaataagttgtgctctgtctccataatgatcatgcagatcttcccgtgtctgggggaaatagaaactcttttttttttaattaaaaatgtgaataaatatatatatattttttattttattattattatactttaagttttagggtacatgtgaacaatgtgcagattagttacatatgtatacatgtgtcatgctggtgtgctgcacccattaactcttcatttagcattaggtacttctcctaaagctatcccttccccctccccccaccccacaacagtccccagagtgtgatgttccccttcctgtgtccatgtgttctcattgttcaattctcacctatgagtgagaatatacagtgtttggttttttgttcttgcgatagtttactgagaatgatgatttccaatttcatccatgtccctacagaggacatgaactcatcattttttatggctgcatagtattccatggtgtatatgtgccacattttcttaatctagtctatcattgttggacatttgggttggttccaagtctttgctattgtgaatagtgctgcaataaacataggtgtgcatgtgtctttatagcagcatgatttatagtcctttgggtatatacccagtaatggaatggctgggtcaaatggtatttctagttctagatccctgaagaatcgccacactgacttccacaatgtttggactagtttacagtcccaccaacagtgtaaaagtgttcctatttctccacatcctctccagcacctgttgtttcctgactttttaatgattgccattctagtaagatcaaattctgatacatttctttggtgtgattggcttaggccccaagtttttttcaaaatcgcaattcatatctataatgcgtgacaatcctcaatgtaataggtcattctcgtgttgttcgttgcacacatatacatatgtatatataatgtatgtatatccattgattctgtgccatcactgaggtgccctacataggatgtaatggaaatgactgattgaaagttatatatattggcctatatctcttagttgggctagaacaagaaccaaaggcacacataaaataagaaattgataagactaataaaaggacaaccaacactttgggcagccgaggcgggcagatcaggaagtcaggagatcaaaaccatcatgggaaacatggtgaaaccctgtctctactgaaaatacaaaaattagctgggtgtggtcgttggttgtgcatctgtaatcccagctactcggaaggctgaggcaggagaatactttgaacctgggaggtgtaggttgcagtgagccgagactgcaccactgcactccagcctggtgaaagagtgagaccctgtctcaaaaaaaaaaaaaaaaaaaaaaaaaaaaaagcacaatcaagcaaagatatcggcaaagagtaaagaaaagagacggtgatacgggaagaaaccaggtggcaacaaatgttctaataatcattctggataaagagttagaagaatacactttaccaaggcccaggttgtgacaggagacaaagattttacaactacttaggaaatgctcactttttaatttttaatcactagactgttagtggttgactttttctacaagtttattttaatagattcactgtaattccaagatgagaatgtcagatgaccccaaaattaattgtgcataccatagatattttaaagaaagaaaatttttgcatctttacttttatttgtttagcttatcacgctatttgaatatactttgtgggcaaagttcgtctatctttgtccacctaaggagggcaattgggtatatatcctctaaaatgaagtacatgttatggatatttatacagattttcaacatatcaaagaataacattctctatttctgtttcaagtagtaaagcttgttttatttctcttctattgaaatgatttcaaaaggtttttcatagttgatatctgggatacattgcctactgttccattaactcccagttaaaataaaacaactaggctaagaacatagcatgcttttctcttggtttgaattgatatagtaaaaaacttcagtttaatttgacatttttatatctgaaaagtttgaaaaaaatcccatccatcttccctgaggtatgtttccattctaagctgcttttacaaattcttattattgcagatataagatagatgtccttattaaaatcctaatataaaatggctagaagaagaactaggttttacaactattcatatgtgtatgtgtttatatttgtatattcatgtgcgtgtgtatatatgtacatgtataaattaggaatgtaaagatctagaaataataaagttatagaaagtatatggagtctaacagatatgaaagaagagagacttttttttactaaaatatttgaacaggatagtctttttcttaaccatctcatctgttaaataagggttatggctacattgagatattgtgaagtcaagaaaaaagcatatataataccttgtgtggtgctggctgcttattaagtgatcaatacttggtagttaatatctttcataaacatttggaacatttagcagtaaatgtggtctaaaaaaaaacccatttagataactccaggttttctttggcaataaataacacactcaattacttgcctttttctgttcccaaagcattgactaagcccttagtatgagccagttactatactggatctactgggataaaatgatgattaagatgtagtcactactttcaaggagctctcaatttaggacatcttaaaggtttcatgaatacagcatgaagttgattggtttggccaagaaaagacaggcaaagccagctgccaagagaattcaaaaagcatcaacagctcaatgaagccccccagtgaaagagattggtcttgaattcacagattatatgacattaagtataatagttttatctttttttcattactaaagcagaggaaaaaaagaaaaacctactgattacacatgatgctaaaaaactcgcatgctgtcccaaagtttttcactaaagagaaggaaagtaaatgaaatgctttaagttatgtacaaattcgatgataattgcatgtgtattttaatgatctctcaaatgcatgtatctggtttatgaaagcacatagaatatgtgaacttataacaatgggacaagagcaaatgtttaaagttgtgcagtaaaactcaccacattaatctgacttatttgtctatctgtccatttacttacctatttgattaagcttattgttattagtttggaattaaatattctagttaaatagacagttaccacataaagtatataaaactagaatgcattaaaatataatcaacagtaattagtatgaaagtgactccttatttcagataaagacaatgtctaaagtttagaaatgtttagaataatcattttaattatgaattataattgttttgaagatacctggccagaatttgacactaacataatagtaagtcaggttttactagtttgctaatatttgttaagacatacatgtttacaaaccttgcctatttgtgaaagttaaaagatattgctttctctgtatgaaaagtaaaaacgattaaaatgagtttcaaaaaagatataaaggaaaaatccactattttatctatgttaatctacatgcacactttgttgagaagtaagaatttagctgtcttgttgggtagtacttaaggagattttataatttatgtacatttcacatgtaatactggtatttacacactatttgctgtattttttagcactgtatgatgttttttaaattgtgatacattttcagataatatatattcctctactatcagtagccatttcttctttagatgaactggcaaacattatatattgtgtgtgtgtgtgtatatacgttatatattgtgtgtgtgtatatatatatacatacatatatacacatatatacacatatatacacatatatacacacatatatatacatatatatacatatatacacatatatatacatatatatacatatatatatacatatatatatatgcatatctttggattgttgcagtggcctgagggaattgttgcccacattcaaaatcagaatatttattatttaaactaacaaccaatactgtactgtactgtactgggcattttcgagatatcatttaagccttaaatcaaccctgtaatggagacattattacccttatttttagaagaaacttatcaagagtttgccagtcctatttatctaactcaagttgctagggagaatttgaacctagatctttccagtgcaccaataatttccaaatttcagtaaacaacttactgcttttaggaattttgcttcatccatatgccaccaggactcctacaacataatgtgcttaaatcaagcctctcttttttttggttttgttttgctctgaaatgtgaaaacagtttgctcctataaatagaaaactaatgttacttgccaaaaatttatgactaattagataataattgcttgtccacataacacctaaaattctttcaccaaacaccatgagtaaacttggagcactatgagtaatctgctgattcctatcaacactacctcactggcaattgcttataaggatcactaaaccacaggccatcccatttcagctaactgcaactctatgcttttagttatttcagtcaaagctgttggagtcatttggcgcttctctttctctcaaactgtatatctacatcagcatagtctatacaacatgccttcaacatatcacaagaatctcaccacttcttacaagatccattgctaccaccctagtagcatcatcttccccagattatcgaaaatgctcccaactgcatttcttttttcacccttgccttgagaacacatggacacagggaggggaacatgaaaaacaagcctcttataactatactcatgtttattattatttattttattgcataaattagcaatgtttgcagttttttaaattatgtcataactaatcaaatttcctgtgtaatttcaaatatttaattcacttctcatgtattatttccaaggtgactggcattactttttaattgaccaatgacaaaatttaacactcacttctcatatgaacagataggtttgtttaaaaaatggcttaggcaggaattgctagtgaacatgtgcccttaaatgctaactcacaattatggcaacttactgagtcaatggtttgggcacttggcaagtctttcttcagttaacatcttgcatataaaatattcattttcagaattttacctagagtgcacatatggtttttcaactcaaaagactacactaaaacaattggaaaaaagatgccattagtgttgcccaaggtacagagaaggccttcttgtatcctttgcctttctttggaaataaagacctatgaattcctaatctatactttttgttaagatccctttttaaagggtgtcatgtgtagcctaagatatagcttgaaagttgatatgagtggtgctttgtgacagaaccacagatgttcagtacatgatatatttattttttaccccagtggcccttataaaaagggctagaaaatcagcttataacaagccaactaatgacatgatatagagaggcccctggttcaatgactgttagtacagctgtgtcccattacatattagatacctagaacatacttgcattctgaatggcatttatcttttgaatttcaaacattcctaccataaataaggattttatgcttttcacaaatgtttcacagtttagtctagggaatactgaaaggttgcttttacttaatgaaatttaccctttaaagtttcctggagctaagacgaacattttctgagcgctcacctcaacagacctgcctcactctcctctatgcccattctctgctatccccttagcctggagaggtgataataacttgagtttcacaaaaccaacagtgtggggaccacatgagagctggcttttgatcatggtttaataattccctctttgttacttctccctaataagaggtatctgagtctaacatagaattgctacacttgtgctgtgggaaaagcaatatttttatatgtattttgtttgcaaaatgcacactatgtctaaaaattactttaagtgaaaatattttcacaaccccctcaaggtcctgattataatttgaaggtaataaagactcatacttctaaagtagagtagtatgacaccttaagaaatgttatgtgagatgacctcacttctgaaataatgtttcagaattgtttcgttttaaataagtgtgatggtccatctcatcttcttcaagcgcaagtagctgctattaatccagaagatcttcatttctttttgggttgaacatatctgctatcttgaggaatgaaccatgaaaaagaaggaaagtcatttcttgtgattcaggcaggaactcagtcattttccttttgtccttcaaataattgttgaaatggtgggagattagcctagatagtgactgctgcagtaacaactgctgcctagaagtgagctttattccacctccatgtaaagaaagcagctgtctttctattgcagttggcgccaggcagctgcttttactttctgtatttctttatagagcccttcgtcttaaatgcagtcacctgcacacagcctacactttttttagtcacaaaggctgcaacaagaaagcttcatatgactcctgtaatgagcaatgcagaaagtaatatggaaagatgttccttgagcattgtataaggagtgtactgggtggacgttgggagatggggcaagggagaaggagtttaacatgtgtgattgggtgtttgtgaaaagcaccagattgtcagatggcaggatgtgtacaacatgggatgagtggcaggaaaggctccagtggtcagttcttgtcctgcacaaaaaattcacagcacaatgagaaccaaagatatctccaataaatgaagttttacttcttcccagttaaaagaaaatattctcattgaccaaggttatatttactaactcaaactaagattatagtctggtgtatgtttcaatctcctctttcctcctagagttttactaaagaagatttatgcaaacccaaactgtgataagatttgtaagatgattgactgtggcaccaaagaaaattactcttatcatttcatcttatataaagctaggtatctatctactctctttttaaacataggttttggtttcatgcatagatttgcaaagtcatttttcaattatattagtccacatattaatgaagtttctccagagaagcagaaccaatagactgtgtgtatctatctatccattgagagagagatagagagggggcagggaaagaatacaccaatagactgtgtgtatttatctgtctattgagagagagatagcgagggggcaggagacagagagagagtgagagagagagagtttaaggaataggctcatgtgattgtggaggctgccaaatccacagactgcagggtaagctgataggctggaaacctagggaacagctgacattgcagcttgagtctgaatgcactctgaagctaggattcccttggtcttaagggttctctattttttctcttaaggccttcaacggactgaatgaggcccacacacattattggagtacaatctgctttactcaaaagtgtgccgatttaaatgttaatatcatctgaaaaacaccttcacagtgaccccagactggtgtttgaccaaatatctgagtaccatggcatagctaagttgacatataaatttaaccatcatagtcagtggtgtgtgtgcgtgtgtgtgtgtgtgtgcatgcacatgattgctgtttctcttttgagttaatttctagactatatttttaaaagaaatgtcaagataaattgatataaagaaaatactaatcttttaatttcacccactgaccatattggaattctcttttaatggatcttcattcttccttgagagtctttttttaggtttttcttggaagacaatgcccagtgcatcagaaagtgtcccctcccctattcctatctcaaatatattcagtttgaaaatctcacttggatgaccacttatcaatagcaatgtaaactgacaaactgctttgtggaaaaggcacactataggttttttttattggtaaatattttcatgtcaacattacccttttggagatcaccttcttatgtgccttctgtgcatagaatttcaggaatagtgtcaggcctaataagacagtcttcactacactgtttccctttaccgacctttgagagtcatccctattttcaggacagtgctgtggctgctattagcaccacttgagggcttgttaatcatctttgggtactgctattgatgaaaactctcagctcagtgatttttgaaaccagaattgcttaaaatatcattcagaggcctttcagaacaccagtatttacctactccaagccaatcctacagatgcagagtctctgaaaataagcatagggatccctagtagcacatgcatttttaaatcactctacagatgaatctggtcaacaagcacttgggaagttcttaggaagaaaaactctttcccagttgcaaggctgcagacaggcagaaaatttatagctccttcacattacagtttgtgcttccatgaactgcctggcctgaggccatgcaaattgaacttgcagaaagagaagttggataaacccttgttaaaaaaccagatatatttatactaatattatcttggcctcaaaaaggcaacacttgtttttctagattttatgcaaatttaagatattgtcattatcttctcaatatcctctaaatgtctttaattctaaagaattatgttaaacctgctgaagagtaatgctgagatggccaatcagtgtaatacagagattgtacttaaaactgttcattaactaatactgagttatcttttcttctgcattttcatcactccttgctacttttcaaagatttccttaatatttgttttataaagtgactttacttcctaacaatgaaatttaattattcaacttaattccaacaatatttgttgcatactgttatgtgaccaacactgtgctgtatgttgtggtgagagataatgataattgatacctactttctaccctcgatgaatttataattacctcaacatttatttaactaaatatagtttgtgcaaagaaaacacaccataataaagaaaaagaatgattattctctgtctgagaatagagaaaggttttcttgaagaggtggggtttgaggtggacaataaaaggtaaagaagggtttaacaggagccagcatgttgaagactggaaaaaggaataaagaggttgggaagataattgtcccctcagatatagcctttcagctgaggcagagtagaggggaagactgaaagggcaatggtggatggaatggtggcttaaggtctacaatcttttggggggattttgttagtccgctggagtggacacacacttacatttccaaacatatttagtcatagatacaaaacataatgcaaataaaggggctacaggcataagagcagatacaacatagcttttcaccttggtttgattttccacagggcaacacttgactgtctgtgcagcaagggccctgccagacttggaaacatagactaatgttgctgcaccattgcttgttagtactcagttctgtgtcaagaattccagaaaaaataacaccaagaaattgtgttcatcaatttaagggactattcacacacattgacttccttttggttcctgaacctacttagcatcaacaataccaacaagtagagaggaatagaggacaaagcggtatgactgtcctcatgtccttgaatagggtctctgcctccactttcccttgaaacagaaagcccatttccctgcagagcctgccatgcaatttcttcacctgggcagaaatgcatgggtattttttcttcattttataggtagcggtgcttgtgtatgatatagatggtttgggatgggatggtttagcagaaatgcttcttgatttttgtgtagaaaagtgacacaatcaggcctatgacttagaaaaataaatgaagatgcaaggaaaacaaaccagttgacacactaatgatagcccaaatgagagattataaaggtctgaaataaacctggggaaatgagggagatgacctttcagagattaaaaccagaataattaaaaccatgaccagttctgtgtcatgcatttgggaaaaaaacagaaccaatacattcatcagtttaagggaatatttacacatattgagttccttttggttccagaaccaactcagcatcaacaataccaacaggcagaggggaatagaggataaattgaccagaattgaataaaggagcaaggggggagttgtagctcactcaaacatgagaataatttaaacacatgtggaagaaaggatgataataccattgatcaagatcaaaaacatgaacgcataataagataatatacagcattttagaattgatgaaattaaggcaaaaaacaggtattctatgcgggtggttgtacaaagtaagcaattgaccactaagatctgattcttgagaaagatcttaaatataatttgtatatttgaaagccatgaaagttgaagagaaaaagtgtagataatagagcatggaatttaattttaaaatagcatcaaggaaaagatcttgagaacagcaatggatacctgctgagtatagacggagtcagctttggaatcaaagcccagactttaactgggaaacagttatctacaaagtcatttatgaaatcttactctgtttttgccctctcacttagtcctcctcaaggaatataagcctaatgagggtggggaattgttgttcactttgttcattagtatgtattttgttcattttgttcattagatgtgtttcctcagcaactaaaatgtattggatatttttaaaaattctatcaaatgaagatgtagccagttagcatgtcccatagattccaccagcacaaactctcttctatttctataacattcttcctatcttcacttgatattactaacttcaggttctcatcaaccctcatcttgattattacagtagccactagtctgcagttgcgtttccacctcatctgttttacaaagtaccttaatccaagtgctttactgtgacttacaaagctctccatgaactgtttaaagactacctgccaattaatacctttccactttatgctccatgaatacattttcttgtaaacttgcataaactcgctacaggttcatgccttttaaaatctatttatatacacgtatggaaatttcaactatttcccttctttacctgttcatttctcatctctcaaaagtcagttcttgagtcacttcctgcaggatgtttcccatttcttcactagagtgagctggcctcccgtgtacccacataggaatcagtttctagctctgtcactgctcttataggtgaagtgactcctcaaaggcagggacctagctttatccatgtttgctgaactcttgataaaatcattgtcagattaatcacattagcatatagtttcaatcacataacttagctcctttaaatagtggcttccattacagaggagaaaaaaacaaaaacaaaaaaaaacttcttagcctcgaaattaagattcctcttatgtggcatcacacaaatttccaatcataatttcctttactccttgttacaaagatagatatatctccttcctattctccaggatattttgaaaatttggtaaccttcacctaaaatacaattattctatatgcatgtgtttaaaattttttaattctgcaagactcagactaagtgccagcactttgttaatttttctctaattcttctcagctggaaatagttgtccttttatcacaactcccatagggctacagaatcgtttatctgtatttctcttatggtgctcctctgttctaatttgtattagaatgctacttcatatgcatttaatctttcttactgcactctaggttccttgagggcgtgaccaaggcatggctcacatttgtctccttcatagtggctaacttgggccttatccaataggcatttttatatacattttaagtgagagagctgtaagaagaagaagagctgagcagaagatttcagtcctagtggtttcatataattagatcagaatactaaagtgtgtgctgttggtagttgtggaggtatggggttttttaaaaaaattattattttaagagaaaactgagtgaaatttgggggcagaatttagatcataagtgttagagtacattatttaaagcaatcttcattaattaaaaaaagacaaagcagaactataaggtagtatattagttagggcactccagaaaaacagaaccagtgggttatgtagagatatgtaagaggagatttatgatgggaatttgtttgcataattatggaggccagaaagttccacaatctgttgcctgggagctagagaaatagaaaagactgatacaattcagtctgaggccaaaggcttatgaaccaggggagtcaatagtataacttccagtatgaagtccaaggcctgaaaactggagggtctgatattgtaattcttagaattagcagacccaagaagctggatcttcaatatctgaggtcaggaaaagatagatttcccagctcatgaagagagagcaagttcactgccctctgccttgttctatttaggccttcaatgggttggatgatgcccacccaccttagtgagggtagatcttctttactcaatccatctattaaaatgcccgtatcttctagaaacacccccatagattcacccagaaaaaacaaaaaacaaaaaacaaaaaacgcttcaccagcagtatgagcatcccttagcccagtcaaattgacacataaaattaaccttcatagttagcaaccattaattttccagtttttcaatgtggaaaactgaggcaaggatgtgaagtaagatgcctagttcacactggtgttgctgactcacaatttgaactcaagtaatctgacagctgtgcccacattcttagtcatcgttttctctgctattgaagcgtgtcatggaagggaagaagaatatgaattagcaactcaatgacaagagagactgggtttcttgagaactcaaggaatggtaagaaggaatggaaacaacaaaaaaagagcccgcatcaccaagtcaatcctaagccaaaagaacaaagctggagccatcaggctacctgacttcaaaatatactacaaggctatagtaaccaaaacagcatggtactggtaccaaaacagagatatagatcaatggaacagaacagagccctcagaaataatgccacgtatctacaactatctgatctttgacaaacctgagaaaaacaagcaatggggaaaggattccctatttaataaatggtgctgggaaaactggctagccatatgtagaaagctgaaactggatcccttccttacacaactaatttatacaaaaattaattcaagatggattaaagacttaaatgttagacctaaaaccataaaaaccctagaagaaaacctaggcattaccattcaggacataggcatgggcaaggacttcatgtctaaatcaccaaaagcaatggcaacaaaagccaaaattgacaaatgggatctaattaaactaaagagcttctgcacagcaaaagaaactaccatcagagtgaacaggcaacctacaaaatgggagaaaattttcgcaacctactcatctgacaaagggctaatatccagaatctacaatgaactcaaacaaatttacaagaaaaaaacaaacaaccccatcaaaaagtgggaaaaggacatgaacagacacttctcaaaagaagacatttatgcagccaaaaaacacatgaaaaaatgctcaccatcactggccatcagagaaatgcaaatcaaaaccacaatcagataccatctcacaccaattagaatggcaatcattaaaaagtcaggaaacagcaggtgctggagaggatgtggagaaataggaacacttttacaatgttggtgggactgtaaactagttcaaccattgtggaagtcagtgtggcgattcctcagggatctagaactagaaataccatttgacccagccattccattactgggtatatacccaaaggactataagtcatgctgctataaagacacatgcacacctatgtttattgcaacaatattcaccatagcaaagacttggaatcaacccaaatgtccaacaatgatagactggattaagaaaatgtggcacatatacaccatggaatactatgcagccataaaaaatgatgagttcatgtcctttttagggacatggatgaaattggaaatcatcattctcagtaaactatcgcaaggacaaaaaaccaaacaccgcatgttctcactcataggtgggaattgaacaatgagaacacatggacacaggaaggggaacatcatactctggggactgttgtggggtgggaggaggggggagggatagcattaggagatatacttaatgctaaatgacgagttgattggtgcagcacaccagcatggcacatgtatacatatgtaactaacctgcacattgtacacatgtaccctaaaacttaaagtataataataattaaaaaaataacaaaatacattagttgtatatagacaaaaaaataaaataaaataaaaaaagaaggaatgcaaacaacaaagtagaaatgaataaggaagtctctttctctcaacattgagaaaaacaggaagaaagtataggagaaactaaaaagtcaaattacctgaaacaggttgtgaagtgaattgggcaaagtgttaagaagttgctaagacttgaaataaaacagtacagtagcccctcaaactggtactgcagtttttcatcttttctgtgcacctagacaaaacatctacattttggtaatggatataaagtaagaaaataaaagaactaccaaggaatttttaaagtgaatatggaaattttattatatctgctcttaaatggtatgaaaataaatatttcaaggtagtcaggttctctgggaaatcagctttgtatagtcattatagatttgtgtttaaaaaattctttatattagttattcatatatttgtttgtttgttttcattccagtgattatttttatttaaacttgtttttggctgatgattttgagacattataatttgtaccaatgactacagttaccataaaattctacttgagcacatttaaacaaaaacatcttttatctgttctcatatctttaagtttccctggaagattactctctttactcatttaatgaacatgcccttaactatcgtcgacattttggtacctattgtgcaggaatcttttcattctgggtccacttctatcaggtaaactgaagaagagatgatacaaggtaagatagataaaagataagataagaaatgataggacaagataatgtgtgggctggtttatttgtattccttataaggagatttgtagagtttctctctcaaagtactgactgtcagccagggccacctccagttcagtaatacacaactgtaccgtgtggcacatttagattgtttaagggaagtctgttaatgggaagagttttgctagtttgtcttcctctacttggtttattgtacaaggcacagtgatacacatacacacacacacacacacacaacacacacacacatatgtgtatgactgagattgacaagtagcaaagttttaagactggataatttattatatggaaatctttcatatcctagtcaacactgcttgcctatattgaagagaaacagtttctaaatgactcaacatttgaagagttactagaataagtctggagtgggctttactctcaaaccagttgtttctgtagggcaattctctatgattaacttccagcctagggagttatctaaaagctttcttcaattaaaaaaaaaaataaaaccattttagcagagagagggaggaaagaaaaaaaatgtcaccacaagtttaagtttctgcataactgatcatcaatctggtctgaaacattccgataaaattggcattgacatttgcccatcttggaatctatggattgatccatctgaaggttttggaaccagtcagcctcagtgggatgtactgacaagaaggtagggtatctcaagacaggacatcctaggacaactcatagcttcactagtcatgacctagtattgaagaggcttcatatacaaatttaaggcttaaagactttatagtgtgatggagactattggttacttctagcagcaaccccctcaccctcatacttaggttcaagcctttatattccaagatatttttaaaaacacagcagcttttattcatatatagcacagactttttattccttctaattgaaaaaaaaaaactttgcaatttgcaattggcatatgtgccacttctaggaatgctcttaaccacttcatcagacttggcactgtctggatgttggttttgattgccaacctatgaaagagaaaggaaatcacaaaagagaaaattaacaagtgagcacagttccaaaatttgttcgacaaatgtgttttaaatcaaatgaatcatcctttggcacaagctattcactttatagtcattcatttgaacagcttagtctctgtctcctacagactgtggttaacattattcttgatgaatgagacagttaccttaaaacataaataaaacaaatagaataacttaacatctgactctcaaaggaaggtatgttatcttaccttgcactagtaatatattttaaataaaagtattcagaaaatcagctaaaaccacaaaagaaccaaggatatgtctacatagaactgctgcatgaaaaaagtagtttgatcaaatacatatatcttgattaagaaaatatgtgacccttccaaatattttatcagttttcttttctagtctttcactccataaaagtagtttccattcttattatttttacttactaatttaattaaaagtctctggcacaaaatagttttcacgccatagagtattgtacttattgctgaaatcaacattttaaaattaatttcaagtctttgcaagggcaaagacttacaaaagtaaataattatgtaaatcttaacctgtaagataatctttttttcttgttgttttttgtcatcccatttaatctttacttttaaagaaattatattgctaatttaaaatttcctccagccactttttgaactgaatccttaggcaagataacaaccttttaaatgtgtagaacattttttcttatttatgtaggctttatatagataactttgcatatatttctgcatcattttccaacatccatcttacctcacaaaacaaaaccctggtgtaataattgtgaaatggcaatgttatttcagaaaattcttttagcagcaaatgggaacttagagagtcagaaacagaaaagatttctgtgtaagcccactggtctcattcctatgtgacaggtgtctctgttggtgaagtctgctagtcagtgggaaaccaggatatcatcaccctgctgtgaatgagtctctcccagagggaactcacttatctgcctctgtctctgactcctactagactctaattctcactcaccatgagaattgacaggaaagatctattcagagatgtatttcacttcactttccatcctggatcaggcttctatttgtgggtttgttcaacatattatattaacatagaactaaattgcattttataaggctttgagatgtagaggataaggtcgatgtcattacatggttttattcattctaagtactagaatttaactctaagggtcaaatagagtccatttggtctgattactatgagataggtgctattcaatactatatataataaatatcagcttttattaagacaacaaaaggatttgttaaaaatgagtttccgaactaaaatttcaaatatgtacaattatacactctccacacacacacatactcagaaatatagtcatatataaaatgttcagtaagatattttcttgttgcttgggaattggcaactagaataaaaaagtcaggcaaaaatacaccaagtataccacatacaaaagagaactgcaaacagttggagccagacacatcttgaggcatttttaagaggaattaaatgggtccttgccatgtagatttttgcagaatcatctgaaaacgtcatgagtgcctacagaaagctagcacacaatagtaaaagtcagtattagtcaagaaaacagtggaagtcaacaaatacagtgcaaatgtgtgcacagctaagtataacctctattttccaccatctctccacagtcctccaacattggaaaagggaaggaagatgtaaatgagctgacttttttcctcttccacccatgaaattgctgttttatactgttatacactgggcattaataaccaaaagtgaagagcaggctatgagatattacagcaatttcatcaaagaacaagaacttgaggttcaacagatcagagggtctctgttctctgtatttcactttttagaaaaatcccattggtctggtctgcattaggatgtctgctgcttgtttgagggccaattgtcatgatacatctcagctatttcttggtcatttggaatgaccaagtaatgaagtagctcttattttctaacctgagaatgccacattccgagcacataacagaataaaaaactaaatttttggttcagaatagccacccaacttagagtagacagaaaaatagagacttcattgaaaaaaagtaatgccactaaacctctatataacaccacaaactatccttcattccactatagcaactgtaggtcctgttaatcaaataattttcaatattatctgtatcacagcttacaactcaatttcacaattcaagaataagtttgaggcatcgacgttgctggggtagagatatatttgtgtatgtgtgtgtgttagctctgtgtattcatatgcttgtatgtttgtgtgtttttttagttttcctaaactttgtcccactcaaagccaaaactacccagtgacacacaatgagccattaactaaaatagacttaaactgttaaagtgtcttgaaaacccaaataaagctttatatggtctcggctgtcaccaatattcctaagtatttacaatgatgcaaggtctcttagtttgaattctcccagaagtaggcattgagatgagaatttgaatataggttgtttatttgggaatgatccctgaaaacacaggcaggggagcataaaaatgaaacaaggaaaggaaggcagccactgaagaataagtattaatcattttaccctgtgggaaactggagcttaatcctgttgctgaagagtgggagcccgtttggaatacttgcttcagagttatcccacactagataagaggaagctgggatatttatacatgaactcttcatcagtcattgactgagagctgttccaaagatgagaggtaattgaagagtataattttttatccccaagacttccagcctaaagtgcatgaatagaagtgactctgataacaaaagaagccctcagtcatacagattaagtagctgacatcttgaaattggaaagttgcccatatagtaaattccaaagggatattgtacagacacaaacaaaataggcccattaggtatcctggaagagctgtagtacttcaaatccttcagtggttaactgagatgatgataggttccatatgcatttgagggaacataggttatcagagggaaatttgtaaagaaatccaactctagcaatgagaatgtttcagatctccataaaggcaggcgacacatctgcctttttacactactttaaccttcacaccttacatggcacctggcatacagtaagcacagaaaatcttcttgaatgaaatcattttatgatatttactttaataatttttactaaactgataagcaaaggtaagcaaaaaggaacacataaagagatattccatacattattaattttaaaaagaccctagaaccataataaggagcactataagactaattaggatgctttattgaattaaatgcaaaattgtctttgaaacaattttcaaacaattccagaattttttagattacttcgggaattaaataaaagaatacatgaatctaatatataatgattagtaattgagctttatgtaggatgtgtgtatataaatatatatatatacacacaactaaaagtgtatatttataatatgtatacatattttagatattgtatgtacatataagtatgtcctccaagttgtacctttaaaattagtacaatcagattttgctttcctcagttttctttccttctatatcaactgtgaataaatgattttctaactggtgtagggtttctgatgattcatatggtttaaataatttatgttttaatttcatcaaatatttgtgcccatatttttgtgatttttatattcatatttaaaaatataaacaaagtctcctctatactgcatgtcttccacctatatttggattaaaatgtgttgataagatttcaaagactaaagaaaggttgatactaagccttgagatgccagttttcacagcagccactcttgggatagtttgtcatcagcgttatttgccatttccttaaatgaacattggtagttagcaatttgtagttcataagggccttttaatttgtcttcgaaaagtggctttgaacatatgttattttgttaaattatagatgttaactgaataaattctttggttgcatgttttctttctacaatcacttgattgtttcctataaaaccctgctgactttttaaggaacgtgttggaaaatttttctcacaactttccttctgtgcctgtagtttttggagttgcttccctcattataaatgtaattgccaggggttttgtcacaggaatatgatcttttttagttcaaaactttcattctgcttatgtagattgttttttcttatctgatttcatgtcccattgtgttactaaaatctagtggtgaattacctaaagcacttcccaacctgtctctatacattcttttagtgaatgaagagaatacgaacattatattatgtgtaattgcctgtgcatcagatgctttatattgaacacaaatgttatggaagattcatttcatatgtacccatttgcaaactttacatattgtttagaaccaacatctggtcttactgaactcttatttcaggatctccttttagagattaaaccaacccattaaagccaaaaatccatttaacagttattcctaaggttaacaaagagtaaaaataccacactttagccatccaggaaggtaaggtataacatagattcatagatgcatgtatgaaaaccaactgtgaaccactctagaatgtaaagggtaacgaaacccactcgtatttggaaaatagactaccagactttgtaaacttcaagtttgctttgcctctagcatttttccctcattttttttcctagctaggtgcattttgaaggaaatttaacttgaaaagcatgtttctaaagctaaaccacagactgtgcgatgtgaataataatgattcttggcttattgtttttcaattccagaagaaatctgacagaccaggccagcaacactttataatgcttatataatagtttcatacagatctttttttcaacaaatggctctgaaaattagaaaaaaaatatggaacacatagaaaaatgttcaaaatcattcaaagacatgtaattagtttaactaccccttaattctggtaaaccacatgtactactttttactccaggttattcttttttaaaactaagtgtattggcaagaacagaaaaccaaacaccgcatggtctcactcataagtgagagctgaacaatgagaacacttggacacagggagaggaacatcacacactggggcctgtcacagggtgggggactaggggagggatagtattaggagaaatacctaatatagatgatgggttgatgggttcagcaaaccaccatagcacgtgtatacctatgcaacaaagggggacgttctacacatgtatcctagaacttaaagtataataaaaaattttttaagtgtattgggatatattcacatctcatgaaatccattcatttcaagtggacaattcaataatttttagttactttattgactcatgccggcatccccagaaatcagttttacaatgattttacaactaactaataatgatgataaactcatcattgcatttttaactatttttcgtgtcaattctaacttaagaatcattacatgtaatttagttttttacaaaaaatctcatcatgaaaaggcttaagtttacttcacaagcttggaaataatgtttagaatctttccacacattaggtaaaatgtagtatctccctgtaaaactgaagtcttcacacctgtgtttgagaacacttgctctatataggctaatgacaattttctgtaaactactgaggttaacaattagaagtgcaggaacctaaatacatacattggattgaaagccaaatccttgaaagaaacaagtattgctgtatttgtatctgcatgatttcctttttagctttacttatgaaatccaaaaattgagcagcttaaggctattttttctaatgtgttgaaattgtaaaggcgtgtataaacatcaatcagttaatcagttctcaaaattctgagatcaattatgtgaaatattcataatggcaaaaataagtattgatgcaatttacttatttggatggacttaagaaatagaatcgctccaaaatttatggctagctgaaaagttacttgacaaaaattcttcagataaattaatcctgtgtgctggaactaaacaggtcaggccacaagcatcatggaaattaagcagcaggtaatctgtctctgcaatttcccctttgctttctgctcagatttttaaaaatttctgtttgtgaggtataaagttatttattgccactcaatgtttgcatttcttaatcaagtaatatggggcagagaaagagtaaatttgtttgggataaaaagagactgagaagtattagtaaacccaagcatagacaatgcaaattttacagccaaaatagaaattctgcaggcatgattgcttttggaaactgtaagtctctgctggtgttcactttgtttgtataaatatgcaaacagacccaaattagcatattccccacctgcacccttcagaaagctaaactagaaactattaatacacacaatctctttttgtagtacttaatttgttaacattttaattgaaatttgataatgggtttaggatatatacttggaggagaagtagagtagatattaggattccagttataattgtcaagtgcatttcactttttcgtattatatttttaggtgattgcttctaagttagaaaacaaagactgtgctctttaagagtacgcctatgttacaaataagtttctggtatcgtggtaacatggaactagggcttctcagaaagatttcatggtaatcaaaatgttttacattgtatacaatgaccaaccaaaattattcttattttctgaaatactatattgtcccattttttcaagccaaatgagtatttttatgtgtgagtaaattggatagctctgagctaatttccaaaatctgatttccaaatgtttgaattgacttcataagttttctgttatgggaggtctgggattttgcccccttaaaggaagggatcaacctacacaactttcaataggacctctctttctgcttcaattagtctctattgcactttgggtggggttgtcaggcatatacaagccatatgggccaggcatatataggccatatgttaagcaatattttttttctgtttccacgcacatggtgaataatattttgatgcaatgcatacgtctatgttgtccaccatattaaaaaaattttgaagagagataattccttttgaaaactcatgagtcatataacaatgtagagttaagcaatggtgactcactcaggcatgtgatatgtataaggacagttgtcatttctgtaggagtaaatcaatttctttctcactcgcctcagaaggtatttatgtgagaatgaagttataatggagccacagttgaatccatacacatatatatatgcatgcgtctgtgtgtttttgtgtatgtttcaaatttggctcctcaattaaagttagcagtttattatttgtcacacagaccccaaaaacaacagggtttgtgtatgacgcctttgataactctggtctggtgtaacaatgccctcattttcttttcttacttatacgaatgaaaggagccagccaagactaaacaacattgtttattttgggcctcaacagtaccaaccaagaggaggtagtgctagaaaaggggtttagcttataatttagtataaccatctaattaataatgtaagctgactaaaatcagaggcgctaatcagcagagacacaaagcaacatatagtaaacttgtaagtgtactataaactgtgactctttaaacagcataataggtagtagctttttttttttttttttaatgaagttttgctctgttgcccaagctggggggcagtggcgcaatcttggctcaccgcaacctccgcctcctgggttcaagcaattcgcctgcctcagcctcccaagtagctgggattacaggtgcctgccaccactcccggctaatagtagtagctttttaaccaaagctgctataggctgtttgtttgtttctttttttgagacagagtctcgctctcttgcccaggctggagtgcaatggcgccatctcggctcactgcaagctccacctcctggtttcccgccattctcttgcctcagcctccagagtagctgggactgcaggcacccgccaccacgcctggctaattttttgtatttttagtagagacggggtttcactgtgttagccaggatgatctcgatctcctgacctcgtgatccgcctgcctcggcctcccagagtgctgggattacaggcctgagccaccgcgcccggcctataggctggttttaaacctgtgtataagttaaacatcaaagagtgcatcatagacgtctttcactatctgaatgtttctgtcccctccacatttatacattgaaacccaatcatcagcgtggtatgatggctcatgcctgtaatcccagcacttcaggaggccgaggtgggcagatcacttgaggccaggagttcaagaccagcctggccaatatggcgaaacccatcactactcaaaatacaaaaattagcccggcatggtggcacatgcctgcaattccatctactggggaggctgaagcacgagaatcacttgaacctgggaggcagaggttgcaatgagccaagattatatcacagcactccagcctgggtgacggagtgagactttgtctcaaaaagaaaaaaaaaaattaggacatgagcccttggaaagatgatgattaggtcatgagattagagccatcagaaatgggattagtgctcttataatgaaggctccatagagctaccttgtccttccatcttgtgaagacacaatgatgctagaatgcgcaatctatgaatcgggaaatagactctcaccagacaccaaatctgctggcaccttcatcttgaacttgccagtctccacagctgtaagaaacatccattgtttataagctgttcagtttgtagtattgttatagcagcccaaatagattaagacaagaactctgggtttaaagagtgagaaaaaaaattacagcaagattgtatacatgccaaatagccagctatttctttagatagcttattacctctctgtcaagcagaggtcttttgcttgcttgaaaaaagttctagattatatttctctactgcaattgttttgaaatgcatgttttattgtaactcaggtatggtgcggccaacagatcaggagaaggttgccactaaaaaatagagactatggctgggggtggtggctcacacatgtaatcttggcactttgagaggcaaagctgggtggattacctgaggtcaagatttcattaccagcctggccaacatggtgaagccttgtctctagtagaaatacaaaaattagccaggcatggtggtgggaacctgtaatcccagctacttgggaggctgaggcaggagaatcacttgaaccaaggaagtggaggctgctatgagctaagatcgcaccattgcactccaacctgggcaacagagcaaaaattccatctcaaaaaaaaaaaaaaaaagagaatattccatgtcacataatgccacaaagagaagcaccagggtcagtcaggaggcagagggagcaagggaaaagcatggatgggagcatttattgtggtttcatgagaaaggcaagacagggtaaacagagtcggggttggtttgcttgaataatttcagttagctctgaggtatagggactgtctctagcagtctggtacctgaccctgacaggattaggacagaagaatattgcttgctggaagttaagagccagaaagaggaggtgtttcagaggaaaggctctggattggttagtttgcacatgaaggcatgttcctggactaacatttgctatctctaagaattgaagaattgactagccctagaagagacaatttcttcccagtcagtgaggcctcagatgccagagcatcaggaatacaaaaagaagaaaatattcagagtaacttcatatattgatatactgatatctactaatataaaccatatgttttacttcttttaatattgagtaaaacatacaatgaattattctattcataaatttgaaagttaatggcctttcacaaatatatatcctccaatcaagatatagattatttctaattactgtagagtgttctctgctgttcacttccactctatagttgtagtttgctaataaaagattaagaccagcacatattttgtttagtgtctgaatataacataacataatatataatggcatttcgttttactcctttctatcctatgcttgggcacagcacatgagccaaacaacccaagaatagcctttccgaatagttttcctaccattatctgttagaatggagggtgggcaaatatcaatcctttcttgaactaaagatatatttaagttacatctctcaacttttgcctctaattaaaagtgaccaaaaccttttttgagaagctccacagagaatcctgcaagcatccacctgccctgtgctggaactgccctggctgttctagccctgaatgaccctcactcagaacagatttatgacctcagcagtgctttaagacaaacaaattaataagaaacaaaacttcacagtgtggtcagcctacttcttcttctttttttttttttttttttttttttttgagacggagtctcactctgtagcccaggctggagtgcagtggcgcgatctcggctcactgcaagctccacctcccgggttcacgtcattctcctgcctcagcctcccgagtagctgggactacaggtgcccgccaccacgcccggctaattttttgtatttttagtagagatggggtttcactatgttagccaggattgtctcgatctcctgacctcgagatctgcccacctcggccccccaaagtgctgggattacaggcgtgagccaccgcacctagccagtcagccaatttctaatctgaaatttgttctgcattgatttcagcttgattttatagaatcattcaaaaccacatgttcatcagccatatactttcaatagttgtccctcctcgatctttggagccatctatactgagataaatgtgatttattgttcagactaaaaagttgtataagatactatctaatttttttctaaggtttcatatttagtccttccaattttgattatcaactgtagttttaaagtttctactttgtcgtcttaattttgtggaaaccagtgaattaagacaacaagcagaagatattgcctaaagcaatcctgcattggttggggactcgggctattaaaattccatcaaagttaatgttcttacccaagattaacaaagccagtagatagacatatttttcacttgcaaatctaagctatattttctggaaagtgaaagacagaaacttaactgaatttaggaattttgcaaaattgtttttcgctctctgggaataaagatttgatcttctccttgtggattgtttacattttctctgaaatgtatttttctaaaacgtttaggctctaacaaacagaagtgtgaagcatgtatttttcatacataaaattaagaatattgccttttaaaaattcacacaattaaatgcatatctgtctaagcattttgagggtatcttatgtttcaggtacaattgatgaaaaaaagaaagaatgtcatagatgcggttgaatttcagttgtctcatgttaaaagaccaccagatccgttagcagcttcatatgatatatgtaaagaataagcactaggctgaaagatgcacataaatacacacatacacaaatatttagatgaataaccatcattctcatcaccttgtataacaatgtatggatgtcccaggatagggatcactagatgcttaaactgcagatgtattatatgtactcacagccctctaaaggacctaaagagataaaaatattgtagaacatcccagaaaagagataagaatattgtagaacatcccagcaatccaaggatcatttttctaaaacatactgattttatacacacacatacataaatacaaatattatacatacatatctcctctaagagtcacagtattttatgataggtttgctaatatactgcattttctaaaaggatttcattatgaaaaaaaattatttgctctatatgtattatttcctaccaacataatttcttattttagagataatcaacttcagcttcaagtggacaataagagttttaaatatagctgtttatcaatattaacctcttatatggtttgactctgtgtcccacccaaatctcaactggaattatagttcccacaatccccacatgttatgggacggacccagtgggaggtaattgaatcatgggggctgttaccctcatgctgttctcatcatagtgagttctcgcaagatctgatagttttataaggatcttttctcccttttgcttggcacttctacttcctgctgccatgtgaaggacatgtttgcttcaacttctgccatgattgtaaatttcctgaggcctccctagtcctgaagaactgtgagttgattaacccactttcctttataaattacccagtgttgagtagttctttatagcagtgtgagagaagactaatatagtaaattggtaccacagagagtggggtgctgctataaggatacccaaaaatgtggaagcaacttaggaactgggaaacaggctaaggttagaacaatttggaaaactcagaagaagacaggaaaatatgggatagtttagaatttccaagagacttgggaggcttagaagacagaaagatgtgggaaagtgtggaacttcctagagacttgttaaatggctttgaccaaaatattgatagtgatataaacaatgatgaccaggctgaggtggtctcagatggagatgaggaacttgttggcagccggaataaagtgcttcttttaatagcttggcaaagagactggtggcattttgcccctgccctcgagatcagcagaactctaaacttgtgagagataatttaaggtatctggtggaacaatttttttagtagcacaacattcaagaggaagcagagcattaaagttaggaaaatttgcagcctgataatggagtagaaaagaaaaactcattttggtgggggagaaattcaagctggctgcataaatttgcataagtaataaggagccaaatattaattgccaagacaatcgggaaaacatctccagggcatgtcagatatctttttgacaggccaggaggtcaaggagggaaaaatggttttgagggccagtccaaggaccccctgctgtgtgcagcattgagacttgttgtcctgtgtcccagctgctccagctgtggctaaaagaggccaaggtatagcttgggccatggcttaagatggtgcaagacccaagccttggcagcttcttcctagtgttgagcctgcaggtgcactgaggtttgggaacctccacctatatttcagaggatatttggaaatgcctggatgtccagtcagaagtttgctgcaggggcagagccctcatagagacctctgcaagggcagtgcagtagggaaatgtggggtccccagtggggcactgcctagtgaagctgtgagaagaaggccactatcctctagaccccagaatggtggatccactgacagcttgcgttggatgcacctggaaaagccacaaacactcaacaccagcccatgaaagtaaatgggaggagtgctgtaccctggaaaacccaaggctgtgggagcccatctcttgcatcagcatgacttggatatgagacatggagtcaaaagagattatttcagagctttaagatttaattattgccttgtttgattttggacttgcatgggcctggagtccctttgttttggccaacttatttcatttggaataggtgtatttagccaatggccgtaccctcatcgtatctgggaagtaagtgacttgcttttgattttacaggctcataggcagaaaggacttgacttgtctcagatgagactttggatttgaatttttgggttaatgctggaatgagttaagactttggggaccattggaagggcatgattatgttttaaaatgtgaagacatgagatttgggaggtgtcaggggtggaatgacatggtttggctctgtgtccccacccaaatctcatcttgtattataattcccataatccccatgtgtcctaggagggaaccatgggtgggaggtaattaaatcatggggacagttacactcatgccattctcatgatagtgagtgagttctcatgctatctgatagttttgtaagggcttccctgccacttcactctgcacttctccttgctgcagccatgtgaagaaggaagtgtttgcttccccttctatcatgattgtaagtttcttgaggcctcctcacccctgagtaactatgtcaattaagcctctttcatttataaattacccagtcttgggcagtgctttatagcagcgtgagaatgaactgatataacctctttcacactgaagcattatatttagaaatctatgattatcccctagattttcagaaccatatcacatatatcatatgtatgaagattgctctaattctgtgaggatactgggagatattaaaaagaagaagacttttatatttttataacaaggaatatgttgattaattgttaaaatgaaatataagatttcattttggtgaatttatgcaataaatgactatgaaatgcatacttcatttgtcattacttttttaaaattttttatttctccacgctgagaaaaggataagattataaattataacaaaattctccagtctttaaaactactttagatctttaaaattcaatgattaaaattttggagttttagtctttagaaaagactaaatcttgtgtatactgttatcaaaaaatcgggggaggaaattctggtcaaaatttattttcagtgtattatgtcttagaatatttttctcccagcacaattaattctattgagaaaattacttttctttttactatagaaattgaataacataagtttatagagagtagtctctcttctaagcacattttcattgccattttgattttaatttttttattttaatatcacgggctaaatagaacttatttttcagaggaaccagccagaaaatatgctgtatactttattccaaggctaaccaaattccatggtagatttatgcaaagccggcactatgctaggcacctaagattctgagggacatacagtctagtgggaagacatactgtaagcaaatgatgtaattacaacacaatgcagtcagataaataatgggagaaggagcaactatactgtaagagggcagaggaaggacctgatcaactattgcctaagggactcaggagaaactttatgagggaattatattagcaaaggattttggagactaatgagtagtagaagcagttttccaggtggaaaagagagagatctagtgttgcagacagggagtacagcatacacaaacaactgaaaaaaagaattgtctttagaattttagctttgtatggagagcaataaatgacaaagctggtatgtatgttgcagtcttgtgaggagcactaaataataatgaaatgaatttcaaattttgtatcctactgtagtccaaagtttcccaactctttgtgatcctaagagttatctgctatcatcttcttaaaaatacagatctccagaccgttctgttggagcttattatttgcttaacattttagaaaacctagatttgaaattatgtgattttgaaagagaggggaatcaatgtttcatttgctttataaaatactaaatcatcaaaatgtatagaaagttgaaattctgaaaatattaagctgaaagtcatagaatccaatgcagttggtaaatggcaagggtttgaactaatccacggctggaaaagtagaaaagtgatcagttttcagaaagttgagctgattggcaagctgaattattggtgagaaaaaatataaactataactctgagattttgaactggatacactgcaaattgataaggttttgtagctaaaatagaaaatcagaacaccaggtttggggaaatcagtgtaggaatggtgagttgaagaacattaagcaatgaatgattatgctaaatcaaacccaagagagtttctagatttaacagaagtgttcacttctgaaaaaactgagaaggaaatgttcctcagtaggcattgtaatgaatggtaaagaaaaataagagactaatgcttttaaagtcatgtctgattcaaaagaaaaatctttcaaccattcactgcatatattttcccatggagacaatttttaaaagctttggctcacttagaaaagaaatcctgagccctttttgttattactttaacttgtccaatctctaaatcacagagatacctcagaggttcattagaaattcccaaatctagaaagaggaaggtcccaataaaaacaaataaaccaaaccagatcctttatgggttgaattttgaagttttcacttcctgattttaaggaagggtcatattttagaggcagaataatggcaaatatagattttaaaacaccatagttaaaacaaagaatcccttccatgtctgtcaccagatctggcagacacatgtatcaagtgtaattctaacacaaattgtgaatgacgcaagtctcatccctaaccagatcccttcacaaggagacactttctagccaacatttttgctttaccattgtaatttgtttttctattattttattgagtgtagtcaatgactcaggttacaatgtgcaaaaatcttccttctgtacttcaaatagatgaagaaacaatcttttagaaaaagttcttctctacttctcggctgaggttcaattattaactttttttaaatttttttgagactgagtctcactctgtcgccctgactgaagtgtggtggtgtcatcttggctcattgtaacctccacctccaggattcaagtgattctcctgcctcagcctcccaagtagctgggattacagtcacacaccaccacaaccagctaatttttgaattttagtagagatggggttttgccatattggtcaagctggtctcgacctcctgacctcatgatttgcccacctcagcctcccaaagtgctgggattacagatgtgagccaccatgcctggccaattattaactgttaagagtggtactttggccgggtgtggtggctcatgcctgtaatgctagcactttgggaggccaaggcaaacagatcacttgaggtcaggagttcaaaaccatcctggtcatcatgatgaaaccccatctctaccaaaaatacaaaaaattagctaggcatggtggccttcgcctgtaatcccagctactcgggaggttgaggcaggagaattgcttgaacccgggaggcaaaggttgcagtgagccaagatcgtgccaccgcactccagcctgggcaacagagcgagactccgtttccaaaaaaaaaaaaaaaaaaagtggtactttgcatctctccgttatatatgtcaactagtcattgcatgttgctgattcaagaggctgtcattgcagtggcctggacttagggaagaaaacactgtgagcaagtcaacccttggtttccagaaagttatgtcttcttggaagagaaattgaaaagcattttttttttttttttgagacagagttttactcttgttttccaggctggagtgcaatgacatgcaatctctgctcacttgcaacctccgcctcccgggttcatctgattctcctgcctcagcctcccgagtagctgggattatgggtgcccagcactacatctggctcgtttttttgtatttttagtagagccgggtttcatgttggccaggctggtctcgaactcctgactgcaggtgatccatctgcctcagccttccaaagtgctgggattagaggcacgagccactgcacctggcctgaaaagcacttttatatcagcttttataaaacacatattactagatatatagggtgaaaatatctgtctagtcctatgtcatgatcgaagaaacatttgaaagaagaatagattgaaagcatcatgcaattccactgacacacagttaagagtttctttagtactggcggtgtttggaagttttcagtaccgctgtgtaagtccggagaagcttcatggagaatggtcagctgtgtgatgcataagccacccctccctcttagtcttaactatttttttctcctttatttgtatttttttcttttcttttcttttcttttcttttctttcttttctttttttttttttttttgagatggagtctcgctctgtcacccaggctgggtgcagtggcgtgatctcgactcgatgcaagcctgcaagctctgcctcccaggttcacgccattctcctgcctcagcctcccgaatagctgggactataggtgcccgccaccatgcccagctaattttttgtatttttttttttagtagagatggggtttcaccgtgttagccaggatggtctccatctcctgacctcatgatccgcccgcctcggcctcccaaagtgctgggattacaggcgtgagccaccgcgcccggcctatttgtattctcttaagaaatatttcatttaaaatataatcaataccactttacaaagtatattatgtctcctttctttatagttttacaaagggcacatatatcagctgtatccagaatagcaaaaattaaagatcaaatattaatattatttctctctcttaaataccaatacaacaaaaatgtattttacataccagacattattttaaatttgctaaaaattattacctttatacggttttaaattttctttttaccagtttcttcatttgtttttctacaaaactatttgctaacttgcgtcaatgcctgcaccagtttctcagcatcctattctgtcatcaacttctttctcttaataggggaaccatttcagtaatctatcaattagtttgtgtaagaggcagaaaattaaaaatccggaggggcgcagtggctcactcctgtaatcccagaatttagggaggctgaggcagttggatcaactgagatcaggagttcgagaccagccttgccaacatgcgaaaccctgtctctactaaaaatacgaaaattagctgggtgtggtggcacgcatctgtaatcccagctacttgggaggctgaggcagtagagtctcttgaacccgagaagtggaggtgcagtgagccgagattgcaccactgcactccagcctggacaacaagagtgaaactccatcgaaaaaaaaaaaacctaggctatcaggtcatttactggcaattgcgattttagcatctataccagcatttttgccaaaaaatccctgagatttctcttccttcttaattttgcctgtagctctcagcatttttccagtcttaaggaagttgaaagttttttttttccattttgtttaaccattaacttccattctctcaaattgcaaatttaaaaaacagaagaatgaaaagaaaataaatctgtcatacagtgtacactgcaatatcatgaatttttgtacagaaaaacactgatttaaagaatttctatgaatttgcaaattagtaatttgaacaaatcactctttgatatctgaaaattaatgaaaagcataatttgtatcactttctcattaatattctaaattgtgtcacagcacataaaaaaatcgataaattatacctcaaaacatgaattaaaaagtattctagaaaactttttaaaagcattgatacaatggagtgcccagagaatttgtctctttctccattatgttttattatgtccacattatttatcaggggaaagaaaaacaattcctattaattatttattaatattaaaatattgatgagtattaaaaagtaccgggcttccagctggtgtactgagttgaacttttctgaaatgcagccagcacaaggggcgtgtattaaaagagcagaacaaatgacttattaggggtccaaaagcagcaatcagaaaaggttcatttaacatagcgatggcacaagcttcaagcaattgcctctacttaagtaagtgtggaattacaaaagcctatttattacagtccaacagggtcctgcagcttgctcaaagagctttgaagaaattcaacagttataaagtcctgctcagtgcagaagcagtaaaatttggacagacccccaaaacagcccacaaagctttcatgaaaaagttaatacaatcctcatcgcaattgttctttgaaatgaattgttttctcacttttctttttttaaaggagagatgctgtacctggttattttcaaaacttctttgaaaatgaattttaaccactaggaaaaaatgaaagtttcatggtggtatcaaattaaatgtaggacctcatgtgttccaacattaagcttcttgaaatgctcttgaaaccaacattaaatgtgactccgttaatggacttacttcagcagaaaaattagtagatttcctcattgtagaaaatgcaaaatttgagtccaaagacactggggctgaaatttttttattagtgattggataatgatttgatttttctaagtattaaagtaagcaaaaataaatttttttttaaaaaatccacatatccatttatttataattcagcaatacatttataaatatagaatatgtttatgaagcttcaactaaagtataagaaaaataacttatcttttgcttggaatcaattttagagagcaaattgcagggttgtgggggtgaagccaatttagggactaaaatagaggattattgaatagatgaagaattgataatgaaaggtaaatgatgttaatttgtatgaaaagatattaattcctaatgggagcaaaaagttggtaagaaaatgaatttactttttcatcagaaaagcaacacctacatttttccttggcaaaagattaagtcaggccaagtgtggtggttcatgcctgtaattctagcactttgggaggcctaccggggagaatcacttgagcccaggagttcaggatcagcctgggcaacatgacaaaactttgtctctacaaataataaaaaattagctgattgtggtggcacaagcctgtagtctcagccagtaggattgctttagcctgggaggtggaggctgcagtaagccgagatcacatcactacactctagcctggaaaacaagggcaaaaccctgtcttaaagaaagaaaaaaataataaaagattaagtcatcattcccaggccaatccatgcttcaattagaaggtgttcctatgagatctcacaaataataaaacccagttgatgggaaatattgcagtagattctattttttggtgtacagttttctctgaagtggcacaaggcaagcatcatgaaagtttctattataggtgaagaataaaaatgaaaagtgtttatagataggaaagtttgaatgagaggtcggatgcaaaaatcatcatgtgataatcatagaaacatcaacaaatacagaacttctgctaacttgtgggaaatacaaatacatgaggttcttatggtccttgatttgagaaaaatctatataaaaataagtgctttaacaatgaaaacaattcaacagttaatgtatctaaagattcctgagtttttgtttgttgtgtgtttgtagtttattttgctgcattccattaaggcagggtgccactgaactccagtgagacatttcgattggcgagtgaaccaagattgagatttgaaagcagaagtactttgatgatagtatgcatttttccttttaatggaagggtttgaagaaggaaatcacttaaaatatttttaatcttcagttagaaatgaatttgaccctatgatatctgatccaaacagatggggtttttattcatattccatactttcgataatgcttagcaaaacatagcaaatgtagaatcaccatcaaataagacatttcaaaacatgtctaggtaattgtaacacatatagcagtcatttccttggtacctctcattaagtatttttttaagaaataaaactgtacaaaagaagattgttgttccttttctttgtagtcaagagatgtttgtcagaagtcaaggcctactgtaatatgtcctaaatcatatctattttacaatatactaaatattattattacctatggataccatgggactccttgtgcataatggattccagtcctcttgcagagctgcatatgaaaatgttatcaatgagctgaagaatctggcattaataactttgcaacattataacaaataggtagtcctgatgttttgttctttttttaatacatcaaatatatttcattgcttacattatagtagcagattgaaaacatctgctcacttgccactagtccaccagcagcagagaatctcagcacattttccctaggcctgcatgtaccagggctataatccagctgttgagtctggatatggggccagattaatattcaagagccttggaaatggaaatagtgctttcttgccaaaaaactggaacaatgatagactccatttgcatgttcccttctccctctgttcttattcgccaccctttctaacccattaatttgcttccttccaccttcccctcccatcctctctttacagctccatcacctgtcctgacgattaagaaagatcggacctccagaaatagcatctctttgtcctggcaagaacctgaacatcctaatgggatcatattggactacgaggtcaaatactatgaaaaggtggggaaacaatgtttaagggttgggctgtgtaggcaagaagctgtttcctcatgagctgtgctcttgcaaagaaaccagtgacattcctggtaaatggtagagcactgtttagaactgtggccctgtgacccctttgatttattggtagaggaaggtttagaaagaatcttgttgaataccccctattctacagcaataaacaacatcaaagatgccactgccaacttaatccagttacttatggcaatagcatgacatttatctccctttacaccaagacccctactctaccaactattttattgtggtttcttagtctatttgtgaactgtttttttagttcattgcctcaagcatcatttcctgaccttcaaatttacatgcatttcattcaatacaaatagcaacattgtgctagtaagaaaaatattgtattatttaactgatgatgaaaagattttcttgaccctgtagaaggaaatttaaaaggttggggatagatggataaatttgcgtgacataaagttgtggcttggtaatgcaattattaaaaaaaataggcacatggttatttttaccccaaatttaaaaattattaaaaaatagttatgtggttattttgccctgagtggagtggcgagtattccatcattctaaataactcattttttttctggttgtaaatgatagtaaagtttaaagacaagatatgtttaaaccttagaatcacagctagttagtttcacaactactaacatgaacactacatatttgtgtatctacttcagtttataaagtgtgttaaaatgaattaaatgcaaattgtgcatttatatagcagtttatatttacagaacatttctgtggacattacttaagtctgagctgtataacaaccttatggaagtagcaaagtaagttgttttagaaataagaaaacagagagtgatgttatatgaatttcccacagcctcattgctaataaatattaggcatctgttttgaattgtggcagccgtgagtcctcctttagtaggtttttccctatatcaggtacctttttctacatgataatagatccttataagaattattggcataatcaactgtgcaaactgcgtaatgtaaaaacattgttttgcattatgtagttatttccttgcttgaagttaatatatttctctagtataatgtcatttttttcatagtctctcttacagaaagcctagagtatatcttttttattaaaagaaattgatgccaaataaacttcattgttcaaaaattgtagtagaaataaattttctcctagctttgagtcctctactgtggtaaagtcaaatactcataggattgtgatctattttcagaagtgtgacaagatagaatgggcaaatataataattcatgttcataaatgatgccacaaaattcttaaaaatcagtaatgtgcctcagttcaaactagatttcaggactgggagaagaacacctaacatttagatctatgaggttgatctcaaattttaattgtatacatctgcacctttcacaaacatgagaaatatgctgccttatttcaaactccctcaacaaatgcaacaagcatcattgccttttttttttttttttttttgagatggagtttcactcttgttgcccaggctggagtgcaatggcatgatctcggctcaccgccacctccgcctcccaggttcaagcgattctcctgcctcagcctcccaagtagctgggatgataggcatgcgccaccatgcccaactaattttgtatttttagtagagatgaggtttctccacgttggtcaggctggtcttaaacttgtgacctcaggtgatccacccgcctgggcctcccaaagtgctgggattacaggcgtgagccaccacccctggacattacttttaaacaatattagctattgcaggaaaaaatggtcaaatctattgattattccctaagtattttttgatacatacatacctgtaatattatttaaaatatattcctttaaatacatatttgcatcacatatacctaaatttaaaaattaattctaaatatttatagtatgcttggtaatatttagaaagattctctaggatttaaggtccacaaggtctagatttctggactggttatttcgctgatggtgattaacagtatatgtaatgtatggcatgttttctgtactattcaatctcgttttggttgaggatatacagcgtttcatattatccactctaggtcctactctaggtgcagggacattgtaccattgcttgaaatcaggttcctcataggagctctgtgtataataatatatgtgagagaaaaaacgtaattcttgataaattcaatttttgtaaacaaagcttgacacaaagagaccactaaaatgtgtcgtgtgaatctaatgtacaatgtgaatctcctagagatcctttttgggaagcatttctagcctttgatctggagatttttgtctctaccaaaccacagtgacttagattaaatacagcacaaatacagttaagctaaaaataatgtagagctacatataaaaccttgattttttatgtttaatattttaaggttgataaaaaaaagttctactccagaatcaatagagcattcctattaggtttaattcaaagggatattttcttctttgtaagtttgttattggaattagatttaagctttctctcagccttgactttgaagagaacatatcttctctcacatatttactggttagaataaagccaaatttttcctgctttacatgcaggacagaaatcataatattcaaattgggaaattctgtaaatatttttatttttagaaatgcccatgttgggacaggtgcggtggctcatgcctgtaatcccagcactttgggcggccgaggcaggtggatctcctgaggtcagcagttcaagaccagcctggccaacatggtgaaacctcgtctctactaaaaatacaaaaattacctgggagtgatggcgtgcacctgtagtcccagctactcaggaggctgaggcaggaaaatcgtttgaacccaggaggcagaggtttcagtgagctgagatcgcgccactgcactccagcctggtgacaaagcaagactttgtctaaaaaaaaaaaaaatgcctaagttgcgttcagagaataaaataattgaaataatcgatatgactttttaaatccatcctatgatttgtgttaaaatataaaagaatcaggtttgagtggttcactgtttatcattttatagcattatgaagatttgattttaacatgaatttttttttctgacctcaaagcaggaacaagaaacaagttataccattctgagggcaagaggcacaaatgttaccatcagtagcctcaagcctgacactatatacgtattccaaatccgagcccgaacagccgctggatatgggacgaacagccgcaagtttgagtttgaaactagtccagactgtatgtattatttcaatgcagtctagaggagggggcagggatcttgcaaaagatgtctgatcgtttattctcactgtttctaagttttaaacaaatgtgatacatttaaggtatattgcttgggacattgcaatttgcagagccctgtgtctgtatacagtatttgtgtttgtgtgggtgtacattttgtgtttctttttttcttgtatgcaaatcaaacatattctaatgcctgaaatgcttctgttttttttttttagccataaattgcttttgaggaacattatttaatatagtaacacacttccagtgtctgtcatttcagatattccaggttcattgcgtgattcaatgaaccacaaaaaagaaacttgctgatccatgagaatcttaattttgttttaatccttaacacattcaatagcatatcacagagagaataaggattttctaaaatgtgttttatcacttcattcacattcagaagtaatttgaatagcctgttcctttaaccccaaatttggctaaaattggcctaaaactggcaaacatttttccagtaacttttctttttttcaaatgaattttcttcatacttaaaaaagccctttgctaaaatataattttcaaaaaggtaaaattatgtctatggcactaatataaaatgagtagaagttaatgattttacttaactcatttttttctttctttctttttttttttttttttttgagacggagtcttgctctgtcacccaggctggagtacagcagagcgatctcggctcactgcaagctcctgcaagctccgcctcctggcttcacgccattctccccctcagcctcccgagtagctgggactacaggcggccgctaccatgcccggctaattttttgtatttttggtagagtccagatttcaccgtgttagccaggatggtcttgatctcctgtcaccttgttagccaggatggtcttgatctcctgacctcgtgatccgcccgcgttggcctcccaaagtgctaggattataggcgtgagccacctcgcccggctgtttaactcattaattaataaacagattagcaagagattaaaacctgtgctaagaaaaacttgaagaacagatacataattatgtgtgtgtgtgtgtgagcgtgtgtgtgtgtgtgtgtgtgtgtttaggtaatcataatatgctaaaaatgtgctaatatatcccacactggttaatatccaatgagggtaataaatgtaatgattgaggtcatctttcttacagggcacaaaccagttgtctttctagtaaataagtgttatttcaattgttaaaggaaaaaggatatatatcactatcagttttctacaacttaaattcactgttgtaaggtagcctagaaagatgagcaaagatgcacaccctttagaaatagattacccaggaaaggtctgacaatgctcaacactctgctgaatggaatataataatcttctgaccattcccatttcccattcttccctgacacctgtacttcccattttctagatagttagttcctgacataaaatctcattgttactggtatatttttgtgtccaaatttgatacctgataaaaactttcaggattgacctaaaaatataagaatcattctagttatatagtatttattccatcaagtttactcatgttggagtacatattttatggcacactttctgtcggacaattagaaatgctgcttacaataaggagctataaatttcaccaggtattgaaatgttaatgtttttagaaatcatctgctcatagctgaaccatgacaattctactcaaaggagagctgccatcctcaaatacgtaaatctattcttaaagacttcttttaatcctcacaataaaatgtgtatggagaaatcaccctcagaagatattagaaacaaaacatgaagtatgatggaaataatgcaagtgccaacaaggtttaaaacaaattaaaaactttagatggctcaataataaaatataagtgtaacttaacattagtacttctaagactttttgcaaatgttaagtggtacgaagaaagtttctccttttgaaatgattacagattaacttttctcaaaatctctttctttttttgtgacaaaatcctgctctgttgcccaggatggagtgcaatggcatgatctcagctcactgcaacctctgcctccctgactcaagcaattcttctgtttcagcctcccgagtggctgggactacaggctcatgtgcccacgtctggctaattttttttgtatttttagtatagatggggtttcaccatattggtcaagctgatcttgaactcctgacctcagggtgatccacccacctcagcctcccaaagtactgggacttaaatgaatatttgaaataacagcaataacaaaatctatatttgatttatcaggagagatccgaaatcatagaattagcaaaagctaatatttattgtgtcctgtggtagaaatcaggcatattatgaggcaaaaagctcagatcactattagataaacatgttttatgcatatttgggaacatccctctaatattacatggtcttaacacttaaccctctctgataagtaaatttgcaaaaacaatatattttaaaattgtaatgtaattccagatttaccacagatattgctgtggtagcatttatgcataaccttctaatgaggcttcagtgtctgaggtttaggaaatatctcattcgaaaactgcagggccttaggatttttgccaagtaagttttgtattagcaatgcttccattgattgagagagagaagaggaaaaaaggatggaaaaatatgagcctttttctccctcctcatttatttaaaaactgtgagttacacattttaatctttttacaaaagttagtttacttttgcccttatttcaccataatatttccagattttaaatataaatgagaaaaaaatgccttttgtcttaggaggtaaaagacaaaattttttttgtctcactctccctattgtttttattaaatcaaaatgacatattcctaaatgctgtaagtatttaataagactcttatttgttatatattgatttttttaaaaaatagacataagacttctgtttgtatttaacagtttgctttttccctctcgttttaatattttattttatttatgtatttatttattcttttttgagaccaagtcttgctctgtcgcccaggtgggaatgcagtggtgagatctcagctccctacaaaatccgcctcctgggttcaagcgattctatagctgggattacaggcatgtgccacaatgcccagctaattttggcatttttagtagagacggggtttcaccatgttggccaggctggtcttgaactcctgacctcaagtaatccgactgccttggccttcaaaagtgctgggattacaggtgtgagccaccgtgcccagccggttttaattttgtaattacataagaatgtctcattcatgacatgtatgcatatttcttggtagaacacaatgtattttgagctggaatttagataacattttctgaactttatagggaagagatggaggcagagcagagcacatattgttttctaagtgctttaaaatatcttatttttgtatgttggtattttatatttattatcatcttcattttacagttgaggaaactgagacaaagggaggttaaggaagttttccaaagtcacacaattggcaagggatacatcaattccagaatccaggtttctacatgacagtatataaagcagtatgataaacatttcatttgattctgttctataagttattcagatactattgtatccttttatacatgatccaagatacagattttgtgtgttttttttctgagtttacatatgtagtcagatggggcaacaaacctagaatctccaggttttgaagtcttgaaccgtgcaattattgcacatgaaaaaaaaaatactaagctaagacccatagaaagcatggagtataaaagagtaaaaggattttcctagcatgaaggtagcttccaccaatacaagaagtacagacattagggcatgtttggaaaagcagatagtccaattgtttggaaaccctcagtggggaaaaactgaagccatggtgtgtgctttgtgcacaagaaaatcagggataaagtgaaagttaagatcaaatacattagagcagctgagcattattagggtgaacttgacaagtcatttcaagtctccgtgtctcagtttttctatctggaaattggggaacatcatgtgataactcatgagattttaatgtttattaaatatgttattacttgtaaagtgcttaaaatagtacctcatatagcctcatatagtaggtactcactgtgcatgtgtgttgtgtttaaacaaatagtccgtaatttgaacatctgaagaatttcaagaataacaatctgtggaataaagttgagttttaaaattagaggatttcattggatattattatgaagaagacaaccccagggataattaaattagcgctcccgaaagcctcacaccctcattatttgttgttttgaagagtaaaaatggtacaactttactttcttgggccctattactagggaacataaaggaagcctgacaaagggagaatggaatcattaaatggagaaatttctatataaaaattaggcattcatcatctatcattttgtaggaaatagagtacttttgcaaagttttaaccagggaaatgatataaacaattgtaacatttattgagcacttaatatatgcttggcactactgtaagtgttttactagtactaactcatttaattctcaaacaacaaaattatgtcacacagcaaacaaatataaatccaggagttctgactcaaaagaatgaactctgaatcactcttttgagagagaaagccagcactctgtgtaggatggagtaaaatggaaatgaatagaaacagagggagcagaaaacaaattcaagttgaattattaagaaatgtaatagctatcaattacattaaattattagacacctatgtaactcatcactattagtcattcacatatttgctaattttagcaatggaaatgatctgatttagttatgtgctttagatagcctctgtgagtcatatattttagagacagaaaaaactgtggagaaatcctagtttaattctgttttcaacagaaaaagaaatagataattattttttctcctatcatagttcccttcccagtttcactgagctttattttataagctggctaatcaaaataaccacagaattcaaaccttgctgctttctataaattattacagtatgcaaagtgaaaagcatgagttcaagtcaccactatatgtttatggagcatttttgaaatattggattaagctatttcacaaatcattcacagatctgtagccaatggatagggatgtaacagccagatgctctgggaggaagatacaaagatgaaactataagagctttataggagaaatatttgtgaaggataaaaggcagatggagctgagccaggcaagcagaacctcagactgagatgtaggtctgtcatttataaaggcaaggagggaaagaagaaagagttgaggaggggaagccccagacagcagtgcagctctgagggttttggccaagccgatggggagtttcagagcacagatcacccatttgaggagtgttgcattgggcagggatggccaggctccagtaaccctttgccagtactgttaagtcactaaggggtacataacctgtgcttgaaggctgtagctgaaggtgctgcagctggaggctgtctgctgactgtactctctgcagcaggaacatctgagcaagcactcctgtgactgccatagaggtataaacaatagtttgctggtagtaaagagtaaagggcttacaacagtttatattatgagtgtgccatcctgccacactctgagcacttttcttcagatgctgctcacaggaaactcctaacaacctatctgtcacgtttcttttcttgcattatttaactaaccctaaaaccacatattttagagaaaatcttccaaacttagatttgttcaggctgaagatgatatgttggctcctggggaggtgatagtattcagataactaaaatctgctcttcttttgagtcctgaggtattcatgtacttaatcagcatttaccgcaagaacaacatatgcaaataagagcataaaagaggctgttccaggaattgtgtgtattttaaaatatctagagattaggatgcttatggagtttgtaggagatgtggctggggatttaaacatgaaacagattctaaatggcttttacacgctctgctatgaaatttgcatcttatcctgaaagttataaagagccaaaattttcctatgcaaaacttttatgcataggaatgacatggtcaaattcatggtttagaaggaatattctgaaagataaaatgtgtggaaagcatacaaatagagaccaaattaggaatttctaattataattcagaagataaatgaagacttaaactaggatatttaagagtgtttggtgattaactggaggcagaatgattaggagatggagaggagaaggttattttatatttatggtctagattcttgctcctcaaaatgttgtggtctggaatcagcagaatcagcactgcctgtgtgttcataagaaatatacaatctcattccccactccggaatgactgaatctgaaactgcttttccagagattcttgagtggtttttgtgaacattaaagtttgagaagcattggtctgggtcaagagtcagtaaacttttttctgtaataggccagataataaatattttaggctttgtgcacatcattctctattgctgctactcaacttgcccattctagcataaaatcagtcatagacaatatacaaattaatgaatgattgtggctatattccaataaaattgtatttatagacagcaaaatttgaatttcctagatttagaattttcacatgtcatgaaatctcattcttttgactttttacaactgttaaaagaaatgtgaaaccattctaagctcgtgagctgtacaaaaacaggggacgggcaagatttggctcctgggcttttttgccaaccatttgtctaggtgaataaatgggccatttataaaggtaggaaatagagggacagtttgttggtggtatgtgttgaggtccatgtattatatcacttttcaaatgaatatggatattggagttaaaacaagcttaattagaaagctttttataattgtatgctgagaaatcttcctctcttctctaagatcctcccataacttctggttcattcaacgagttttttgccattgaggacagagaaacccagtacagcatattttggacaggagacatttaaataatgtttgattgatgtcattgaaacaaagtatgtacccatattaattaggtagaaatttcaagcaaaattatgggaaatgtctatttttttaaacattaagtaaagaatactttcaacattgtatcagacattaagccatacttcaggtaaaagtagaacacatattaattaattaatgaatcaatcaactgttccatgtagatgttagtcatgattataatacctgttcttattttttctcttcaacctcacagctttctccatctctggtgaaagtagccaagtggtcatgatcgccatttcagcggcagtagcaattattctcctcactgttgtcatctatgttttgattgggaggtgagttcacagtctgtttcactattcactttctttgttgctttgtttgctgccactgattgctgttaaaatgtgaagagtgtgctcaataaaatattttaacaaataagaatgtctccacttgtagtttaggtcctctctttctcctccttttctttgtttctccatccttagttttgattttctgctctacattaaattcctgtccccactcttttaacatacacccctcctcttctctcttctgacactactcctagtttttactttctttctctaattatctcctcactcttcaaataaccccagatttccttgacactttctcacccagaacaggggtaacactgcacagcactaatcattacccatagagactttacccttcattccttctaacagaagttgttaaaaaatactataaacacattctaaagccattataaaaactgaactggagggtctgcacagtgggaagcaactctgtgtatctcctcattaggcagctttccagggttcccagagagaggggctttcttcagaggattttgaaaatatgaagttattaaactttcactaaagcatttaattgtttgaggaaaatgttttatttttatgctttgcacattctgagcataggtaactattttaaatatattcctcttatgtgttcgctttccttgatttacctccaggttctgtggctataagtcaaaacatggggcagatgaaaaaagacttcattttggcaatgggcattgtaagtttctaaacttggctttttgttttgcttcaccgttttagctttagcagttattgatttacaattggttaacttcctcctgacaaagagacttcaaaagtagttttatggaaaaactgagtacattaaatttattttagaaaaagagggaaattcatggttctgcattaaataatttttacatgtgtacatttcagcatacttaagctaaaataaagggtaatctgtggtttacattcaaataacgcacatgctaggtagtagaaactagtctgctctgcatggctgaaatgcaaagcgtatcttcaatttccttattactagtcctttgctaaactctaaataggagacttttctctttcctaactgccaagtaaatataaacaacctctgtttatttgaagtgccttatcccattttatcaaccaacctagaaagagcctttaaaataaactgtttattttgcagttacatgatatccaactagtagtaaagccagaactttctctccacattttaatttacccttttaattttttttaaatacacatttcagaaacaaagtgtttacaactaacaaaaagactttttttctttttctggtgaaacgaatcattccaggtgttttgcgttccaaactatggctcagcttagtgtggcaattactaatcagtagcttaaatagcatgttctcatggaaattagtacaaagactgtactcatgcttatgtgctccaaaataatctcaatataactaatgtagtcttgtaagcattaatttttttagtattcactattgccttctaaaattatttgcaaattgacatgatactttgtatcagccgttggattatcatctaaaaatgatagctttagttgtaactcaagtaaaaaacttgactacctgttgctaacctgcaggaagcatacagtagcttgaaaataatgcctttcaaaatataaattgatatgagaagaaagcagtataggagtttgaagaagcattattttgttcatccaattgcagcgtctataaaataattcacacaaaaaagccaaagtactacattcctaaaatcaacatcacatcagtccagattaattaggtgaccaactcaaaagtctaaaaagaatgcctgaacaagttacaggatccttgtctttctttttctcaatgggcccacaaaacactagtgttacaatttttatgcataaattagagcagtggcattcttgtggattaagtcaccctcaatttgacttggacaattgtaaatatcatctttagagcaagaccatgctgatttgattttttttttatgggaagcctacatcttacgaattttgagctttggtaaatttctgtgtgccaattattaaacaggttcctctatcgtcccagtctgttttgctattgtttttatggtggatttttgttgaaactttaatttttttcaaatgcacaatatccttatgacaaacaaaagagaaatgcatttcatcctggctgcaaaggcataaagtaacttatatgcatgtcataaactttctgcatcttaatactacagctggtttatttcagaccttttatttggtattactttaaaaagctctagctacgaactgttccctacagccttgttacaaatcctataatattgcttcaaaaggaaagaaatgtgtttcacctcctaagatcctgtccccttgccctttctggctgggcctttttacttctttgctatccttagggcaactcatgctggtaaaatggaaatgtaaattattgtgtttgcacagaatgagctgtaaagtagtgcagcttaacacgtgtgcatgtgtttattacctggttttcatgacagagcccagttactctgtatgttgcccttaattattggtgtgaagggattatgtgcctcgcagcctgaatcacctgattcctggaatctctggggtcagcagttaaagatcagcagccagtgcttctacagcgaacagaccattttacttgggggtgtatatgtttatgtttgtttttttcccccaaatgtcttatggatggaaaagaaattcaccttattttaattaatagaaattaataggattcattttatttgggaatggttatttaattttcaaattatttagtaatagtagtattgcatataggtatccatcatacatatattctctacaagctgactggtacttaagggtaaatctaaatcacacaatttcaagtctgtttaaggccaatgcttatttaaaatatgtgagacattgttcctaacaactcattttataatctttgtaaattctgatggcaggaaatctcccccacgttaatttccttaacttcagcaaagtaaaggagttataattatgtacaaaacagttccattttaccttatgcttaaagtatcattttatttccttgaaaaagattgctagatttctttaccttactgttactaagtaaaggcaaataaaaactggaagatcacacattatagggttgatctgatatgagttttcatccttaaaatgtaactaaattgactaaatgaaaagactccaacaagattttatttcctaacatattttagtaatggttacttacttttacaatttttcttactccacatctagaaaagtatgatagcttttccttaatcttaaagaagtttcttcttttaaaggtaaagggttttagtactggtaatgttagaagttattttaatgtaacaataaagcacaacagattactgtattaaagggtgactctcccatctgtatttataggaaggattcatgcttatatggaagaagcatataagctgatctgtgagctcaaaagtaatggacatttctaagtctaaattctaccattaggaaacatcaattatattaataattgtaaataaatgttcttaacaataaaaacgctcattagggcaatgagctctatcaatacattgagtgagaactatgcaacagtttctcatgctaggcatttgaatagtatagctttttttttttctcagagccctagcttgtcttttttgccaagatattcaagatgaaaaactctaaaagtgaagttctcacttcaacagctactccactcagagtttgtccaaagcaagggacagaacttgtatttccccatttctgtggatattgacttctagatagtggtgtcctttcaaattatccacacctcgcctcaagctggatagcagctgctcttttgttgtagctgtatcagcaccaggcagaagtaggagtcgtgttagcttttcttctgcattccctatttgccctctcaccaccatccctgctttctattatgctgtgtcaaagtcatgcaaataatagctgaggaaaatagagtttttacccaacctctctctcagccaccatttcttttacaacagtttattctcacacttacgtttttttactcaaaatctctatgaaagcttcacaagaacataaatcgtaatgcattataaccatgggtttcatgaagttgtcttgtagttcaaagaattgatcatttgttaacacatactgtgaaatcctagacttgttggcctaatgttcattgtactgaggcttcccagaaaaactgcgggcatctgcagtctccacaactatttaatacaaactacaaaactaactcaaagaaacgattggttcacgcagggtgttcaattgcaactttcccataattctcccattatgaagtaatattggaaacagtaatatctgatttcatttgttataatttaatgtaatgaatgaaaatatatttcactattaagtatccatattctgtgctaaaacacactattaagtatccatattctgtgctatgaatgttatcaaaattaaaagcaaaatcagtagtcttagcagatataccataggagttacattgcaatttcctttaattttagatcatatttatatagtttagtagatcttagaatcacttttttaaaactcagggtttttgtttagagaaagttaatttattgaaaattgcaaattgtctccactgttatttttccaaattataggaatcttattaatattaaatcaaattaaaatgattatcctgtatcagttgtctgtaatattttaactacaggatatgaacatttttaccttcagaataatttaatgaataaatataatatgaaggagatttttatttaataaattacatatatgacttacgtttggaacttagctccttagcgccattattcaactcatagacaatatttattttacttctaattatgttataaagctatacaatatgattatatttaactgatactatattggtgtgtatacatgtatgtattatatatacacaccaatataatatataatacatacatgtatacacatactaacagcttaaagtagatttgtaattacagtgggacattttgattgtgaatgttaatataagcagtacagtgtcagaaggtatgccattatatatcatttaatttatctataattgcagccattatctcaccttataattgtattgaattattttccaatcttgcattgtaatacatatctggttattataacatttgtgtaatcataaatatgcaatagcataatggtgttcactcactgttgctcctggtagtaatgactaggtctaatcagttctgaattatctttcttcttaagatccccttttttgagtatgcattttccttctgatgtttttgcaaagaaagctcctcattgtggttcctttatataattcatcatagagaacatgttttcttaaatttttcaacacagtccaatgtcactgccagtttctgtgatactacagaataaactgaaggttgtgcaccttatggggtagggatttttttaaaccaataatgccataaaatttgatctataattgtttgtacaaatctagctacaattgcgcctttctttctttcctcaaacagtaaaacttccaggtctcaggacttatgttgacccacatacatatgaagaccctacccaagctgttcatgagtttgccaaggaattggatgccaccaacatatccattgataaagttgttggagcaggtaaccacaatgaccctactgccaacttagtactgtatgtgaatcacgattgctcagtctctgaaacctaagtatattgctaaagaaatgggaattttctgatttcatgatcaaaggcaagtaataaataagtgcaatatttaatggaatgtaatgagttcaaaggtgccagacttaccggctcacagaccatggctgcttttgatttattaaatttctgatgtgacagcagcaacaactcaatcttcccatagctgtgctgatcgtgtgtcacaaaacctatttggctaaataaggataactggataaaagtctatttcaatttagacaacccaggtaatttgaagttttcattttcaattttagaatcatgtttggaattaaaagaacaaacaacacaaagtaatatcatgactcatcttacataaattttatcacaactatcttgggtggatattttaaataatataaggtgctccattttaatgcttgcttgactttgaatagtcttatgtgttaaagctttttttaataaatatacctttgttctaattattaatttaaacaatgataaatttgttaacaatcacctattaagtggttaataacagttgcatatttataagaaaaatttcatatatttgtaaaataacagtattttatatatttacacataaacacatgatatgtgcagtatgcatggaagtaaaactactattcaaaagtaaaaatgaaccatgctcaacaataaaaaattttgtaccatcatctaatccttcaatgtcactccccaaagcaaacataaactagttatgttgatacaggaattctctgtgtaacatcagatcacattttctgcaagtaccgtatttacatatttatgagtgatgtgtctttacaaaaatgtacatgtaatgctttgtttctttttctatacaccaaagtagtactgaaaaatcaagcagtagttagtatgcgaacaggacaatcttgtaaatataatgttaatttactagagcttctcttctaattatcttaatttcttatcctaaaatttacatgtgcaggtaatattaaaatatgaaacttgtgttcatagaaagaaaatggagtagtaacttcttttttacaatctaagacttgagagtaaacatattcgctgtacatctgtgctgatccagtgccaaaacagatatatattgtttactctgtttcatttcttcagtcctgacttctgaacagctccatgatgcagaagggtttagtctggctggttttaatgtttcctcacaagagtgcacttttctccagcacggagcctgcggtagcaaatgcagcacgaggactttgaacactcaactggagaatatgttgagaggaggaaaaggttacttatgctaagccactgtccaaaagccaggcagacattattatgatgttgaaatttaggtacctctccactgataaaatatctttatatagttattattgacagactcagatatacagaacatagtgatttgggaaaaagcacaccactgaaaatagcagctgataaatgagataaggggaggtctatttatactgaatcacttaatccctgatgctcattaaagattagaatagagcctccttcctatttctgtcttcaagtatatatgttaatgattagatatatgcccatgttcagggttttgcagccaatattcacatttgccatgttaagaacaacaaaactgtacttatttgcaaataggtataccttcaaggttagttatacttttcctgaaataattcaatacaatatacacacccaattctagactgccttgatgacctttcagagggtttgtatttaccaagttagaaaatgaaattattattcctaaaagctaacaatttgttaaacattttgttttgtaaaatgtaaaatatgtacacaaataaattaaatagtgtaataataaataaacctgtatgttactcatttctaaaatagcttttataacaatgaacaaatggcaaccttggttggtatatacatttacctacttcctacattcttaatcttaaaaaaaatatgttatttataaaaatttaataattattctaaattgattaccaactggcttccattgttagaaaggcaaacctttcagccaactacataactttcagagtcaattaaatttacagaaagaatatatatatatatatatatatataagctaattctcttaaatttctgtcagaaattttacataaatgaattgatgttatggaaactctcttgtatacattggactatagaaagaattatacttatactataaatgataaaattaagacatatgaattagcttcccacagtagtagattactagaagtgaggaattcatgactacaattcctaattttactcctcaatccaaccattctttcaacgattgaatactaaaaatttctgaagaaagtaaatacttagtaagtccttaatttatcctgtgcattcccatgatatttaattttattatcctttttagataggtattattatctccatttcagcacgtgaataaacaaaagctgagaatttgaatagacttgtttggatcaaatgaaaaaccaaaatttgaatcttatactttccaaatttaaagcccatgctggacactggagatcatagtagtgtcttcttcatagtatttttttttgaggattaaacaagataagttgtgcaggggacttagctgacacagaagcattgttcaatatgtgtttttattatgcttactttatgaaaacagtagaaggagggtaggctttaaagctagtgttggagggagtcattctatttaaatgtcggctttttttaattgtttaaatgaaattagcataagaaattttattttgagcagcttttacattgtgcattttaatcagaatacagtccccattcttataaatatacctatttcaaagagcaaataaaattgccgcacttattagaattaaaaaatcaagatctggcagccatgcttttatctagaaatgacaagatctgaatttttgtttcatatgggtgcaaagttaattgaataagacaatataaaacttggccagatgaaactattgcaaattgcatttgcccagtctttgttaacttttacaatacagttcttttattttttatttttaatctttttctatttttagcagctttattgagatacaatttaccaaccataaagttcagctatttaagtatacaattcagtgatttttagtatattttcagagttgtaataaccataattgctatcccaatgcagttattttaaattattaaaaatataattgaattaatattaagcatttctatgtcttttataatatattggcggctatttctagtgtttatctgatgaaataatcacattactaaatgtggggaattttaaaaactagcattgctgaaacacaattttcatgaatttcgaaggtaaatatatacatgtacatgtttatgtgtccaggtgtcccacttacaacaaagaacactcttaattggctcatttaaaatttgaactcctacttttcatatctctagtatgctatcctttacaaatatatgtccagtaagacatgagccttgttatcgccatcattaccataaccatctcttacattaacatagaatttggcattttataaagcactttcatattcatttgtcagtttgatttaaacagaaactcttaaagggtagttaggcaatttatcctttaggtgggtctgaactcagagagataaatagtgaccaacacttagatgtcacctactgtgtgtctggcactgtttcaagtacttaacatacattagttcctttaatcccacaacagctttatgaggtagatacaataagtgtcccccatagagataggaaaagataggtacagagaggttaagttacttaaaatcacacagctaatatgtggcagagtcagaattggacccgaagcaattcggctgcaggatccatgctcttaaccagagttctgtactatcactcctgtaaactgacaagtgacatgtcacttagaatatgtgatgatgacatctacatttaaaacatgctctattataccatgttgatgtatgataatggcagaactttctggttttcccaagcttagtgtttacacaaagtgaaacaaagtaaatgggagcgctctgataatgttcggataaccctatatgaggaaagaaactcttactcttgtttacaattctgagaataattttatcacaccataacttctctttctcctaatattctcatatctaaatggcatattcttccttcgaattagcaagatcaatgaactttctcaagttctactccctgattctttctgtatcctaaggaacactatagctgtagatatcattatcttctctacacttcctcaaagggaataaactagtcctgtcttgtttaccattatatctatctctgtgtgttttatactgtatgcaatacagttgctattatgaatatttattaaataaatgcatgaatatctgcttttggattttaagtgactttgccaaattaaagcataagtcattgctttgaaaacagggcaagagtggatttctggggatgagtcaagcctggggaaggttaaagcttcccagggagagagacaccatttgtagtaatgtagctggcaaatcaataggacaacctgctacttttgtggttcaaaccacttgcttgaaaacaaaaatagagaagaatcatatcacttcaatctgactgacacgtagggcatgaagctcatagaaaattcacagagagaaaattggaccaagattatgattccactccatcaagagccaaaaattaatcatataattaattctaaaatatttcaagaaaagctcatttgacattaaaaactatttttaatgtgatgcaaaacatatctgataatccacactatgttagaagttcttctgtgaacaaaggacattctatagaactcccatgtggcaatcatcatggcagcatgggtacagataaataaatgtaaagggtatctgctctaagtgagctccaaatgtaatgaattgatgattagtaaatctctcagtaaaaatgtattttgaaggtagtgtccatactagttctaggcagttttatatcaactggactataatatttaaaagtcagtaacactctatatgggacaaattctggattaattgcacattgaagacttttttttttaaattgaagaagatgaatctaaaatatttctacagtatttagataaggcatgttgtttttatttgatactgttatattgttgttgtcctccagaagcccagagacttttatagctggtatgtcagtaaagcaacacaccaatactccaataaaataaattgatagcagatgctttccttctcatttttagagtctgaatatatagccatattggccctcggtaaaaacagaattgttaaaatatctgaaatttaatccaatgctcacatttaatcactgttggtgctgtcctgttaatttctctgaggtaatggtagctatgacaacaaggggtaaaaaatctaacatatgcagctttcaacttatctctccttttacattacattatttatagtgtcgtactttaaagtatatggaattttcacaaggttcattttccaacagggggtgactatcctgaggttttctaggcagtttcatatgattatctttcaaaataatttggagtactagagtgtacatcttgcaggtcaaaggcacaaatattttaaatggaaattttgaaataaaacagttgctctctactgatgaatttttattatagaattccttacattttgttgctgttctgctttataacaggtgaatttggagaggtgtgcagtggtcgcttaaaacttccttcaaaaaaagagatttcagtggccattaagaccctgaaagttggctacacagaaaagcagaggagagacttcctgggagaagcaagcattatgggacagtttgaccaccccaatatcattcgactggaaggagttgttaccaaaagtaagtaaagtagtcataagacctgtgtttccgtatgttgagcaaaggttgtttaaacccaaccccaaccatttaagaattttggctttttttcataagtatctcagttttaccaaaaagaaaagtttaggaatagcatgcctttctttgacagtagagcagacctttaaataatattctattgacagtactgttttagacctcaaaaaattttaaaaaaatactagaagccacatattagaccatttaaaggtacgctgattagcagacagttaagagaagaattgtggggaattctcggctatgtaagtagcaaagaaaaacaatgactcaagcttgacaggaactcccagctagctgccttttcttttattgttcatcagttttatttaaaagttacaaatctttaacctcctcccaccccctgcatccctgcctttaggaaaattttgggagtctaggaaatgcttctgagctgtacagattggaatcacaatagacccaaggccgtttcttggttctctgtggattttaaatagttctgatctagaaacccaggtggattcttactgctctgtggaagctctggctcacagcccatgatagagatgtgaacttatttccatgatggtttctccagcaggtctcaaaagggatcctgtgaggcggatctgtgatttttggctccaatccctatataagtctcttgagaatactctgggacatttttcctcaagattttggagctcaggatgaagaataagtgaaattggcagcaaactttttagagtgaaagacaacatatggcagggaatttggcatcctttaggggataattcattggcaccacatttacatactctatcgttaccaacagacatatttttcataattatatttctctttaccattttatagagcattttccaaatggcactaatacttattctcactttagcatgactaaaaaggcatttccttcctcatgagagcatggtttaattgaaatagactttgatttccttttgagttttcatatataaaaagtggaattaagaatttaacaatgtggaatagttcaacatacattgtaagtccatattaattcttataaggctttttatttgtttgcctatgtactctacaaaaccaggccttattaatagaaatattttctgataaaaaacatttttaaattttaagttaataattaataaaaatgggcataattagtaaggattgggaaagtgtatgaatcctttgttctttctgagcaaggctatactgttttatgtctgtacagttacagtatcatgtctcattgggattttagtgtcatttagccatttaatgttctccattacatctgcatcaagtggtggttgccttttagctcttgagcctcctgggaagagaaaactcccttgtacttatgaagccattcttctaactctcaatttttacaagtttttcattatgaagtatctgttatgtgcccacattatactatgacattatttcattcttaccactaccctgtgaattagacatgataatttctctcttacatttgaacaaacaataactgtaaagggtaattagcttgtataactagaaaatgctagaggtagcactgggaacttgttctgttcatttcaccccatccccaactctgaacccaaacaggtttctacttgtcttttcctgtattctacttattcttttatatcgttactttaaaaatcttctctaacatagtgagacattcctcaatcttcaaaaatttctggaactattaataatccttaatatctaaaacaaaatataaactctcaaagagggcaaaaacccatgttatttgatgacaagtgactaaaataaatcctggatcataatagatacttaatttaccaatgttgaaaaattaaaaaaaatattgatgaaggaaggaaggaagaaagaaaagaaggaaggaagggaggacacaacaatatcttttaacaataggtctttctttagtatttgattcattaaattgaatacacttttcaaaggagtgcatttaaataactacttctatcacccagagagtgatgaaaaaaaatgattactttttagcttgaatagaatcataatctaacttcttcaacatgtgtaattaagaaaaaaatgagctaagagtcactatcacacaaatattaggttctaatttaagcttactaataaactcactctattattttgtcagtcatgagttgatttttttgtttcagtgttatgaattatgaaagctactccttatattttcctgtttcctataaatgcatttactggatgataagcaacattaaactataaatgttgtggcaaatttcctttagatataaaactgaaacaattaaatatagattatggtagactgacaaatctatgaaacaatctctaagacaaaaaatgtagaaaaatgcactaaaatgacttttaaaaattgcaggtattatatattaaacatcttactcaaaccgactctgtaacattctaatatggattacaactgccttattcttagggtgagagttctaaatttgatatatctccctggtcaaataagcatgtaagaagctgccaaatctgactatataaatcccagtcatctcatatattgtaaatataatagagtagtagccctagaattagattttgaactccttggtggcatatttataagctcttagtctggcacccggtaacatctgagaggaaatagaaactccttacaataaagttgatatgttgtatttaacacacacacacacacacacacacacacacacacacacacagagcgattgtgtttccaaaagaagctatttattctactgctattattgtctttgtttcctgagatttctaaaacaatccacctgcagagatcagaaagcacatctatacatgcacacatgcacacacacacacacaactagagtgatgcagagcttataatttaatgaacaaaataatattttcaaaagcaggcatatcagtatctagattaataatcaatgatctgagttcaagttctgaaacaaccttactcctctgagaactcctacaaatcagacaattcacacataattcatttcttcgcttgtaacaaaattaaacagtactactttactatttttagatactaaagatcaaatgagattacataagaatatattaagtggcaaagaactgtgcaaatctaaattactcctctggttgtttgagattttaccaatcaatttgggtgtatagaaaaaaattcttgaaaataattctttttttgctcaaagataaatctgtttattattgttattcgattgtgtgctttgaaacactaggtcaaatacaatgtatcattttcaaatcatttgaagaaaacttttcttaaagctttttattcagtcattgtattttcatttagccacaaacaattttaatgtttttgagcctgatggtcttaaacaggagaaggtgagagagtctctgatcttcaaagtagcagaaagcggggggcacaggctctgctcacaacaaggtactaacatgtgttatcaattttagctgaagttcaaaaggatagaacttgttcttagcaaatgtttgatatttctgccatcacaccattagtcaaataatgttcagactccaagaacaccttccattggccacttttcacctagcgaaatagaaggaattatattggatgagattaatgtattttgtcttgcattattttcaggaaattttaaaaaattaccatgtaacttaagtgtaactttgcattattgaggaatgtcatgggcagaacgttaagatgattttcataattaaaacttatctgtagtggcatgagtatccactttcactaaaagcttagccattggcttccagttgcctgtttccctgcatgtacggtaaggacacatttctggaataagaggtcatcatttagtaacaatgccaaattctagttattttctgtttgtttctctctaaaaatattctaaatttgtcttaagtgtactacacttcatgtcatcttaaaagacaatacatacgttgtacttactatactagtaatttacagagatagtttgttaggataacaaattttggaaactctaatgacccaagttttatcatggattcatggctgcaaattgttaaaatgagttcagaacatgtctgtctaagtaaccacatcaacaaaattaaaaaatcactgctcgatatattagaaaaatataagacagggaatgttatttttacatatttaaacagcttttgttacttcttcatcactgtccacttatgtcccttggatgaataggccattttgacttatagaaaagtgtggtattgtgtatttttctcatttatatgtataggatggttttctgatatttttgaaaaattaagatcaacttacaaaatttgttagagcacgatttgtgtgtgcccaaagacaccatttctagagcactggtttacatatacagtaaatctcctagagaaagaagaaatatgatgaagcactagtttagtagctgtctgaataactgtggtcttacacaacctttgcagaaagggaaaaaaagtatcacctctaaatgccgaggctagtaatatcttgataccaaactatacagctattatcagaaagtataataacattattgtaatgcataaacaaaaatttaataacactagaataattgtgaagccatatctgaaagtgtatcaaaaaagatactacaccatttcccaagtgtagtttattccaagtatgaaaagttggttttgtatttaacaattctaaaaactcataacattaataggtaataagaaagttctatcttaataaatgcaaaaaataaactattttaattttaattttttattagcacatcatacatagaaaatatgtattcctgataaaggtatgtaaacagcccccaaacaaacacaaacaaacccacaaatgtcacatttaatagtaaaactttaaaagcatttcttttcgagagaaaacaaaaagcctgttgttattattatttcaattcaatattgtacaggaaatcttaaacctttttttttgacttttacaaataaatcagctcctttatttgcattattttgagcactctgataatgacagtcttcactgatatttttgaaatcctgttttttgttaaataagcttttccaattaggcaagcaaataaataaaagaaagcttggaaaggagaaaaaaacaaaactttttatgaaatcaaacaacatattaagagtattatatacattcattccacttactgtatgccttacattattgtgcttactgcatgactcagctctaactagcataatggacagtaaattagttgttatctttgaagatgttaaatttcgtttcaagttaagcataaataaatataaatatttttcaagcagctgaaagtaaagcattctatgtgttaggattgatagagtagggttggttaaggaagtcttggagaaagtgtttctcatcctgattttgaagaaagaaattatctctagccagtctgaaattatagacctaatttgatcaattgtaactggcacagtggtaggtgttggatttagaactacagacaaatgggcttggtctttgctctcattaactcatagacgtaataggggtcatttccacacaataatgtcttgattaaaatggaatttggaagacgttgccctgtaattttataatgatttaataagaaacccacaaaaaaaaataccctaactcagctcaatatttcatttcaatatttcagttcaatattcattacaatatttttatcagttaggtatgatatgtgaaaatctatgatacattttttattctcatcaaagatgattcaaatcttctttcctggaaataggcaaattttgtcaatttttttcaactttccatctcccgttttttttttttttccttccatcctgacactgattatatagattgctagcggctaaggtcaaaggttttgattttataatataccctcattagagtgtgtttaatccttttgaaaataagacatagagtgttagacccaatgactgttgttaatagggagttaatagcatttccatttgaaattattaaatgtaaatatttaataatgtttcaatatctgataaacagtttgtttgaatgaaaatattttaatctgaaaaacaaagtttgttagaaaatttcaaagaaaatatctttatgactgactatatatgtatatatatatgcgtatgtatgtgtatatatttcacattattctactctataagaaatgtgattgagaaggttgtgttaaaatagctggtgctgaatctggaattcttagacattttgaatcatatttcttctgtcatcaagcggcgattcaatgactagtaatagctccgagccactggggatagttgggaaaaggaactgattataacagactgatttgcttccctttactttacaattgtgaaagatcatcattttatctaaactcataaatcaacttgagaacaaaagcaaaactccactgcaaattttgttttgctcatttttgatggtttcatttcagcaagtcatagaacagtactttcattgagtttagtatgtatacccagatgtgttttggggtttctgagagccgcaaatgatacaagctttgtctggaggaagacgatcatgtcatttgtaaatcaaaatacacctggaagagcatgcaaacttgagtacaaatacatggcataatgcgcagatgagctggcattttataaataatttcccaccacatttaatgcatgttggaactagttctcgccactacagaagtctctttttctttaaccctatttaccataatcaaaatcacaagggaaaccctaagtcaagatactgtttcccaaggtagaatatttgtaattctgtttactctttgtatatttgatttgcagaatctttgaacgtaatgcaaagcacattttcagacttgcccatcttaactgatgtgtttacaaatacctgaattctagagttaaatgcacgctgatgtgatttctgaatggtcatggggctttgacttaattgactggtttgatttttcagctacttttatttcccttcccaaacatcccactagacatgctaatgagaaatggtcataaggctgggagccagaaggaaaggagtgataagtaaaggtctgagtagtataaaaatgcagtaactggccaatgatattgagagttggtggtgtgaggcaaaatatctgtgactgcatttgaagtgtgcattgaattttggtaacatatcattcctcccagcactgtatgaaggaggaaagacagaaactgatggtgatttatagaaagtacacatatgcaggattttattcattcattcatttattcattcatttcatttcaggccaggcatctagaatcaaacagtctctagggaactgatactaattcaggagagatctaagtttccaaggaaatggtgaatcttccctttctttttgaatattgtttaatcaaagtttagttggaattttgataaagcaaattctgggggctcaaggttttgactgaagcaatttttcagatattactacattaactagatagatgttacatggtgccttaaagacataaatcagtgtcttaacggaaaatagatcaatgtatcaagtggttgtaacatgtataaaagttatctcaaaaactatagaatttaaatagatttttccttaataaataagacataattcctggaatatattcaaattactgaatgtaaaagtataaccttcatgatgctaactcataatttacattttgtacaaatcaaagagttttttacacatgaaaggaaaaaatcaagaaaaggaagttattttctagcatcagaatggcaaactaacctcatgataaataagacacataggaggaaaagttgtgttatacagttatgtgtacattaatgtttgtttaacatctgttatttgcttatgagttttcagcagtactcggttaatactcaactcacgtcttctggacttggaaaaggagtgattttccttcctgtaaaatgctggacttataactaaaatagtataagaataataaagtaagggaattacagtgtggtaatatgtataggttttgaaattagagacagtcgtgtttaaaattttcttgactgctatctaattgtattacctcaacaagttgcttaaacccacaatgttttctgggtaggaatcagtaaaatgggaataatgcatattgctaaagcataagtaagctgtgaggattaagtgatataacaaatgtcaagtacctaatgcaatgttacataattctaatcatgaaaaaaaaattaccagtatttcttttatatcaaagcatcctttttttggtatttttctttttaaaatgttagttttacataatcttcttaattgttaccataatgtatatagaattatattttcagctttgtataatattacgctgtaacaattgtctaaagtgcttaagtcttaaggtcatcattttaatttaaaatcatccatagctttaacatgcaataactgactaaatcattatctgtagtggaacatttgttatattcatagctctgtgtatccactatacttagcacctttgtgtctgatgctttttcatatgttacatttttccctcattatcagtttccgaaagtgacagcatagtgtgtacaggttgcaacttttagctttataacttgttagatgtatgatgaccagcaagttaattagcctctgtgtctcagttttctcatgtgtaaaatggaaataataatacttaatatgttaatatataaattaattacaccagcatcatgctcacaataagtactatttaaatacattaaaatgctgggttaaaggtttcatggtattttaggctacatatttgcaaactggttattacaagttactgccaatagcaattttaatttcagttttattttccatttaaacatagcattcatttcataatttttaagtgttaaacaaattttgtaaataattataactattattctgaattgttttgtagaactcgtgtagaatccataaaggcagaaattttgatctacttgctccccactaagcggcacaaaagagaacacctagcacagtgccctacacgtatatatgtgtgtgtgcacatatagcacatataaatacccatagaaagaataaataaatgttaaattcctaacattatcttgggcttggaggcagaaatatttggtgttgaagataagtgagaatttaattaaagagaggaaaggggcatattttttgtttacttgaaaggcctgtcaaaccaatttagatgctattggtcatgggcctttgttctggaaaccaatcttctccaatttttgtggtttttaaagttttattttctaatgaaacctagggctttttaaaatttttaaaaattagaagacaggcaaagttcttacatctctataatcctcaggtaaatccaactatattatatatgttcattgtataatacttgaactgtactgattattatttattatttactgtatatctaggtaagccagttatgattgtcacagaatacatggagaatggttccttggatagtttcctacgtgtaagtaagatgcacacacatacatatatatgaataaattgctgaaaacattagagacaccctccaatattgtgccaagcaattcagtaatctaagtttaaagtaaaactgaaatcttctgaggctaaatagacagagaagggctgtaaaattgcatctttttttgcagcattcaaatgttaatggtttatatttttaaaacaaatttgtgagttcttcttcaaaagactctttttatactgccaagattcacactcgttaaataaaaataaaaaagaatcctaaagcaagtaataaaacccactgatgtaagacagaaagtctcttttttaagtaatctcagtctgatataattatttaatcacagtctgatataagacagcccatctactttccaaacagtgctgtcagaaaataagcatgtgctataatgctaaagtatatatagttttaatttagatatatcattttgctgttagatatgtacattaattttttagattgagaagctttatacgtttatctatcatctatctatctatctatctatctatctatctatctatctatctatattttttgagatggagttttactcttgttgcccaggcaatggtgcaatggtgcaatggtgcaatggtgcaatggtgcaatggtgcaatcttggctcactgcaatccccgcctgctgggttcaagtgattttcctgcctcagccttccaaatagcagggattacaggcgcccaccatcatgcctggctagtttttgtatttttagtagaggtggtgtttcaccatgttggccaggctggtttagaacccctgacctcagatgatccgccctcctcagcctcccaaattgctaggattacaggcatgagccaccgcacctggccatattttgacatactatatttcaccataagaaagtgaatatattaaatttacatctatttcaacaaatgttatgttcaacaatttcatgaagttcaagacaataccaattaccagtcattgcaggcgataagaaaagacataggccctgtcctcaaggtgcttttgttgctatataaattgagatgggcagatgacagaaagatagatagataaatagataaagaaaatatgtagtatcattcataatcatggaggaaaattttaaattttctaagactgagaaaggatatgctttatattaaaatccattagccaaataaaaattttaatagcaattattttcataatcgttatttcaaaaataaacatttccaaaatcaggtgagttaaaatattatgataaatattctttcaaaattatcgtttgtaattaaacatggaattttatataaatacattatctatacattttaaaccttatgtttctattttaatccaagattaaattagattggaagctggattatgtgatttagtttcttattgctttctattttgtgactacaattcagaagtgggtagaaaaacaaatatccaataaatatttttgactaattatgaactaattatttatgataatgtttaaaaatgtagcatccaccttatttgaaacaattcataaaatatcaggaaacaaagaaggggaaatgaaaattcaatcaaacaaataaatatcaacctaaactagccacaagattcatttcacttttttgttcttaaccttaatgagtctgagcaggagttagtttttttgtcacataaggaccaggaaagtccttgcttttaaactgaagtcaaagaacgttaagatacttcctgttacaaagtatttgataacatagccagtgtgttattttgtttcagccttgtatccatttgccacatatctttgtcttgagtgcttaggactaaagtgtgtatagtcagtcttgttacaaaattcaatatgtgagattttaaccaataaagatatatctttaagaaataggaacgtatcttaattgtacatttgaaatgcttcccagaaacacgatgcccagtttactgtcattcagctagtggggatgcttcgagggatagcatctggcatgaagtacctgtcagacatgggctatgttcaccgagacctcgctgctcggaacatcttgatcaacagtaacttggtgtgtaaggtttctgatttcggactttcgcgtgtcctggaggatgacccagaagctgcttatacaacaagagtgagtaacttagattttctccttttttatcattgttttccatcttgtatcatgttgatttgtaaataagtagaaatcatgacccaaaacgtgttgtcaattatgctttccacaatagaaaacatatcttaaaattaaaatattattatttattctgggtaaatagatggtcactgtttaacatttaatgattttaactctgaaattctatacctcagtttaatgttccccaccaaaagcagcaagattctcacattcctcaaatcttgatatttttaaatgtacccatcttttcaccatggttgagtcaccctgagctagcagattggataaattctaaggaccttatcccagtacatatcattttaaagcactttcaaatcaattttttaataagtaatacctatttatactgtaaaaatgtcaaaacagacctataaagaaaagttgtccataattgtgccatccacagacaacatttataagattgtgagtcaattcttacaaatttttcttcatactcatatgtacaaacttgttcatgaatatattatttaaatacaattattcataatacaattgtatgccatttctctccttaccaatacacttcttgaatatatttcattgtcaataaataatctttaaatttttacatgtagtaggttgctgtattctatattgttgtatcttttttaaagcaaaccctaattagtgagcaaattattattatatttaatttttccatattttataccaatgtatgtgatctgcctgcattcataattgttatgagcctcatgattttctaatgatacattcctaaaaatgaatgttttgtgtcaaagattacgtgaatattttaaaagcacactttactacactcttgataaaactaggtattttcattaattttactattatcagttaggataaattgaatgtatatgttttaatttgcatccatttaattcaaaatgcatttgaattttttgtgagcttttctgttgttgttttgttttgtgtttgttttttgttttttaggcagggtctcactctgtcacccaggctggagtgcagtggcacaattacgactcattgtagcagcctcaaactcctggcctcaagtgattctcccgggctcaagtgatcctccctcctcagcctgctgagtagctgggattacaggcatggaccaccagccccagctaatttttaagtttttctttaaagaaaattatttccatggtagaaatttagaaaatatagataaaaaacaagtaaatgtctaataatcattactattaatactacacaaacataattattagcattttaaatttagcctttcgatttttttaaataaattttcacaaataaataactcctcttttggcataaagttacaaaaatgggattatactttatatactgatatataaaatgatttcaacataccgataatttaggcactttacttatatataaatcaatgccattttgttttctgccctgttttaacttaaaaatataaaatacataagtttccagatgattaaatatttttacaatattcaataatgtctaatactctattcatatacataatttaattaaataaagcactattaattgggcagaattacaatattttcatattatgagtgatactttgatgtcatgatatctattttgtgtctgtccatgattacctccttgggatatttctatagaattaacattacaggatcaaaacgtatacaagtatgtgagaatttttggcgtatatattgcccaattgtctttgctgtagtttgttatcaattttctctcctaatggcagtatctttctccatattctcatcagctaagagaataggtggttccaaagatggtagtcttctgctgtttcttattatctaattttaaaagtttattcccgattaaaaaaaaaagctcatcctatttgcaaatcactcgagaactccaataatcaaaattgtcacatggcatgcatatcatgctataataaagaacctaatatgccagatagcatttcatccacaagtaaagccgcaataatagaaccactgaataataatgacacaatgctgttgggatatttctagatgcattgatataggaggtaggactctcccaatggcttttaataataaacccttttgtttttccaattttcaaatatactctgtagtgcatttactttgttcatgaatctaaatttttttttaatctgagtattttttaaaaagtccttagacacttaaaatgtgtcctacataaaaatgttgttcttaacaaacacaattcaaatggataagagcatgacaaattaagacaaatttcttatcttgtagctagttgaattaaatttacaagtgactacaattatatagctctgaacatgatgaaattgccaaacatgggatcaatacctcaacagtgctttttagttctccttctctgatcaccagaaaaattagtcagccaatgtatctgcaacaaagcatcattttaataactgagctaccaattcagtagacactatatgcagcaagtgatacttaacagtcttagggaatgtatttcattctactcacttctactctttttctaaggctatccctcttaacctgtcatgacataagtacttctaagagtccatgaaaagtatcatgcttacttatattgtccgtgttacaacaatcatattatgccagaaaaatacttttaggttaaataaaaactatttgataaaaaaattatttgaaatgttaaatttctggttattcagtcaggttctaatttctatgccatattaaattatttatttatttatttatttattaatttttgagacagagcctcacgttgtctcccatgctggagtgcagtggcgcagtgtcggttcactgcaacctctgcctcccagattcaagcaactctcatgcctcagcctcacaagtagtttggataacagtggcttgccaccacgcctggctaatttttgtatttttagtacagacggggttactccatgttggccagtctagtctcaaactgctgatctcaggtgatccacctgcctcagcctctgaaagtgctgggattacaggcgtgagccactgttaccagccccatattaaattattatgtgagagcatctctgtccccataagtaggcttgattgccaggatactcaaaagaatagtttctctggcaggaattggaaacatttgtccaactttagatgattcatactctggagaacacagggggttaactctaaatgtttcctttacactgattgttgttttgtcagggcctctttagtgttagaagaaaagtgtcgtatggaaattgctctttaacatttctgaaataaaagtgaaacaggctctttgcatttctgttccagtcactgaagattcttaaaaacacactgaacaaataggctcattcaccaccaataaatagctgtttcgagttcttcagggttcatctttgtatttccttggaactccctcaaaatatccatgggagtcctggctttcttccgagaagctgtaatttgcatgtgcgtttctagagtaatttaaacatcattgatttaatctctcataataggccttattgagtacaataagtttatagtttactctaaatatgaggtatggttatgaagtaataagaagacttcaattttttaaaaaaacaaatataccaaacagctaaatgaggcagcattctaagttttccttttggaaataaatatatacttactccaggaatgctgatattgcacaaaatgttttgggaatttctcttttggaattatatttaaagctaaattataactgatgcattaatcaaacatttttaagcaggtagtattttgggatataggcttgactaagataaaatctggtctcgataagcagagtggggtggctcacgcctataatcttgacacttcgagaggccaaggcaggaggacctcttaagctcaggagtttgagaccagcctgggcaacatagcaagacttcatctctgttaaaaaatatatatatatataaatatatatttatatatataaataatatataatatatatacacttttatatataaatgctatatctatataaatactatatctatataaagtatatatatactatatagtatatataattttatatataaatacatctatatatatataaataaattatatatgttatatataaatactatatatatgtgtgtatatgtattaaaataatataggacaggtgcggtggctcatgcctgtaatcccagcactttgagaggctaaagcaggcagatcacctgaggtcagaagctcaagaccagcctggccaacatggtgaaaccccgtgtctactaaaaatacaaaaattagctgggtgtggtggtgtgcgcctgtaatcccagctacttgggaggctgaggcataagaactgcttgaacctgggaggcagaggttgcagcgaacggagattgtgccattgcactctagcctgggggacagagtgagaatccatctcaataataataataataattaattaataaaaataaaaacatatattaggcatggagacgctcacctgtggtcccaactactcaggaggctgaggtggaaagatcacttgagtccaggaggttgaagctgcagtgagctaaagcctggggatggagcaggaccctttttcaaaaaataaataaataataataaatttaaaaggaagaagaaaagaaaaagaaaaaatactattacatttttgtgtatatattgtctgtttgtcaacccaaagcaatatacccagcttagacatctgtcttgtttatttgatttagtgtgctctgattattgttatttcagaaaaacaagttcatcattcaaaacaatttgctgaggcattccttttggataagagatcctggttaatctgcattaaaaagtcagtcacattaataaagtttaacgcagttcatctagtgtctgaagtttctacaatttggagattaacatttggtgcctcaatgcaatgaccctttcctggttgctcctctgaaagttactgcctgtaggtagagcgtagttgcactgaagagtcatgaaggacatttgaatcaatgtcagtggaaaagaatactgaacatagaatgtctgtcgctcttgttttaaaacatctctgtgagtgacaggcagaatagaggaatgtatagaaattatataatctaattatgtatttaaaacttcttaaactttgaagagtatttgaggagttgaggaaacacctaagctcaaaacttaatttatcagacagtcaaagatattttctcacactgtgttctatactgtcttaggtgtatcacaagctttccttccttatgttctcgacagcatgccggatatgaaagggtcagctaagatagtactatacatttttatgtttattttctcttttacataaggatattgtgtaaggaatcagatttttttccccaatactcacttgttgttatttcttctcatttcttactgctgtgttacgcagaaattgcaaatgttgatattttccattatacaatgttattatgcatcctgtaaaactccactgtactctcatgggatgttcagaatgaataaggctatgaagtttcagtattattatgaaaatagtttctatcttgtggacccctaaaatgctcttggggacccacatacatgctcggatgacagattgaaagccactgttatagatactttactaggaaaaaagtcccttaataactaaatgaatatttttgccgttattcactgatataaatctaaattatggcatagttttatgtgatataatatattttaaagaagtagctttgaaagcagaactgcagctgcataccaaagtttgcaaatcatcttgaaagtccctggatttcgtttgggatggatatgattagaccatttagctccacaaatttaaatcatcaaagaagttttgtgtctgaaaaaaaaaacagaaaaattaattcctttcctctggtttctcatcatgtgactttgaaagtataattataacatgtttgttatatttttgccctggtctactaatttacttcattctaacagaatcatgacactattgtagaacagtttgccactgaatgatttttcaatttttgcttctatgaaattttatctttaactggttagtatttttgtatatatgcattcatgcatctatatagatgaatatttctatattcatatgttgaaatacatggaatccaaaattccaaaatggtagtgtttaattttctgttttatacaggatcaagttactgaaagcacagacttttatcttatttagatgctgggtaagccatcacttcaattcttcctatgtccttaagttcattttgggagcataattaccacataaactgagttggaaagtttgagaaaacaaattgaattgtccttggctatattctccattattcgatttttttcttttcatttctattctgaagttgcctacttagtaagtactaactagattttgttacaacattttattttacataataatttatttggctttttagatctgtgactctgccatattgatgccagatatattctatacaactttgttttgtttgatttcatttttgtttttttgttttgttttgttttgttttttttgagatggagtctcactctgtcgcccaggctggagtgcagtggtgggatctcggctcactgcaagctctgcctcccgggttcacgccattctcctgcctcagcctccggagtagctgggaccacaggggcccatcactacacccggctaatttttttttgtatttttagtagagacggggtttcaccatgttagccaggatggtctcgatctcctgacctcgtgatccgccagcctcggcctcccaaagtgctgggattacaggtgtgagccaccgtgcctggcctgtttgatttcattttaaggataaggcaaaaaaagaaaagtggctaagcaagtggttaaaagctaagaggttaaatatttcctttcaggtaactccaatctaagaacataaataacagaaaacaggagcctttgttctgtaacattttcaagaaccaaaaaaaccatgcttatcaaaattggtataatacaaaagacacatattaatttgataagtaatatatgtcgcatgtcatttatacctaaatgaaaaaggtaataacaaaatatctaatttgtgtccttcatatagtaacagtattttaaactgtgaaccaaaaaaagtcaactacgaatttattgcctccccttatgatcaatatgaatatgcctgcatgtagcatcagaaaatacagccacttattcaataactagaaaactctcaaaggttcagtgattttaataattaatgttgaatcgacacttaatgaaaagtctagtactttctacccatctatttcagagagatgagtagcatgaacatttaaacatgtaaaaaacaactatccaggtttatgtggtgaaaaattacaactataattgtgaagtggaacacaggagcacacaagtaaaggcagaaaagtaaaatgaggaatgcaggcagtctgtagagaatgcaattttatataggatcgtcagagaaattggtaaaatgacactagagcagaaaatgggtttgaatgaaggagcaaatactgaggctaaagaaacattaattttgctttcactaattttcaattgaatagaataattttaataattgcactgattccaagaggcccaccttgcaggaagacaatgtaagtcattagattaattatttagctcagactaaatgtcaagctaatagtaactagtcctctttttctattggtgatgcatgcctttagtcccagctactcaggaggctgacgtgggagggtcgcttgagcccaggaggtcagggctgcagtgagccttgattatgccattgcactttaggctggggcaacagagtgagattttatctcaaaacaattattagaatgaatttagtattatttctatcatttcaattgcaaattgtcagtatcccctgctacgtttctactaatttaccatcgcttcttcaaaaaattgtgttcagagtgctacaatttcagactttgaaatgaatcactataacttttaaaaattagagattttaaaaactggagattgaatatatataaaaaatacaaaatttgacatttaaaacctcattgaacttttaaaaaagccagactcatattaaggcacacacacacacacacacacacacacacacatatatatatgtatgtatgtatatagacttactccccgatgtttgcattatttttgtagaagatagatatcatacatcagattacttagtttttacactgtttcatgagagtccgaaagtaacataagcattatgagtttgttttttatttcctggttagccattataataatttggaatatggagattttcctgtatttcaagtaatgcttaatcatttcacatgatgttgaaagatctcaaaagttcgaagaatgaggttttgctacctaaaggatcatttatctctgatctcttgtggcaatcaacatttgctgaaactattctctcagtggcgctgagatttgaactgctggggataagactagatgcttcctttgggagccttcttggatcacccttcaccttgttgtctgcagtgaatgaattttagtccttgacaatacatagatgctaaatcttttagccaaataatttatctctatagttccacttttaacctgagaagctaatatttccctccaggttaaatactcaattacttgggtttactcagataaactctccaaagtcctttgtcactctaaatatgacctgacaaagctcaaaaacaggaaatgtgaattataaccagcaaacctttcctaaattggcaggcagagatttgtacatataattacagaaacatttggcagctatgtgatattatgcctcaatacccagaaatttcagcaattacactccttctctttagaaatcagaacttgaagccccgtaacccataccgcatgagctgacttcagttaagctcctgaaaaattcaggcttttagccacatgtctcattgaactgtctaaattcatcgagcttagggaactgaattgcagaatctttcaagaacagggttaccgtgtgattcctcatctaactgctgtatctaggcaaagtggacaaggttttagactctcaactaatcctggagtggagtttagcagttatgtagtgcctttttccagagaatcactagcatctttacctgtagcactttattcatctcctttaccttttctgtaaaactctatagacgtaaatcgaggtgacacccatgtggatatgcaatttattccaaagttagtctttctttaagagtccaaaataattaacattgaaaatgtcagcatccttgatactcatgtaggtttaagatagaaagttcaaagagctatggtcataagtcagcaaagctgttaagctgttagataaaactgaatgtaaagtcaaattttatatagtccatgaccctgtttttgaatgacaagacagctgtgcagagaggttaagacacctggctaaaattaaacaggaaggtcaaaactgaggccagaaaccaagactcctgattcttattaaacttcagaatccaaatggagcaaatgactaaacttaccctgtacctccagttatttagctatacatagatgagaagtcagcacttggaggaactggctgaaggtttggcactggagatgtaaggagcaaacattagcttctgattctgttaagtttgaattggaagtctttctgaaattgaggttttagatacactccatatgctatgattctgggcttgctccaagcaactggaagcttttctgaaatacataaatatatcttgggagcttacattaggatatagagaccagtaaaagtaaatgcttcattttaaatgtttaaatatggttaaaaaacacatcttcataaataattgttatagtgactagctgagcttttataatattctaaatgcctagtgtggcacatccctctaaagcatctacattttaaaaatgtccttcacatatataagctaggaaagcaatttctaaaccagaaaaaaataacactcatgcaatatgagcttgaatttgttaaggtgggaggtgagaagggaagaggaatttttgtggtcacaatcaagaacagaaatatgcatacgctctgtgatgaattacttgtaggaaacttagactcctatatattcaatttattttagtttgatagtctcagaactacagatcctcagcttaaatgcagcaagtcttattgtaaagtgtgactcagttaaaatttattgccccagcttcttcttttaaccatatttcagaaccaaattgggccctcaaggactcttattcgtgtctctctatgccaataatgtttacgtttttgtagctgtagacagtgtttgctgttggagcaagcacttgtatcttactaaaatgcttggttacttatacctccatttaataaaaaaattgatgcttaatttataaagttaatttaagttttactagcaaacttaaattaacaggaagttatcctaaaaaagaaaaagaaaaggaaggaagataggaaaaaagaagaaaggagaaaataaaataaaacataaaaaaattccagaagggatattattacatcatcaaaacccaagtattaggagattggctctggtgaacttgacccctgtttttctattagtaaaggtatagcctgtgacaggggtataaaatatccctagaaagttgatttcacttagtcaatataaaatcccacataatttgtagacctcatgtggattactttcccttgatgattgtacaacatttaaagcagtagttcgcaaatggggatgattttgttccccagaagatacttggtattgtctagaggcatttttggctgtcacaactggggagatgctaatgtaatctagatgacagcggcagaagtgctgctagatatcctacaacgcacaggacagccgtcacagcaaagaatgatctcgggtgaaaggtcaacagtgcccttctagagaaaccttgcctacaaggttcccatcatgtgcaaagaatgggagtggggatcaaatgtttctctcaggtactttctattttttcctgtccatattggactgcaagatgcatgggacaatatagactacaccatttgtgaaaaaatgtgcaacagactagccatctgttatcaggcctcctagaatgtgaaacttcaagctatcacaaacataatgcaacaaatcataagtcttgtgtgcctgttaaaatttcattttcatttggtttcaattaaacacttaaattacttaccaccctccaccccaggctctaaatttcaaacatagccactttagttgtgatgttctattttcattttattaagacatcatggagtaaaatcatacatagatgtatatctctagaagataaatatatcagatattttagtcagtatataagtcttacccttgtgtaatttttttaatgttttaacattttacttagcctcattctacaaaggggtaacgtccatgtgtgtagactaaaattattttttaattaattgtatttttaggttggtgaagtagctacaacattaatattgaagcagttgatgtagaatgtgtattgtttatggagtcaaatgaaaatctttatagcattctacgaactctaaaacacataatccatacaacatcctgtgacatatttttgtaattctacagatactctaaaaaagttgatgctcagtgaatcttatactaactatcgttgtggagttcttaaaatgtattaatgtaacaacactattaaatagtagcataagaaaaaagaggacattagaaagcagtatgatttaagaaaataaactattatgtttatattggctcattcacattcacatatattatgaaaaactagatttaactcattatcaactgaaaatgaactgcacctttaaaatgcacaaaattatcagaaatctttagaaaaatctactttcccaggtccacaaaataaatcattattctcacttgacagaacaacgtgcttttttgcaagcaacaaagttttgtaaacagcagaggtagaaaataagacatactttaaactgggggaatacagtggtgaagggggccaggtggttattcctctggacatcccagattaggcaggataataaagcagtagaaagatcacagaggatggaatgaccaactcttgctggaagactcctaaatgttcacccaaagagtttacatttgaccaagatgttcagataagaactttacccagttacagaaaaaaggaaaaaaagcctcccaaaaagaaagaccatgtatttgggaagatagcatgctcacagggggaattcaattaagatcagtgagcatctgttgaatgcctgcactgcacatttgccaagataataccaagataatactacagagagcaagaaaactgctctctgtagtgaatgtgtattgtttatggagaacatagtttcatgtgagttaatactccttatcttcagctttataatctattcagtttttcataagcttatgatttgaaataatggttcgggtttactatttttatttgttgcaattgatatgacaggcactactgctactacttttactagtgtagaacataaagagtttgaaactacaatgaagaatttaaagagtttatgagaatgtatgtatctatcttttcttaaattccataataattttgctcgtttgaaatttcacctgtagtttgatttttttttttacttcaaattaaatgtgtacaatgttggtttattattcttttatttttaaagccagagcaatttgatattatttgcttgccatagaataagataatttttaaaaatttctttttatctgatttagtattaattgctaaatttgaattgtactttgtagttaacagtgagctttcccttgtagcatcttttaataaatttgttatattgacagtaaatgtaacaattaaagggaattgaaaggaaggaacaggcataacatttattgaatgctctattaaggagcagacactttttaaatggctttatatatattataaattcatgacaaatgacaaaattttctaaataataatatataattctcaatcatctttattctcttcctgtttccctcaatgatggatggcatcatttacaatatggttagatagaaaagagataagagtcttgaatctgtgattatttcattattggagctaaactaatccgtctaataagctacctattagcagataatggaaattctctaatgaaaaggctaaatgtttcatgaatattgaatacattctgggctaaacagctaactcttggccaggtgcgatggctcacacctgtgtaacaccagcactttggtaggtggaggtgggaaaatgacttgaggccaagagttagagactagcctgaccaacatggcaaaaccttgtctctatcaaaaatccaaatattagccaggcttggtggcgcacacctctaatcccagctactaaggaggctgaggcacaagaattgcttgagcctgagagggggaggttgcagtgagccgagaacgcactgcaccaccgcattccagacctaactgtctatggacttcaacactaaaattgggcaaagcaaatcacttattcacatcttcttctaaagaaagagtttaaattagccccagctcttcttttagactgagttgtttggatatcatatataaaaatataaattaagagtttttcattaaaaataaaaataaatatgtttacttctaagtatataagctcaattaactgtgacctgggacagaatctggccagcgaggaaaagaactggtacaccaaaagttgatcaatagtagtatctggataaattacggaaacatttaaagcactgcaccctggtttcattgttgaactgattgaatgccacttaatttttgagtgtttgtaataacatgtccaaaataaaatgaaaataaatgagattgccccacttccttatgctttcccacaagggcagcaactgaacccttgatatagttaagagacaaaaaggaaaagtgtaaatcaaaaacctgaatgacacaagtgaaaagaccatacctacatttccaaagctagcaaaacttgtagcaagaggcctttgccatttcacaggtatctactgcacaatgtggccaagatacttttccaaggtaccacagtgagctaagagccagaatattttgttaaaaattagtacgaaggtaaagatagtataaaggtcacctgatcagcaagtatgttacattgaaaggtttaaagttgtcattctaacaataatatgtgtgtgtgtgtgtgcaggctacaacaattacaaaacacaaccagaagagcagaattgaaaatttaagtttttcttattaaaataaattactatacatttttccaaacatgcatcccatttgtttaaattttaagcattttaataagatttacacaggttacacaaatagaccacatgtaattgggaaatattctggaaataatttgcttgaatctgtaaccatgtatttcattagagaacatactgtataagtcccaggcaagttaagagattcaggtgagtgaagctttccttgaagatatgatcatgcgaccacagcagatacctctccaacattattatgtctgtatttacaacagagcaaaagaggattctccttccaagcttaagcagaaatatggctctgttcttcctaaaaatgatcacctttcagtatatcattattttaagaaattctattaatctcaatgctcttctctctggaaaatggtgaagaaacacttaaaatgaaacaactcttctgtgtttctttttaaccctgattgaattaaccaaataaatacacttctctttcatggctgtcatcaacctattgtttttttcttatgactctattttaatttcaactagagaccatggtaaggcaacaaatatctgggcctaatattttctaaataggtacaaagttttcagcatagaaagggcttttttttttcttttttcttttttttagtgccatttaagtacacttcacaatttcagtattactgaaagtatactgacatgatcctttcagtataagtatacttatataccttcagtaatactgaaagtatacttatacgctttcagtaatttggttctggaaaaagagaagtagcaaaggcagttagaaaaatgacaagtgtctataacagacctaagatatttaattgagatttttaagatactgtacctcccttgtcctatgaatacagctctgtttgacttttgttaattctctgagttcttaagaaggagaaagtaggcccaatgattccatttggcatcctgagtagattctgttcaatgccacatgtctaagtccacttttgtcgatgtcaaggggtagtatttgaaattttgaattataaaaacataaacttgatctaggcatatgtagatgagtgctttgggagttttagtgcacgttgcacactgtagtttatctccctaacttccgaggctatcttttctctggctccggtctctccaatttcatttgttttacttcatcagtagaaactgtcaactattcttcacctggtagcttcttaggaaggttgcgctcactgtgtgtctttgcaggcttattcttcctgctgatggtgtttttccatttcctcaattctctgcactgtttcttgcattcttcatgactgtgtaagctctaccttttcaaagagcttctggcagtactctccctgaacagctcatttgtgccaaaacaccaaggagaagtgctcagttttactgagttagttccaatcttatcactctcctagccaggataaagtttcccaagtgcatctgtgattaaataaaaatttgacattttagcttcctcttccattatatttcttcacacaggaaactgttcttctagaacatacagttttctcctctgtgctttgatttatgccatttgctcagaatatgagagtattgagctaacatttattgagtccttactatgtcctaggaagaagactaaatattttactgaaatttgtcgtttagtcccacataaatactctgaaccaggactattacattctcaataacagatgaggacagtcctgcacaacaaggcttagaaacttgtcccctaaattgctaatccatttgtgtaaagcactatattgcccccttgagcatcacttcaaatccagtggcatgctatgaggtccgatagaaatcggtcacattttgacgaacacggcttaagattttgaggatgtgagttctttctttgaaatatccatcccttttttcttatatcaaatattgtacttatctttcaagtgacttcacttgaaattgaggtcacttaattcataagtgccctcctcagtctctctagtgagaatcttggctccacgttccacattacggtggctttcactactgtctttctactcagggtaagttccatggaccagcatcacatggagattgttggaaatgcagacactggctacacactcaacctcctgaatcaaaattttcattttactgggagtaagctgtatatgatttatatgcattataaagtttgaaaagcaatgtgctagatacctatttcgttctgtatctagtttttcagagtaactcattattactcctgtttgcctgacacttacgaaacaaaagagccagtatgttatttatcagtttcacccaaattaactagcataatacttcctatatggttgacaatcagtacatctttattaaatgtatttattgaactaagagcaaattccatagacattacacttttatatctcccataacttataaaagcaatattattttcctctaaattataagttctgggaatgtaattattatgtctatctaatttatatggtgcttgcctactatccagaagacacttcaatgactaatgatgaagcacacagtaaattaatcaagatgattattgtgttgaagagagttttttaaaatataattttattttgagtttatttaggtaacaaacacctgtaagtacttatgtgccagggagtggtctaagttctttacaaatactgacttattcacattctgaacttcgattgcttggtcaagcataaatctaggttaaatcaataaaagttgatttgtgatacctcttttaattctaatacatgtcatgtcacatctgcttcaggttgttttgttgcagatgattaattaacctgccatagttgatataaaatgtcaatatttaagcaattttcttttttatatataatttcaaaatccttccaaattatttggaagtaaaatttgctgtaaatggtatgctacttctgcttggtattgaaatagaataacatcaaaatgtttcacagaaatgcatattccatttcagaacagaaatactatgagaaattctgtccggtttcagattatgttatgtatattatatgttctatgcattgctgatttatgtagacatgattttatattcaaagggagggaagatcccaatcaggtggacatcaccagaagctatagcctaccgcaagttcacgtcagccagcgatgtatggagttatgggattgttctctgggaggtgatgtcttatggagagagaccatactgggagatgtccaatcaggatgtaagtatttgtggtctatgagttatgagttcagatgaaaagatcaagctgtgcaaggaagtggaacataatgtaactgggtggctcctggtttataacactgaaataaaatatttagcagcaatgaaactgtttccaagtcttgcaaggatattatattaattgaattgttcttacagatttacatatttccctcaagcaagggtttagaaataagacaaaagaaacatttgtagtgaaaacgtaatgaaaaaagtgaccaataagataacctctagattctaatgcacattgaagtttgaaagtcactgctttacaccattgaaaagtactaatgaactaatagttacttaattttacagcacttaggattttacaaaaaaaattactataatttggaaggcaccatttgaactgcagtataactaaaacctgtatagtaattttgtccatattcattcatatatgttttccatagagaactatataaccaaataataatttctttataacaccaaatttgctctatcatttaacatttctttttattttaacccaaaaaggatctttacatactctttcctaaatttatgttatttcaatcttcctttatataatattttaggcatacataacgtcttatttatttgatcagttgttatccttttaggcaactaaaaatgagaagttttcccacttacctttaaaataagcatatttgtgagccccgcccatgaaaacgtaaactaagtgacacttcctgaaaacttcctggttcctgaaaactttgcttctcacacaggtaattaaagctgtagatgagggctatcgactgccaccccccatggactgcccagctgccttgtatcagctgatgctggactgctggcagaaagacaggaacaacagacccaagtttgagcagattgttagtattctggacaagcttatccggaatcccggcagcctgaagatcatcaccagtgcagccgcaaggtgacacattcaatttgttatctggcattcactctgaaatttgtgtttgctatctccaagatgttaatttttttagcccacccccaaaatgcattatttgaagcttgtattccaccatattagagagatgtatttcccctttcttttttaatctttagaactaattctcgtcctccttaatagtaatgatgaaattctgagatattttttaacatctatcttgactctacattcaggcttgtttaagtctttgggaaataggaatactggaggggtgcggtggctcgtgcctgtaatccaagcactttggtggatcacttgaggtcaggagttcgagaccagcctggccaacatagtgaaatgccgtttctactaaaaatacaaaaattagcctggtgtggtggcaggcacctgtaatcctagctactcgggaggctgaggcaggagaatctgtgaacctgggaggcagaggttgcaacgagctgatatcatgccactgcactccagcctggtcaacagagcgagactctctctctaaataaataaatatactgaacacatacttcttttcacccttcatgaataaagaagtcctgattcatctttcattcaaaataaagaaaaagaaattatccaaaatattgcactggctagcaaaatgcaaattttccccagttaattaaacaaatatttgtctagtctatattgcgtatcaattactttgctagacaccattgaagataaaactaagagtaagataaagccagtgtccctggacaacaacacaaatgttaatactctgcagctgtaatgcaatcctggatgcacaaagtctatttaattttatgcatattcttttaggttaagaatcactgagttctctcagtggttagaacaatgtaaattaaagtgtatctacaaagtacagtggaaaaaagaaggaagaagagatgaattttgtcaggggccatataagaagaaaataaatattaatatatttggtgcctctcagagtaattaaaggcaaagatatcttgtttaataattttgattctcattgtaagcataagaaaaaaaggttcttttacattttgataatgcattctcttacaggcttttaatttttctctctgatttatcacatgagttagtacatgttttatacttttgaaacattcctcttgacaactatagagagaagcatttcagacctatttgggacctctagctatgtgcctactcaatggcttggacttgtgagttcaatagtatcttgattggtacaatggagttttatcagtaacgatgacttgtgggtcattctgccttctttgcataaccagttgcttctcaatatcgcttctcaactgtgttagttttgggtctcaataatagtatcccgccctgttgtttccattgctacaaagcttagtgactaaagctggcgttcaatgcatgggaaattccttgcattttgtcttaagttatctgtttgaagatcaagcagggcgtgtgtgtgtgtgtgtgtgtgtgtgtttgtgtgtgtgtgtgttggtgagtgaatatgtaggtacattacaagtttgattaaccatgccttagtatcatatttttgtgaaaaaaatcaatcatatttaaaacaatattttaagatgtctaaaatcaatgcccctgaaatccacagggaataaaatagcaaaattttaacatataaacgttttttatccattcttctgtcagtggatacctatgttgatttcatatcttggctattgtgaataatgctgcaatgaacatgggaatatagatatctctttgaaatactgacttcatttcctttggctatatacccagagtgggattgctggatcatatggtgattctatttttagttttttgtggaacctccatacatttttccatatggctgttccaatttacattcccttacatgccaatgttccctttctccacatcttcactaacagttgttatcttttgactttttgataatagccatcctaacaagtgtgaggttctagctcattgtggttttgattttcatttctctaatgactagcgatgttgagtacctttacataaacctgttggccatttgtcttcctcagaaaaaaatgtctattcaggtcctttgcccatttttaataggggtattattatttttgctatcaaattctatgagttccttatatattttggatattagccacctatgagatatattgactgtaaatattttctcttcttctgtggattgcctttcattttcttgttttctttactgtgcagaaaatttttaatttgatataatccctcctgtttaatttggcttttgttcctatgattttggtgtcatctctacaaaattgttaccaagaccagtgtcatagagctttcttcctgtatttcctgctagaagctttacagtattaggtcttcagtttatccattttgtgttgattatattaaatgcacattacctgttttttacataatagtttaataagttaagtaggagaatcataaacaagatcttaatatcagtatataagaatcatagattatttattgataataacacttagtaggaatcactatgattgaatttagtaataagtccttaaataaaactacccataacttattccataaggataaatatctatcccaaacttcacagagactgtatagactcttagaaattcacctgacagtttaacaactaacaggataacaaacctgtcctttcctgggccatatggtcctcattctgtaccctgaaggcatttattttgatctttacagcatagatagtaatcacagaaaaaaaaagactttacctatcataaaaacattcaaaccattttcaaagctaactcatgtaatgtaatgtaatgtaggggtatctaataccagtttcacagagaaaagtagtcttactatcagatcataatatgtgaggctatgtcctagcatccaaattttaacatactttcataattcacttttccactcttattgaaatatatcaaatactttttcttatatatttttctttaatacatgaactaatttgatgtattttgtcataaaacataattttagaaaaaaatcaatattttctatgaaaagacaaccatctcaatgtacagaatataaacatttgggcaattatatttatatttttacttattaccattaaaatgcacgatgggttagattttgtcataatacatttatttttaacaacctcacattactatatgcaactatgtcaagaagtttttttctctttagaaaatttgctttcctacttttgacaatgattatttcatccttttcataactgattaaaatgacctccttctttaatttttagtgatgtccttgccaaatgctttattgagaaaataagccattagatgggaacttcccacagcaaaacagaaatgtagtggcacctgcacctacccatatcgtccttctttcctctaattataaaaggcagtgtccctctatttgtcagaggctaatcctctactcttcctctctccctgtctccctctctctcttctgcatatccaggctctttttttctgtaggatcattgccacaaacagatgttctattatattctttctcattatcttattcttatcaccaggggaacctattacacatacaaatatccaggtctatcccaagaatctccaggaaaagagaatggagtttggatgttttataaaaatgccaggtgatttttttctcctctggaaaatttaggtgatattgcttgtcaatattacccctgctggccccacatctctgccaactacttccctacttctctaacactcttcacagccaaacttctcaaataatggactcacagacataaagtcaatattctgaaaatttatcaattttctccccctagcctgatccttccactgcctaattaattgcatacaccagcagctacccattcacctaaccaggaattagagcaactcttggtacctctttcttcccctctacactgtgatcatctggatcaatgagatctatctctatcccttttcactgaaaacactctcctcatggctgtttcgtcttctgacctggaccactgcaataggctcctaacttgtcccctgctttgattgctttcaaactccaaacattttttttgcacagcctccagaatcttcttatcaaaacatatatgatatagtttcagtcacctgtttataatcaatattgaattcacgttacacttataaaaaaatctccttttggttgtttaaaaagccctgctgactgggtggagtgactcaaaactgcaataccagctattcaggagactggggctggaggataacttgtggccaggagttggagaccagtttgggtgttatagcaagacccccatccctacaaatttttttttaaatgggccaggcatggtggtgtttgccagtggtcctagctactcaggaggctgtagcagaaggattgcttaagtccaggagtttgaggttacagtgagcaatggtaacaacactgcactcagcctgggtgacagagcaagacactgtctcttgaaaaaaattataaattaattaaaaaagaaaattttgaaaagtcttgcttctccaatgttattatcttattcaaataaattttattcgaaaactatttttatataatacaatgagatgactatagtcaataataccttaattgtgtattttaaaataaatggtgttttctgccactcttgtaaacaacagacaagtacagaccagaggaaggaaataagtaaatggccgtgatgggcgataaaggaatagctgcgaaagagtctgaggagctgatgtttgagacctgcaggaagggaatgagccagctgtgtaacctcctcctcaccaaaaagaatattcttggcacaggattaaaaaatgcaaaagtcttgagatgagaaagggtttggagagttctaggaagtggcagagaataatatgactgaagggagtctgtcatgaacctaaggaggtaaacagaagccagagcacttgaggctacacaggccatggtgaggactttgaaatatttttcaaatgcatgaggaattcattaggcatctgaaccagagaagtaagatgatttgatttatatgactgctttgtagagggaggagcaaaagtatgaggaggtgggggtcattttaacctttcgacttgtgccaccttcatctaaacaatactctaacctcagtggctacttctagttccttcagaaaacaaaagcatttcagaagattgtagcacatgctgtttgccttgtctcagattctcctttgcacctttcttccttaaggaagcaacttacacatcatgtatgtgttgactcattctgtggcagcaccagtgaaataaagtttaacatcattattcttttacagagcaccatattctcgttcttcatcactattttaattctgttttctgtgattgtgtctgtgtattctttttaactatccattttctcaataaactctaagccctgtgagagcacacaccatgcttctctcgtattaccagtgcagattgataatgggtgctctgtaaatgtctcctaaatacctaataaatatgtgctgacatcattagtaaatttacatttcaaaagatgcaatttatagaaaaaattccagtgtttttctgctctctgaacagatttttttaatagacattgatcatatggtaaaagcctagacctgttctcctaagcaaaattctgcatgtgtacctttctgtcaactcaactccagaaatacactcctaaaaatttaataggagacttcaaaactgaattcgtggctggtacaaagcattcaagtttctgaatggtgtagttattcagatcagtgcatagaactgtgtttatacacgtaccctgtagtgtcttttaagaaaaacaacatcattctgatagaaatgatgtttcttcagtctttctggatttagtacattttatggtcaaattttatttttttcttggtggctaagtaccttttgaaactaattgtttgaatttaaaaacgttgttgcatataccgcaatagaagtctttttataatgcatcatttcacttttcagccttcattagagttgatgatttatagcagtaccattctcaaagaatcttccgcttagagtgtctccatgaatatcgtcactggaagtggggaaggtggaaaagctgatggtcagggtgggccagatcaaacaattacttagatgctgcaaagaatcataataagggaaggacagttacattaaactttgtgttatgcttgttccctagtaattgattgctttttctaaaagtagagtaaatcagaggagatgtgagggttttaagttttgatagtacatcagtacaaggctacagatgtttattcaacaataaccgtgtgtgagacattatgttaggtcctgtgatgattatataggtaccagatgtagcttccatcctcaacagcttacgtttaaatgtggaagaaaaaagaatatttagaacactataatacccctcagaacatgtaattattagagcaaaaataaaaggagttcgggaatcccgaggggaggtgagtttacttttatatttggagttttctggtatttgtatgcaaaagggacttttggatagtggatgaaattgaaatttctacaggtaggtaacaggaaaacaggctgggggaacactacagaaaagggaagacatgcaaataggtaggatacttccaaatcacatcgcataatacggttttgctagactataggataaaaaaaggaaattatggggaaaaagcctgatagatcagggatcctcagcccccgtgccatggactgcttccaggccatggcctgttacgaaccaggtggcaaagcagaaggcaaacggcgggctggtgagcattaccgcctgagctctacttactgcagatcagcaggggcattagattatcataggagagcaaaccctgttgtgaaccgcacacacgaggagtctaggttatgcgctcctcatgataatctaatgcctgatgatctgaggcagaacagtttcatactgaaaccatcccccaccacacccccattcgtggaaaaattgtcttccatgaaactggcccctggtgccaaacaggttggggaccgctgcgatagatgattcgtcaggtgatggaagactaaatgtcatttctagacatttgggcttttatccataaggaaaggggagacactgaagttactgaagtgatatgttgcactgtgtttagggaatagttctttggcagctacttctaaaaagggctggagatgaagggattcatacgagagaattaagctttcaatagtctaagaaaaggatctgctatgctagagcagggaaagtagacagtgtgtgaattcaatatgttttattaaagtgagttctataggacatagtgactgagatgtgcagagtgacagagaaagtatcagagaatacttccaggttctgaatgtggagcctttgagatcagccttctcattgacagtggtaggaagaacagaaggaagaacaggtctgccatgcagataagcattcttggcaacagtcaagaaactaatttaaatgtttgaatgcctcctgtttccattgtatgtaacaaggtgtagtggcagccaatccagattttaggcaccttgtaagggggctgtggagccaatcagtgacaggaaatggcaatacaagaaggaaaacaaatacgaaacattcactaatatctcagaatattaactcactacgttgactgccaccaagagagaaagaaaattccctttattttgagctttggagagcagtgccagttatatcacagaagaatgtgaaatggtaggtagaaacgaggaacaatcagggtgataggatgaggtttagactactgcagaaaaccacagtgcaaggcatttccaaaaagtagattcaaacggtattaacaaaagctgaaaaagggaaagaaaaacaaaaactgagggaatagacttccagttaaataatagaaggatttataatccattgggtatatacccagtaatgggattgctgggtcaaatggtatttctggttctatgtctttgtggaatcgccacactctcttctataatggttgaactaatttacacgcccaccaacagtgtaaaagcattcctatttctctgcatcttcgctggcatctgttgtttctagactttttaatgatcgccattctaactggcgtgcacacgtatgtttgttgcaggactatttacaatagcaaaaacttggaaccaacccaaatgcccatcaatgatagactgaataaagaaaacgtagcacatatacaccatggaatactatgcagccataaaaagaatgagttcatgtcctttgcagggacgtggatgaagctggagaccatcattctcagcaaactaacacaggaacagaaaaccaaacactgcatgttctcactcataagtgggagttgaacaatgagaacgcatggactcagggagaggaacatcacacaccagggcctattggagggtgaagggaaagggaaaggatagcattctgacaaatacctaatgcatgtggagcttaaaacctagatgatgtgttgataggtgcagcaaaccaccaagtcacatgtatacctatgtaacaaacctgcaggttcaacacatgtaccccagaacttaaggtaaaattttaaaaaagatagaaggaacattgaggtattaagaaaactattctgaattttggaataatatatattacattgtgagagacctaattataaaattggataatgaaaaggcaaggcaaaacaagaagatgtgcataaaagaatgaaaacaaaagaagctctcctctctttttttataagaatcaaagaaatgtttcttctttcttctctttctcttcctctttttcttactctttctttctttctttctctttctttcttcccttctttctctccttccttctctccttccttctctccttccttccttccttccttccttccttccttcgttccttcctttcttcctttctttctttcttgacagtgtttcactcttgtcgcccgggctggcatgcaatggtgccatcctccgcctcctgggttcaggcgattctcctgcctcagcctcctgagtatctggaattataggcactccccaccatgcctgactaatgtttgtattcttagtggagatggggtttcaccgtgttgaccaggctggtctcgaactcctgacctcaggtgatccacttgccttggcctttcaaattgctgagaattcaggcttaagccaccacatccagcccaaagggatgttttttaaagattgttcttgatagaaaatgccaccatgaaaataaatagaaaatagtcttaaaataaaaatattctttaacttcccaacacattgttttgtacatataagagaaatacacatttattttttaaaaacatattttgaaagattataatataacttctagatttaaataaatttattcacttattttataactgaagctaaattaaaaattgactaataacagaaaaatgagaatgtgtttctattcaagtagtaagataccctttttatttttgaagatatgagatttttattattgacaatattaattttgaagagatgtatgtgtgtgcatatgtgtgtaaaatgaaatagagaaataatttcttcttaagttcacagaatttccactagccaggtattgaattcttctatactgttgtaaattgataaaattcaaattcttgacacaaaaaaattagataatacattcaaaatatttagaacgaggttttaaatggaaggcaacacaattcatgacacagacttaagcaatatatttaataatatttagaacaaggttctgcagacccaattatatttagttaatttaattgaaatgtttttaaatatattgtttcattgcattgatcactaactttgaagggatttatttttattaacttgcagcatagaaaggagtaaaaataaacaatactcatattttccccagttaatgaaaataaacaagtattagtaaaaagcttctgatctctaagagtacataatagaattctttttgagaataactgctgttttgacaaataccatatccttcaagacaaatcgaacaaccaaaagacaatctgcctttatttctcaaaatgactttgacctcaaattctgaaactgacagggtgactttgctcagtgaataaatatgatacagaaccttttagagggaatcgaatatgccgaatacccaagtgatctctctgtctctctttttttttttttttattatactctaagttttagggtacatgtgcacattgtgcaggttagttacatatgtatacatgtgccatgctggtgcgctgcacccactaatgtgtcatctagcattaggtatatctcccaatgctatccctcccccctcccccgaccccaccacagtccccagagtgtgatattccccttcctgtgtccatgtgatctcattgttcaattcccacctatgagtgagaatatgcggtgtttggttttttattcttgcgatagtttactgagaatgatggtttccaatttcatccatgtccctacaaaggatatgaactcatcattttttatggctgcatagtattccatggtgtatatgtgccacattttcttaatccagtctatcattgttggacatttgggttggttccaagtctttgctattgagaatagtgccgcaataaacatacgtgtgcatgtgtctttatagcagcatgatttatactcatttgggtatatacccagtaatgggatggctgggtcaaatggtatttctagttctagatccctgaggaatcgccacactgacttccacaatggttgaactagtttacagtcccaccaacagtgtaaaagtgttcctatttctccgcatcctctccagcacctgttgtttcctgactttttaatgattgccattctaactggtgtgagatgatatctcatagtggttttgatttgcatttctctgatggccagtgatgatgagcatttcttcatgtgttttttggctgcataaatgtcttcttttgagaagtgtctgttcatgtccttcacccactttttgatggggttgtttgtttttttcttgtaaatttgtttgagttcattgtagattctggatattagccctttgtcagatgagtaggttgcaaaaattttctcccatgttgtaggttgcctgttcactctgatggtagtttcttttgctgtgcagaagctctttagtttaattagatcccatttgtcaattttgtcttttgttgccattgcttttggtgttttggacatgaagtccttgcccacgcctatgtcctgaatggtaatgcctaggttttcttctagggtttttatggttttaggtttaacgtttaaatctttaatccatcttgaattgatttttgtataaggtgtaaggaagggatccagtttcagctttctacatatggctagccagttttcccagcaccatttattaaataaggaatcctttccccattgcttgtttttctcaggtttgtcaaagatcagatagttgtagatatgcggcattatttctgagggctctgttctgttccattgatctatatctctgttttggtaccagtaccatgctgttttggttactgtagccttggagtatagtttgaagtcaggtagtgtgatgcctccagctttgttcttttggcttaggattgacttggcaatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtctcctcttttatttccttgagcagtggtttgtagttctccttgaagaggtccttcacatcccttgtaagttggattcctaggtattttattctctttgaagcaattgtgaatgggagttcacccatgatttggctctctgtttgtctgttgttggtgtataagaatgcttgtgatttttgtacattgattttgtatcctgagactttgctgaagttgcttatcagcttaaggagattttgggctgagacgatggggttttctagataaacaatcatgtcgtctgcaaacagggacaatttgacttcctcttttcctaattgaataccctttatttccttctcctgcctgattgccctggccagaacttccaacactatgttgaataggagcggtgagagagggcatccctgtcttgtgccggttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctctatttatatgctggattacatttattgatttgcgtatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcccggctttggtatcagaatgatgctggcctcataaaatgagttagggaggattccctctttttctattgattggaatagtttcagaaggaatggtaccagttcctccttgtacctctggtagaattcggctgtgaatccatctggtcctggactctttttggttggtaaactattgattattgccacaatttcagagcctgttattggtcgattcagagattcaacttcttcctggtttagtcttgggagagtgtatgtgtcgaggaatgtatccatttcttctagattttctagtttatttgcgtagaggtgtttgtagtattctctgatggtagtttgtatttctgtgggatcggtggtgatatcccctttatcattttttattgtgtctatttgattcttctctctttttttctttattagtcttgctagcggtctatcaattttgttgatcctttcaaaaaaccagctcctggattcattgattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtaggcatttagtgctataaatttccctctacacactgctttgaatgtgtcccagagattctggtatgtggtgtctttgttctcgttggtttcaaagaacatctttatttctgccttcatttcgttatgtacccagtagtcattcaggagcaggttgttcagtttccatgtagttgagcggctttgagtgagattcttaatcctgagttctagtttgattgcactgtggtctgagagatagtttgttataatttctgttcttttacatttgctgaggagagctttacttccaactatgtggtcaattttggaataggtgtggtgtggtgctgaaaaaaatgtatattctgttgatttggggtggagagttctgtagatgtctattaggtctgcttggtgcagagctgagttcaattcctgggtatccttgttgactttctgtctcgttgatctgtctaatgttgacagtggggtgttaaagtctcccattattaatgtgtgggagtctaagtctctttgtaggtcactgaggacttgctttatgaatctgggtgctcctgtattgggtgcataaatatttaggatagttagctcctcttgttgaattgatccctttaccattatgtaatggccttctttgtctcttttgatctttgttggtttaaagtctgttttatcagagactaggattgcaacccctgcctttttttgttttccattggcttggtagatcttcctccatccttttattttgagcctatgtgtgtctctgcacgtgagatgggtttcctgaatacagcacactgatgggtcttgactctttatccaacttgccagtctgtgtcttttaattgcagaatttagtccatttatatttaaagttaatattgttatgtgtgaatttgatcctgtcattatgatgttagctggtgattttgctcattagttgatgcagtttcttcctagtctcgatggtctttacattttggcatgattttgcagcggctggtaccggttgttcctttccatgtttagcgcttccttcaggagctcttttagggcaggcctggtggtgacaaaatctctcaacatttgcttgtctataaagtattttatttctccttcacttatgaagcttagtttggctggatatgaaattctgggttgaaaattcttttctttaagaatgttgaatattggcccccactctcttctggcttgtagggtttctgccgagagatccgctgttagtctgatgggctttcctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaacgttggcctgccttgctagattggggaagttctcctggataatatcctgcagagtgttttccaacttggttccattctccacatcactttcaggtacaccaatcagacgtagatttggtcttttcacatagtcccatatttcttggaggctttgctcatttctttttattcttttttctctaaacttcccttctcgcttcatttcattcatttcatcttccattgctgataccctttcttccagttgatcgcatcggctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtcctcccgtagctcagagtaatttgatcgtctgaagccttcttctctcagctcgtcaaaatcattctccatccagctttgttctgttgctggtgaggaactgcgttcctttggaggaggagaggcgctctgcgttttagagtttccagtttttctgttctgttttttccccatctttgtggttttatctacttttggtctttgatgatggtgatgtacagatgggttttcggtgtagatgtcctttctggttgttagttttccttctaacagacaggaccctcagctgcaggtctgttggaataccctgccgtgtgaggtgtcagtgtgcccctgctggggggtgcctcccagttaggctgctcgggggtcaggagtcagggacccacttgaggaggcagtctgcctgttctcagatctccagctgcgtgctgggagaaccactgctctcttcaaagctgtcagacagggacacttaagtctgcagaggttactgctgtctttttgtttgtctgtgccctgcccccagaggtggagcctacagaggcaggcaggcctccttgagctgtggtgggctccacccagttcgagcttcctggctgctttgtttacctaagcaagcctgggcaatggcgggcgcccctcccccagcctcgttgccgccttgcagtttgatctcagactgctgtgctagcaatcagcgagactccgtgggcgtaggaccctccgagccaggtgtgggatatagtcttgtggtgcgccgtttcttaagccggtctgaaaagcgcaatattcgggtgggagtgacccgattttccaggtgcgtccgtcacccctttctttgactcggaaagggaactccctgaccccttgcgcttcccaggtgaggcaatgcctcgccctgcttcggctcgcgcacggtgcgcacacacactggcctgcgcccactgtctggcactccctagtgagatgaacccggtacctcagatggaaatgcagaaatcaccgtcttatgcgtcgctcacgctgggagctgtagaccggagctgttcctattcggccatcttggctcctccctcctgtctctcttttttaatcttaaaatcaaaacagctaattttaccacacggaggaattaaaccaggtgtaacggctataacttcaaagatttttgtccttaaggcctagagataattaaaataaacacaatgactttatttctccttaatgtgtcatttatgtactaggttcctgttgggaactgtatatattcaaaattatttttagttactgatgaaaaattaaattcattttatcgtatctggatttttaattttagtgataaagatcaaggtcatcggcaatcaacattaaaataaattggcaaatataagattttccccctgaaatacattggggaaacatttgaaattttaaaaaacagttataaaatgtacggaaaaaatatattactattctcaaacaataataaattcagatacaattattagtattttggctttaaaaagttgctttttagatttaatgtatttcctgaaactattcacaacaaataaaaaataattataatgttacagtatgcatctccaatgttattacctccttgtagacataataggcatatacttattcattcaagaaatgtgtattagttattatttttgatatttgaggagtaaatctctttgtaatcaaaaggagtctattaagtgagaaatggataactagagattcagaattctaaggtagcattgaaataagattattacccgaagatattcctgggattggcagttgtttattgagctttttccccagtatctggtgctaatttttatgcacctatttacagctaaaataggaattgatgggaagaaaatatatatgtacctctctaatgcaacagtataaaacccatgaaagaataattcacaaatcttaatagaaagagagagaaagaaagggaagaaagttatttttcacttcccctgagcaaatatgtaatttccatgatttctttttaatgactgcggtctgtagccagtaggtactgatttatgaaaagctgtaaaagatcaggtggagctctgtaggacatcgtttacagctgcatggattgaaacctatctaatttgtctagtaaaagtgtgagctcacggtgcacatcacccagcctataaatttccccttcagaccaatgtctggggctgggtctgaaaaaacgccaatgcctgcagctgctcaaaggcccagattcccttggtgcgcatgaagagacatcacaggctcttcacagtgagagacaaattcctatccattgataaactctccagatgtcctctctgaggaggaaaggaaccaatttttatttgaaatccccagagaaatcctggaagtggaaaaatgatactttgcagggctagttattctgaggtcattggcattaaaattaggtcatttttttttgtcttggatgcactttgatccaagtcataaacagacaaactcagttggggtcactaatccttaatccacacgtcctgttctatttcaatttgtttatactaattttctctaaactcttgttgagtctggctaaagtgttgagtgtaaaagtacaaactattctgaactgagaagaaagaattctgcattttgctattaggcacacttcataaatattctgaataaatgtcctggggtttgattcttcatacccacaaacccataaataaaaaagtattactattcatgggactaaaacttgacataagattctgtgctccagctactgtagacagagaaactgtggcgtgtgcgcgcgcatgcctgtagatagtttaatgtcttgtctcattctaggtttcacatgatttttcttctaaaatcttctcacacctgatttaatgctattcttatcaattttttagtggttcaatgacttatccaatgagtctaatgtaatgtctaatgcttgctagtgacaaagactatttcactcatgataactatgctgaaacaacccatgaatattgtgtacattttggtgtatatctgtaattactcaagttcttaggaaaagaataaaaatacaaaattttcaattataaaaataagctgtttttcttcctaagatgagtaatttaaaaaatcataaagtcgtttgcatatatgtttcagaagaagataacttatgaaatgttatattgatattttatagttttcctgatattgctaaaggaaaaaattaatatttatataatatggcccaatccttttttagataatctctgagagttagtaaaactaaactatatcagagaaatagaaattataaactccataattaagattttcaatttataatttgaacttgtgaagtaaaaaggattgaggtaattgagtttagtctagtggacagaagtttgaagaatccttccctttcaacttccctccactacacaaatgaccatcacagagaggggactattaatctatattttccacagagtatgtaaatagagtcagaaccaatgttgcaatttttttttcctgaaactcagggttaaaactgcactaaaatgtgaccatttttatcaaatacgtttcatgcatcgctgtaaaaatccagatagtgaattcacaaacttctcatatgttccaagtaatagcatgtaggtgtagggcacgatctaaaattatcctggctcacgaatcaactttacacttgagcaggtcttttgtacataagagagtaagttgaagaatatcaccagaagtggtataaacctctcaattaaaagacctatttaagtgtgcgcagagctggcacagatttgcttcatagattttctcatttagaacaggagcttttaccacatatcctagatggtaatcaatgattgctactcatatgtaaaacattatacagttttatttcatgtatattgttcattttgctatttcatgctatttctaaagatattgaaattagccccttagagacctaaatttatgtctaaaataaggataaatgcatgtcgatatattatttgttttggtgtcttctcaccacaaattctaaactttgaatttaaacacttcaaatgacagacttcacttagactaatctttcatttcaagtatataagaaaaatatgaagttctagttttaatactcctaattttggagatttttattgaaagattctgaagaactaaaacggcaaaaaatcaaaatataccctcttaattattaaataaagattaaattatatataaagttttaacattaatactatattttattacaataatgaaaaaaatcacagacagcagaatagcacttctgttttcaagcatttgcagtggaatgattgtgaagttgtaaaagttactgactattctaatgaagcccctaataatggctacttttcagggttgttatactattatgtacataatattatatatgactaaatttctagttacttaaaatggtggttaacaagatcattgcattcccagcattatatataaactgatatttactctgctattttctttttgaagttttcagaagtttaaccatttcaccatttacataagaataatgaacagctaacacatagtgcttattatgagccagcactgttctaagtgcttcccacatatgctcatttaatcttcatttgtgtgaaattgatatcctcaccatcatccccattttacagatgaggaaacagacaagaaattcaccaaggtcacacaaatagtatgtggtatacctgggattcaacccaggccttacggttccagtatctgtgcactaaacttcagggcatataaacatcgaatatgccacatgatggaatcataaatcatttaagaaaaaacaggggaaatgcaatatgaacaaagttttacctaaatggcacagtgtaccagtcaagaatgtggactgtggtatagaataatgtgggtctaaaggccagctctgcctcttttgcctgaggaaacttagcttcgtaacttaatgtgatttagtttcagcttctttatctatctcagaggatagcatcagtgcctaacaggtactgtaaggattaaggtccttcatgtctgtgtaatattcttagcatgatgcctgccacattgagtgcacatgaacgtttgatataatatgaaaacaagggccttaaaaacttatttctgtcattgttattattcatccaaaactaaaggcttttataactaccttgtgcccaagctcccttccttaggagaaaagaagagagaagtcaatatattgttcacctagtgactggctccagtcttataagtcaaaggacaattaaagaggccactaagagctgaagaaaaaaaaaaacacaccaaagacatttcaccaacagtctgcttcttttgcctcttcagggaggcaaacattgtctcattcatttcctttatgcctcttctgttccattgatttaccaggtcttgcaggtggttatagatagatgtttaggcctgtatttatataaaaaaatcctagaaggaagtcctttttctttctctctttctttttgagacggagtttcgctcctgttgcccaggctggagtgcaatggcatgaactcggctcaccgcaaccttcgcctcccaggttcaagcgattctcctgcttcagcgtcccgagtagctgggattacaggcatgtgccaccatggctaatttggtatttttagtagagatggagtttctccatgttggtgaggttggtctcgaactcctgacctcaggtgacccgccggcctcaacctcccaaagtgctgggattacaggagtgagccactgcgcccggccctttttcttaaagctgattgtattgtgcaatataaatcacaattacaatccctctctgagtctctgtgtgtgtgtgtgtatgtgtgtgtgtatatatataaaatattatgtatatatcatgtgtatataaacacattacatatataatgtatatatcatgaataatgtgttgcatatatatatcatgaacttcatttggtgtcaagtatgcaagaatgttttttcttatcagtcatctacttttttctattattttttatttttaatgacatgcagcattatttaactctgtattgagtttatgtcctgctgtgagtgtagcctagattgttcaagccattctttagacagcaacctgtgcaatgtcaaacaaacaaacaaacatccagtgggaaatacttaaaatattgaaactgaatccatcatcaaagcagacagcaaagaattcagtgtgtcctgcctactgtaaccgtatcctaaattactaccatttttgctagtgattaaattcaatgataataaaatatgtatggatatatttatgtctttcactggaaaattttcagtgatttaaaagcatttgtggatggagaaggggagaacttagacaagatgattacacggcgttcctccaagctgccagcttgaacagatgaagctttcatggcagataaattccacaaatgaaaggaacaccatatgaagtctggaagttcctgccgatgttagtgtcaaattttgacacacagcaactctgctgactcctgatctgtctccctttggtgttttttttcttgcaggccatcaaaccttcttctggaccaaagcaatgtggatatcactaccttccgcacaacaggtgactggcttaatggtgtctggacagcacactgcaaggaaatcttcacgggtgtggagtacagttcttgtgacacaatagccaagatttccacagagtaagaaaaaaaaattcattaagaagaatgaaggattcttttgaactttcttggcttgacatgaaagatttgtaacatcttggcttgacatgttacaaatattagtggtagatctgaggtactgactaccgcctggaactgctaatcagggccctgggtctccttgtggcccacagcttctggattgatacatattgatgtgtcttcctctctcaagatagggcccaggatcggtgtctttagatatgaccttcagatcaaccaacagattcacacccataaccacactgcagactcaagcccctaatttaaaacataagcagacatagattgatgattattatatttctgcattttgtgatttttctgttatttttactaaagcttaacatctgtgaatcaggaaaattgagagccaagtagataatgtggtatacaaggaaacatattaaagtctaaaactggttttcatagttgctaaataaacataacaacatgtattcatcattgtctaccctgtaaaggatatcatgctagaaaatgaagttataattaggtttaagatagaatttttgggttttcctcaaaaggcttattgccagatgagaaagaaaaaatatgcgtcataatattaatattaattgatagctttatgtgttaaaaaccaataataatcaagtataatatgctgtattttgtggacaatcatctttgggtaacaggaatcttttgatatgagaaacacatggactcaaggaaaggtggtatataaagaatcaagtgaatccagtgaatagtcaaaaatttggttcttattcacaaagtagagtgtttgggaattgataaattaagagttggaagtcacattcttcatctcactgtgattgagaaccaatttacttcacttcctaatgtgactacataattttttctttttctgcacagtgacattttctggattcccatgcgcatagctaaaaactggctttctaaactcttggtcatatagccttatagtgccattcaactgaccagggtccaactcccttaatctaagttaccaggagagaaagtaggactggctcagtcccacttgtacattggcacctccaaagtcatatgtttactagtatctagtcatttatcttcaaaagaagtagaatgaggtagtatgaacttggctctaggggccttttcctgaagataagatggagaactgtcccaaagaaagaagtgtatactggatagatacaccaaaagttgtccagcatgttgtcgcttgcatggtctattgggaaactgttcatctttgtgtcagtctttctttgatctttgttaaattaaataaaccctttagtcccccaagtttaagtattatcatctcccactaatatttaaatatttaaatattgttgaatatataaagactttcattgccaccctgtcaatcattcaacatcactgtgaaaaataacagattagatgccagaaaagaacatgccatgtaattaatagatataagtgcccaacaaacaaataaataagtttataatttatggtgtaacattacaatcagaaagacataaagccaaagaaggacttacaggaacagtttacgattattgaagaagaggacttgttctaaaaaaataaacttaccctagtcaatttaacatgcaccagcattcttgttcaaagtggaatgtggtgtttattgaatagacttctgacccaatcgacagtacacttgggtttctgtggtacttattttgatcagatacagtctcaggatatagtcatgtgtttaaatatttttataaattcttattttagtaatataaacagttagggttatgatacacaaaacacctgctgtagagcacagaagcatagcgaaaagcaaacacaaagttgaacatgtccacatcactgccagattttcaaaggcaaagttatgcaaatgtttactctcaataaaatatcaacactcaaaacttttagatattgaaacactatattgaaatgtatgaggcagaacactgttgataagattaactgctagtttgcaattcaaatattgtcagccattataagctatgaatgtgataagaaagctatttgctttaaaaaagtgaatgacagcatttgtcatactttccaagttagcgacattacttatgtcagcaataccatgttggacgtcaaactctttttggctgattggaatatttttacttaattgttattattatttgaacaacctgtgaatatacattcaagatgaaaactgacttttcctgaaagacagctttttcaggtttgtcctgcacactgagtcaggtggtatggatatgtccatattgcactccccacaatattccttcttctgtcctttctcctcaattcagggacaatataggattaacacctttgccctaacactccttcttgaaaggagctgcttttttccttgagtcttcatagtgtcatgcacctcatgctcctaatttatattacaaaaagagaatttattaaaagtctttaacatactaataatttgggtaaatataatgaggcaacattttcagcataaatgctgtaaaatattgagctagatattttagctttctttcgggttcctggcttattgtttgaatttgattgctttcagtctgtattttctttgtgccatccagactcaattcagaaatgatttgctcgaccaaataactgtggagatcctcctagaatagaaaaagatacctttattcctattcaggctgtcaaagtataggaaaagatcaataaaatttcacattcaaatgcatattaatttattttcgttagtttagagatttcattgacatgcaagctactcaagttatctcatttttgaacaaagcccagaacacatgcaattttgtttaataaatacatatttcaagacattatttcataacctaagatggatttaggaaggttaaagtgagaaaggaagagagaaagggaaaggttagagtggctgtgactgtggaactagaaagagaattaagtgtgtggaatgaatattaagcagattcattgccacatgtcattatcctgcacccttggatgccattttcaaagtgtcatcacctatccctttgcctttgaagtaccagataacactttaacctctggtctcagtctggagctgctctttagtcttgaacttttccgccactcttctgaacaggacagtcaaaatgaaatgagcacacagagtgttatggagacagcagcaactgggggttccaaattattttggacatgcagagtagtggacagaagatattcgggcaagaatagagagactagagggtgtttaaaagccctagctaaggaataacccaaatggataattactttaattctcttttcaaaagtccaatataatcatttgcattaagtaaaaaaattgtatataaaacatttatatgtagtatatttatataaatatataaaaatatatattatatattatatataatatataatgtttatatattgtagataacatatataaacatgtatatatatataaacatgtatatatataagcatattatatatatatatgtttgcttatattgggttcacagatacagaatgtaaaacagttttttgcagaacatttcttgaggaatacactcaggaggtgcagctatgaagaagtgatgaggaatgtctcaaatcagtctgtgaactcagcatcacatttttttttccagccacttggggatgagtgcttcagttcagaaggaagatcagggccaaacatcatagcaagcagcactcagtaactatgcttaaatttctcaaagagctcaggcaattactgcattggaatatataaatattatatatatatatttactcatataatataaatattatatatatttactttccatgactattattatttttatttatttatttatttatttatttatttaatttttttgaggcggattctcgctctgtcgcccaggctggagtgcagtggcgcgatctcggctcactgcaagctccgcctcctgggttcacgccattctcctgcctcagcctccggagtagctgggagtacaggcgcccgccaccacgccccgctaatttttttgtatttttaatagagacggggtatcaccgcgttagtcaggatggtcttgctctcctgacctcgtgattcacccgcctcggcctcccaaagtgctgggattacattccatgactattattttaggaaggggaaagggaagagacaaaggacaaaaaatcatctagtcataaaacataggatatggtattggaagaagatgaaagaaaaaagaaagagtgagaatctattgatttgcatacccatacttgtatctgtcctgttttctggctctagactcaaaaactgactttgctgtcgtttggggataagtggagaaatgtttattctttgttttaaaggtagattcatggtatgtttatcaaaatcctgtaacgcacattctcaaaggcagggatcaacagaagtagcatacattactccaagtgaaggcttccatcatccgcagtacactaagcgtggcaagcctcacattcccatacatccccactagccttcctgagaaagagtatgatcagatagggcctaaggcaaggcacaagctctccagagaggatttatcagccctttgacagtcagcagggagggaacctgaaggtcatcaggaaccttctcagcccagatggtaggaattcagtagagtctcggttaatttaatgccctaatgcttaaataacaactacatttcttctcaaatggttacctattgttttcttgaacacctttattgcctaggaacccatttcttaagaaatcgattaatccatttctgtgtagttgaattcccaattttttctttctttatgctcagtataaaggaatcccctctgtgtgtgtgtgtgtgtctgtgtctgtgtgtggtgtgttcacacgtgttcttttttccttgccattctcaattttcctggctctccttgacaaatgatactttacgccctggtcatctttacccagaaaaatatattttgtatgtttctttctttagcaaatttgtattgagcccactaactggcagccattgtttaggttgctgttggtaaacagagtacgagaaaaaaaaaagaatcccagttcacatggaatttaccttcttgtggagtaagatagggaataaagaaaataaatcagaaagaaagtcaatatgtcagatggtaataaatgctttggaagaaaatgaaacaagaaaagaaaacagaaagtgcagatacaagtacagaaaagttttaaaatattaaataggagggttggggaagatttcattagagggggatgtttgagcatctctcaatcctgaaagacaggaatatatgaactaattacttgaaacaagaatatataattaaccatttgcacattagctgtcttttttacctaaatgaaattccttatgtttttataatctttattttaatgcctactttctgactttaaattattatatatttaataaaagagataggtctttgtcattgtttttctactttgaaagaactgtgtactttaatgagattattccagttatctatggctgcacagcagcctccccgaaaacttaaaggctaaaacagcaagaggtttattatacatcatagtgttgtgggttataaatgagggcagagctcaggtgggtgattctttgtgctctgaggttgatgttgacagaagcttacagctgccaaatggactgatctggtgtggagggctggagatgctttcatttcgacgtctgccttggtacagttagctgtacagctggtctcacctgggattgtaggccaaggtgcttacatatggcctctcctgtgaaatagtatcaggtagtcagactttttatatggcagctctagagcccccagagaggatatctcaagcaataagtagaggctggcagtttcctaagacctgaatgaagaaagtgatacaatgtcaattctggcgtactctgttagctgaagcagtccccagattcaagggaaagagataaaaccccacaaagaatgtgtgatcattgatattagtttcctaaggctgccacaagaagttaccacaaatttattggcttaaacaacagaagttttttcttagaattctggtggcagaagtctgaaatcaagatgttggcagtaccataattgctccagtctctaggggtgaattcttcctcgtctcttctagtttctggtggatcctggtattctctggattgtggcaacataactccaatctctgactccatttgtacatcgccttcttctctgtgtatcctattctcttataaggaaactgtcactggatttatgtaccaccctaatccagtaagatattttcccaatcggtgtattaattacatctgcagtgaccctctatccaaataaaatcgcattttgaggtttgggattgacagagattttggggaaactctattcaacccactacaccatctatatagccttctacaagatggtggaacggtccggacataacacagatgatgcaaatatcagacaattaggtccacagtactagaatataacatcgtgcaaattgtgctaattgaaaatctcctgcttatacactatcgaggaaaccgattcttatattgttttctttttttacagtgacatgaaaaaggttggtgtcaccgtggttgggccacagaagaagatcatcagtagcattaaagctctagaaacgcaatcaaagaatggcccagttcccgtgtaaagcacgggacggaagtgcttctggacggaagtggtggctgtggaaggcgtagcatcatcctgcagacagacaataattctggagatactggtggaagttccaagtccaataagacactcaaatatgagtacaaatgccttaaaatggaattgaaaaactctttattttcccctatcatttattggatgggtgggtggggtatttttttgtaattgcttttttaaatattagttaatggattaaatttaattcttcagcgtaaaatggtgaagaactagcatatagccattgatcataaactgactatcataaaatcaaaacaagtgaaataacaaaatggacatggtggctttgtttaggtagagccacaaaagaaaagacttgtaatatttttatatacagaggaaatctgtaacaggtattttgtttcttttaaagcaagcaacacagaggaatttatacctcaaactatctggccatatttactaccttatcactgcattattctcttttatctgtttaaagcatatagagatgaagtttgtagttgttttaagtactacacatttttaaattgttagcttccttaagtatatcatgtaaagaaatgtcttaatttttgaaaaaagtacatatttattttcttttgaattgtttttattgttttctatttatgccttgatgatttaatatggatttgttacagccaagtgccaaatgctctctcaaattgtcagcaatttaactagacacagataataatgggtttctttcagattttttgaaccatccacttacatatatttttaaaaaatgaaatccttttcctgttcatacactaaccaaatctctcaaatctgttatcccaatcattgttgcctctccgtttattataaactgtatgctcacaacttagtgtaatataccagcttgtatgcaatggattttcaaccagataacatacctttcctgctctggtgcttagagactatcaactccctcctttagtgaaggagccgtgttagagcttccgagaatagctccactggagagaagtggaatcctatatagaatgctgcactaattgacaacacagcctataggccaatgcatgagtaaaaaaaaaaacaattactggctcactggctttgaaaagtcacttactattgttgctgaaacttgctgagctgtttatagagaatgatgataacagaacttttcctctgtatcactggtgtttaggtgaattaattaaacattgtgatcattagtaccaggtattattatctttaagagtcttccacttcaatgcacatggtgcagttttggtgtgtaacttagaaggattgaacttctttgaatttactggacataacattttcagaatagttggtcatctagcaaccgcctcaaaatgtgtaagcaggagagaaatttctcatcacagggatttagacttactattacataaaggctaactatgagcttgctcattaattttgaaaagatgtacctggtggatatctagctagtaatatattctgaagcaacattttagctctattgatactctttctaatgctgatatgatcttgagtataagaaatgcatatgtcactagaatggataaaataatgctgcaaacttaatgttcttatgcaaaatggaacgctaatgaaacacagcttacaatcgcaaatcaaaactcacaagtgctcatctgttgtagatttagtgtaataagacttagattgtgctccttcggatatgattgtttctcaaatcttggcaatattccttagtcaaatcaggctactagaattctgtattggatatataagagcatgaaatttttaaaaatacacttgtgattataaaattaatcacaaatttcacttatacctgctatcagcagctagaaaacattttttttttaaatcaagtattttgtgtttggaatgttagaatgagatctgaatgtggtttcaatctaattttttcccagactactattttcttttttaggtactattctgagcatactcaacaaaacccatgcatttcataaactaatagaagttgaggattgttgaatctatttcacttattttggctgtggtttccatctgaaagtagaggttgtatacaccatatactgttcttcattttattaatatttttctccttgacctctcataaatttactttacacaattcttaccctgtacatatgtaaacataagtgtacgattcttaaccatggagtagaggtactagaatgcttacggccatctctttgtacaggaactgcattgactttcagtaaacataaagccacaactcctacatgatgttatgtaccatatgatctgttttgtatcttaaatttgatttacatatattatttatttctggtaactcactcagtttatgctgtgctaaatatcaatcaagccatgtataaatgtgatatgattggcaatatgtgtttactttaaacttgtcttttcaaaatattactcagtttatgttgtacaatgtagatggcctcttactaatgtaaaatgatttgtagtggaaacatttatatttttataataaacataatgaaaatattttttacagattgg

SEQ ID NO: 36832 - DNA, 61145 bp, Homo sapiens
cccgcctcctggtaggagggggtttccgcttccggcagcagcggctgcagcctcgctctggtccctgcggctggcggccgagccgtgtgtctcctcctccatcgccgccatattgtctgtgtgagcagaggggagagcggccgccgccgctgccgcttccaccacaggtacctagggagcagccaggcgaggtcgttggcgggtggggtgggcccaggatagggcagcggagcgcggccgaccctcacgcttccagcagactcctgagcggcccgtcgccttcccctgcccccaccttcacacataaaccaagcgaggcccctgcagcccatcggggaggcccaggggccacccctcagggcggagggcgaggtttgggggcagaggccgatgtgagggtgggaaccggctgccggagtccagcttattgcagaggagaggactgaactgggtggggactaggggacaacttggaggagggggtcgtcagagggggaagggaacttgaggggtggggccgcaggggggtgctgggggagggtgcggagggagtggtgcctgctgggtagtgtgcagtgaaccctcccgcgaaactgggcagctggagtaggggccttcttagggtccctctgggcggggctgagcttcccacctgcagagtgggtgcgaggtggagagaaccccaggcggggttgctggggcgaaagggggaagggaccaagacgtggggcagaacgtctggagttggagttaaggactagttaggagcctggatagaaaaagaggtatggagagaaagcttggctaagggtatacatatgttggtgaccttttgaaagagtaggacttttcaattttgtttttcgttgtgtgttttttgcagtgttggaacattgctagattaagcaggtgatgggtggagcttctgtagtttgttttggggaagcagagtcagggtcaggagaagttgcatcttggctattgctttgtgtggaggaaagagttttgaaaagaaggtggcaaattatttgggaagacttgattacttttcagctgtttaattctacgagaatgggacatggggagaggaaatgaaaactaagaagagaggccgggcgtgtggctcacgcctgtaatcccagcactctgggaggccgaggcgggtggatcacgaggtcaggagttcgagaccagcctgaccaacacggtgaaaccccgtctgtactaaaaatgcaaatatcagccgggcttggtggcgcgcgcctgtaatcccagctactcgggaggctaaggcaggagaatcgcttgaacctgggaggcggaggtggcagtgagctgagatccgccactgcactccagcctgggcgacagagcgagactccgcctcaaaaagaaaaaagaaaactaagaagggaagatttttccaagaattggagacttcattccatctgaggagtgcagtgtaggcccagtggttaaaaaccagactgcctaggttctcaaatatcagggccattgctacttagctgtgtgacctaaactctctaagcctcagttttcccgtctgtaaaagggggatgatggtattttctagcttgtgagtttacggagaagagtaaataagacaatttgtgtcaagtgcttactacagtgtctggcaggtagtaagtgtagtaagtagcttttacctgtcactgtaaagggactagctggtatatttggggctcttctgttctaagtaaaatttatagtcaagaatttgactgtagacagggctttagagtagtatctttgtagttgttgtagggttttgttgtaagtcatttggctttactggcttggtggacctggggctgaaagtccagtaccaatactagttctcctccgtggtattctcaaaagttcacctgcagtcttagcagggcatgtttttgtccttctgtgactttgaaatacttggctttggtttgctattgcgggagggtgtatgacttgaagaaagaatgcaagattggaaatttgcttagattgattaatcaactgattatacagttaggtccccgtgaggtgacttttctttaaaaataaaaaaaagcctagttatgtactcctttgtggaatacagagaagagaaatacacatttaaggaggagcatgggttagtttctaagtagttatgggtgaagtgccttgcaatttgaggatgaaacaggtggcaactccttttccatactgcgcgtccttttcctactcactcatccagagtgagtccttgtttttactattgtctctatctctgaacatacatctttgtgtcacataagtaaagacatatgtatgtatgtatatatactttacttcacataagtaaaatatatacatctttacttcacactctgttaaagaaagggatgattttctttaggaagtgagtttaaacccttccataggacttggatttgtagtaggcagaattacatctccctcttcccaaggtgccataccttgatccccagaatctgtagctatcctgtgttacatggcaaaaggaacttggcaggtgtaattaaggttaagaatcttaaaatagaaaaattatcctggattttctgggtgggccgaatctagtcacttaagtccttaaaagcagagaactttctccaactgggatcagagaaatgggcagaaaaggaaatcagagatttgaagcatgagaaggactccatttgcctttgctagagaggaccacatggaaagtttatcagaaggaatgtgggcagcctctagtggcaaagaccagtccctggctgacaaccagaaagaaatggggacctcagttgtgcaaccagaaggaacctgaatttggtcaacaacctgattgagcttggaagtgaatttcccagtttccaccaaggaatgcaaccttgagacaccttgatttttggcctcgtgagaccctaagcaaaagacctagctagccaagcccacccaacttctgacctacaataactgtgagataacaaatttgtgttatttttagctactacatttgtggtaatttgttatggcagcagtagaacactagtatagattttggtaccaggagtggggtactattacctaaaaatgaaagtggcagtagataaaggttagaattgttttgaggggcatgatagaaaaggcctggaacacaggaggatcgcttgagcccaggaagtcaaggctgcagtgagcggtaatggcaccactgcactccagcctgggtggcagagtgagaccctgtcaaaaaagaaaaggcctaggacatacttttagtagcaatatggatgttaatgactctgctagtgagggcccagacagaagtgaggtctttcttattggaaactggcagaaaggggatccttgttacatagtagcaactaagtttagcagaattgtatcctatggttatatggaaagccaaatttgcaagtgatgaacttgtatatttagctgagatttccaagcaaagtattaaatgtgcagcctggtttatttgtgaatgtgaactttaatggagtggacccatgtggaatacttccacagcccattaggttcttgagaattttatgccaacataaacagttctagtttggattgaaagagacagaaagtaatagggctgttggaccccccaaattctactgataggaagcaggctgataaaactactcacatgtgaatgtgttgcttttcataaaagaatcagggtgactcagacggagataggagagcccagaggggtggagctaaaagctggagaggatttttcccaggctttgaaatggaatggagattccctagattttgaaactgctttggaccggaggctctgttttcttttacattttgcccatttgaactggaatgtctaactgttattctctacatgtctcacagtggtatgttgggagtagagaacttgtttctttaggaattgtgccccaggaattggacttactgttttgtccccagaacctcatccacacctgaatagatgaatgagatttgggacttctgaaatgataagctttagatgggaaacctttgggaccttgggatgggatggatgtattttgcatttgagagagagatgaatccttggaaaccagaaggcagactgcggtaagcagaatggctcccctacgatttccatactataaaccctggaacatgaatatgttaagtagatttaattaaagttaaggatcttaggtagattatcttggattttctgggtgggtttattctactcacataagcacttaaaagcagagaactttttctggctggtgtcagagatgaggcagaaggggaagtcaaatttgaagcatgagaaggactcagcctgccgttactggaggggaccagattgaaagtgtgagacggggaatgcaggcagcctctagtaggaaaggccagtcccagctgacaaccagcaaggaagtgggaactcagtcctacagctgcaaggaactaaattcagccaatagcttgaatgaatgtggaagcaaattttccccagagtttccagcagggaacccacccactggataccctcatttagcccttgtgagacccagtcaagcccactgacttctgtaagataatccatttgtgttgttttgtttgtgataatttgttatgacacaatggaaaacaaatacaggggttttgctggttttattttagagtctttgggatatcattttctagagaacaaagatagcaaagattctataaaacaatttagtcctggaagactccacggaataatggtgttgagtggaacctgtgcctgtttcttgatgtttgaatattattattgtccttagatgcagtttgaaggggcttgatggtcagcttagtgagatgtagtttctgaaggtctaggacattggtaggatttctgtaaataggtggttcttccatatcttggataaatgacataatttcttcattagtttttattggcttaataatgggtttctatgacagccttttaaggcttatttcatatttttttagaggagatggaaatgggtgatacatttttgtgaatttgtaactgtctctctgttctctcacacctcccaccccaccccagctcagctcaaacttgtaagatcttttctccctgtcattgtctgttgaggttgttgagtttaagagtcagatctgggaatcatcactacagaatggagtttctagcttttaagaaaagtcttttctttttgttctttaaagtatcctattaattggattcataaaatatggactaactaaactttagtcagaggatgaaggaagtgagaccatttcttttgagttattacctgaatagaaagatgattacaagattagcatttcagggtatgaaagactttagaggttatgtttgactttgggtttagagtaagggaaattgggccacatgaatgttaactggtctactaagatatctcagccctagagctagtctagaatcctggtccagccaatagagaatcatgacttttgaactatgttccctgagtacccttttctactgttggccgggcatggtggctcacacctgtaatcccagttctttgagaggccgaggtgggcagatgacttgaggtcaggacaagaccagcctggccaacatggtaaaaccccatctctactaaaattagctgagtgtggaggtgcgtgcctgtggtcccagctactcaggaggctgagaatcacttgaacctgggagacggaggttggttgcagtgagtcaagatcacgccactgcactccagcctgggggacagagcaagactccgtctcaaaaaaaaaaaaaaaagatgttaactgtctataatattcaactatatgacaacttttgcataaatattacagtatgatttgtacaagttcagaaactgaaaaccaatatgatttgccattgaattaggtaagggcttagtattttaaggtaataaataatgtgatacttgatttgaaatgagaaactgggttttgatctgtcacaattcgtgggtaacctggataaggtttgtttcatgagagtattaatgtgttcttatacctgaatttctttgaacttctgaaatggataatttcgaaagtagcatgtcatttagtttatagagaaatctaggccagccagcttttcaaatgaagaaattcctctaggattattaaggaaaagtagctgctgtcattgtaacaaaggatgtattttcattgggttatagacaattggtagttttcttacgttgagtgctcccagatgtactttttttttttcacatgtagaagtcaaagattgagtcttttaaaaagtttaaggtgaaagcattcacagtatcacaagatactgctaagagtggcattttaactggtttctacaaattctgtctttcagtcttagacattaaaaaaccctacgtagcaacagttgctatggtcggcaagcttctttacattcgtggtgataatgttttcttgcatagaaaatattgtgttatctgaggtgacagttttagggttaaataccaaggtacaagttagattaatgttttataattttttatgtgtgacatcttaaatgcccttatattggctgctcttttctttttatactttcttgtcttgtgggtttttctgacaggtttttattagctgaaacattttaatttgcttggaaaagtgaacatttgaaattttcctgaagttatgactaatgctttaatgggcatttctcagtttagctatctcatcaatgttctataaattttaagaaagctaccctgtttaaaatgaatgggtaaattattttccaaaaaatggtatcatgtcatatccagaaatacgagatggtcattttgggttattgaattcataaccactcagaagatgttgttcattcagcagatcctgagcgcctgccacgtttctggcaggcgttgtgctaaagatctccaaactgtcactgccctccaagctcaaaattgagtgacgttttctgataacaggcatatcataccacaacttagtagattttggaggtgttttcttataataactcctatttgctttgtatcttaggtgtagtttttgaaacagctgcagaaatgagaagggggtagaatagagaattaattgagattgcgggtagggaggggaaggcaataggttagtgggaaagaactcccactttgagtttggggaagtttacttaacctcttcaagtctgggagttcttgtctctacagttcggataacaactaccttgggcaacttactaacttttggtttcttcacctgtaacatgggaattagtagtacctacctcaggatttttgtgaggattaataactagagtactagctagtattatctcaggattattgaggattaaaggagaaaattgataaaatgtctggcatgtgggtgcccaacattagttctttcccttccctttcggagaaaagaatgtgtttattgccagtgctgtcattcttcattctttattttcattttctgctgccaagagttcttatttttttaatgagacttttgacctgtacttccttgtttctaatgtagcctgttgggtgggtgaggtatgaattgctgcctaggggtggatcagtatgtaagtcacgcccagtgtagattacctcaattactcgtgtacagtgtctattacctagtcctggtgagtctaggattcttttgcttctagatagagaaggtaatattcccatctcagactcaggaaaaggtctacctttgctcacctatagacttgtaaatatagatcagaggtcttactcccagtggttctctgatcacagtttgggaattgcttgaatattgtgtgttagggatatgtttggagaaggccagctccctgcattaacatcttctctatgtcttgctctctcaggtaatccactaacttgctttcttgtttgctttgtattattaagtgataaactgtaggcagaccaggaacttgtatttatcggcactttaaaactttttttttttttttttttgagatggagtcttgctctgtcgcccaagctggagtgcagtggcgcaatctctgcctcctgggttcaagtgattctcctctctcagcctcctaagtaactgggattacaggtgcatgccaccccaccgggctaatttttgtatttttagtagaggcggggtgtcgccatgttggccacgctggcctcaaactcctgacctcaggtgatccacccgcctcagcctcccaaagtgctggggttacaggcgtgagccaccgcgcccggccagtgttttgtgtatttatgattatatagaatggctacaaatggccatctgctttggagttgtctaccttttgtgaaaaaatgaaaatagactattgcctagcaattaagtattcaagcatgtattttgccacataatttattgtgagaaggttatcaatgtcaaataaaatgctttcattatttgcttctatttgtctgtcttcctgaccagttcatttttccttccagtgaagccatcttgagctagggttttctttgtgggtagttgttaattttttttgtagagacaaggtctcaccatgttgcccaggctggtctcaaactcctgggctcaagcagtcctcttaactcagcctcccaaagtgctgagattacactcatgagccaccacactggtccgaagaaattttttttttttttttttttttttttttttttgggagatagcatctcactctgttgccaggctggagtgcagtggcacgaccttggctcactgcaacctccacctcccgggttcaagcaattctcctgcctcagcctcccaagtagctgggactacaggcgcacgctgccacgcctggcttttttttttttttgtattttagtagagatggggtttcactgtgtttcccaggctggtctctaacacctgagctcaggcaatccacccatctcggcctcccaaagtgctgggattgcaggtgtgagccactgcacccagcctggtctgaagaatttttaaacaccacagctaaggacctgagcattcatctgcagctacctatatgctcttgttacatacagttgttatactagggggtttttcacagccatcttttatgactgtttttggaaaacatcacattgaccttcatacatattcaaaactttaggctttgttgcatctggagtccaacactgaggcccacagatgtcaccagcccccagccagcaaggtggggcatgtctcagttgtcttcctttctcccttcagtagccacacagaaaagcttttccatcatttaaaatctgatttttatacaattgtggcctggtggccagcccattcaggtaaaagaataatgaagaaacctgattattgaaactcagtatcccacccctaccttgcctccaaatttaaagcagttcattttattatagtgttttggataggctgttaataaatcagtttggagaactaaggaaatagtattaaatttagtgaaaagaacctatttaggctttggatcctaaacagatctggcttccaccacttagtaatcctgttgtttttggcagattatttaacctctgaatctgtttatttctaaaatcagaatatgcatctgatactgtgcctggtttgtaagaggcattcaaatggtaacagtagttattacattcataagtgctgaatttttctttagattactgtatatcccaaatgaagttttccatcttttggttccagagggtaatagccagtggagtaaagtttcacattgtgactttattttgcttatatggcgtggtaaaaaggtgtatagatgatgactatattgtaagagacagtactggaattccgatttctcttaggtgtttggggtagaactattaatccaaatcaaactgcttggattttcttctaatacctcccttcattgggagacctcacactgttgctatgtcatttatgtcacattgacactcagatcccttttctgggttgaaggtggagaaatgtaattcacacaaaaggcccaaatgctaatgttttctgttttactgtacttcctggtttgttttatggaagtaatacttccgtgtattggtttaatttttttgtatgtatgtatgtatttattttgagacagcgtctcgctctgtcacccaggctggagtgcagtgacatgatctcggctcattgcaacctctgcctcctgggttcaagtgatgcttctgcctcagcctcccaagtagctgggactacaggtgtgtgccaccacacctggcctatgtgcattgtttttaaaaacaaacatgttgtatgttttgtatgtaggaataaaagcagaaggcccctaggggcatgttaggatttataatctcctaaagttaaatattctgcaagtttacacaagcagtaacttcatgaattactaagtattactgagagtatttatgttccaaattcgaagccttaatcaaaccagaaaaaaacatattctgttgggtttgaacaggtagttttcttattcattgtatacttagaaccttgggacttaaaggtcagagagtcaagggaactgccaaggagttagttgctagatatttttttgtttttttgagctgtatatatttccccacttgaaaaaacaaaaacactactacttatatggcattagtatgataggtgagagagaatgttgttggccatggttaccaccttaaattgacatgggaaaagagaatcaatatgaagtggaggaaaaaaaacaataacttcatttaatcatacatttttaccgttaacctgttttcttttggcttatccttctgagctagggtaaggaggcttgttttgtctttgttgtttttgtttttttgtgtcagtgacctccaaatagatgatcttccagacgaaatggttgcctgttagtacatctggtctatacttgaaagctgcaaaaggtgattgcgtatctcttgaaataagaggaattgtgaaatagttttctcaacctgctgcatggattttgactattcaggtcgtgatctccacaagttatttaaactagaatttctcaaccagtgtattgtgttagggtgcgttacagatgtgttgagatactggtcccctcacacctctggccattcatgcagaatatagtttggatacagcatccaaactaatgacctcagatccagagcagtcttgatcatttaccccattgtgccatacaaatattattttctgtcttgactgtaaaaaagactgggagcagtggctcacacctgtaatcccagcactttgggaggccgaggcgggcagatcacaagatcaggagttcaagaccatcctggccaacatggtgaaaccctgtctctactaaaatacaaaaaaaaaaaaaaaaaaaaattagccgggcatggtggcgcttgcctgtagtccagatactcaggaggctgaggcgggggaatcgcttgaacccaggaggcggaggttgcagtaagccgagagcgtgccactgcactccaggcctggcgacagagcgagactccatctcaaaaaaaaaaaaagttaaaagtttagaaaaactgggagcactaatttagaaagctcagtaattggatatctgaacagttttaagattcaagggggtaaacaatctgaaaataatcttggttttaagtttttaaagccattttaaggtacctctctgacccacaagtaattctctttggacacatgattcaaaggatatgctttaaaatacaagactgtgaacaatttaaggttggacagtagtgaagaaattcaagttcttattttctaagcagtaatgtgaggcagaagtaaagttcccttttgtaaaactgttatctctacctgactaactctgaatgctactgtatcttttctgaggctgacattttgttaatcattcatcaagcttgggtctcatactctgaagcctaggatacattgtcttcttgtcttccttcaggaaagaatggcatatacttagtttgagcagtttaattttttaatatttatgtaaatcaccaagttagccttcttagatgagtttctgtttgtctaactcaggaattattaattttgctggagtttacagatttcctgagcctgtaataatttttttcttcaaaaaaaaatgtacatgtacatgctgctttatatacatttaccagagagttcatggccactgatctcattgttgagctgcattttcagttccaaaatttgtgtagtctaaataagagttcccccatcttattatttgtaaatttatatatttagtataaaccagggattgattgctcaaatgccttcaggagtcgagtcaataaggtaaatgaagagttgtccaggtttacgtgtggtatctccattgggtgtctgttaaaagagccagttgttggacagtcacagcttagcatatccagcaggtttttgtcagtgcaggaatgaagagtcattgttaccagacagacagacctacctgccctccctcctgctttatttcttttaagaaatagaaagttaaatttttttttaattttggtaactgtcactttgaaaaatattaattgtgaaaaattttaatacataattcaccttaataccttttcttttgttttttgagacggaatttcactcttttcacccaggctggagtgcaatggcgcgatctcagctcactgtaacctctgcctcccaggttcaagtgattctcctgtctcaggctcccaagtagctgagattacaggtgcccaccaccacacctggctaattttgtatttttagtacaaatggggtttcatcatgttggccaaggctgtcatgaactcctgacctcaggtaatccgcctgcctcagcctcccaaactggtggggttacaggtgtgagccactatgcctggcccctgatttactttttaaaaacagtgtgaaggctgggcactgtggctcatactgtagtcccaacactttggaaggctaagatgggatgatcgcttgaatccaggagttcgagaccagcctgggcaacatggcgaaaccctgtctctactaaaaatgcagaaaattaactgggcgtggtggcgcacacccatagtcccagctacttggaagactgaggtaggaggatcacttgagctcaggagtgtgaggctgcagtgaagtgaactatgatcatgccattgcactccagcctgggtgacagagcaaggtcctgactctaaaaaaaaaaaaaaaaaggaaaaaaagtgaaaaacttgtacacatatgcacctagcgacattatttcatagtagccaaaaagtggagacagtccaaatatctgtcagtgaatggacaaccagaatgtgatgtatttatacagtgaattcagctgtaaaaggaaatgaattactgatacttgcaacaacgtggataaacttgtagacattttgctaagtggaagaggccacatattgcatgattccatttatgtgaaatgtccataataggcaaatacatgaagacagaaagcagattattggttgccagaggattgtaggaagaggctattgggagttaatcctctgaggtactgggtttctttttggggcgatgaagtgttctggaatcagatagtggtgatggttccacagcattgtgaatatacgaaaacacaccattttagggtactgattgtaccctaaaatgatgagttttatgttacatggattttatctcaatttttaaaagtaatatgtgagccaaataggagatatacacacagagtagtcctgttcccagccatctgtgggaaatatattccaagatccccagtggatgcctgaaaccacagataataccaaacctgattatcatcagttggaacacagttttctgttgatgtcttctacccacaaatttaatgccttttccattttaactaagcatttatcacatactgcggtcataacttttgcagtttgaggtacaacagcaaaacaaatgtgaatttatttttccctcttcacattatcactgatagaagatttgttcttaccatagatcttagcaatttccacatatgatttttttttccatattaagtcaagaacttttacctttttacttaaaggaagcactttacagcttcacattggcatttccagattctcagcatcgctactcttgcactttggggcatttcttaagtaaaataagggtaacttgaagacaagcactgcaatactgcaacattcaagtaaccaagaaggctaccaagtgactaatgagcaggtggcatatacagctggacaaagggatgattcacatccagggctggatggtactagatggtgcaagatttcatcacattactcagaaccatgtacaatttaaaacatggctgggtgcaatggctcatgcctgtaatcccagcactttgggagggtaaggcgggaggattgcttgagcccaggagttcaagactagcccgggcaacatagtgagaaaccttctttacaaaaaaaaaaaaaaaatagccaggagtggtggtgcatgcccgtggtcccagctacaagggaggctgagatgggaggtagaggctgctacagtgagctacggttgcaccactgcactccagcctgggtgactgagtgaatcctcgtctctaaaaacaaacatggaaaataaaacttatgacttatttatttctggaattttccatttaatattttcagactgcagttgactgcgggtaactgaaaccatgggtatgggggttggctgtgtttgtggtcaccagtttacagtcccttgctgtagaacagaagaataggctgtgaatctagacgaatgttttccaatcactacctctgacattgggaaggttatgcagttttgccttctgtaaaatgagaaagacattacttaggtcatggacttgctggtttaacagtgataaatctggctgggcatggtggctcatgcctataatcccagcacgttgggaggccaaggtaggaggattgcttgagcttaggacttccagaccagcctgggtaacataacaagacctcagaacaaaaacaaaagacatctcagaaaaaaaaacaaaagaaagaaagaaaaaaaagaaaaaatttaattagcaggggacagtagtgtatgcctatggtcccagctactaaggaagctgaaggaggaggattgcttgagcctgggaggtcaaggctgcagtcacccaccctgggtgacagagcaagaccctgttacacacacaaaaatgataaatcccaagaatcagtgactgacataggcattcacataatatcttcagaattgaaaggcaaccagtttttactgcccttacttccagcctattctatttttgtcagttttaggacaacctaccttattagctgttggttattgatcacctgcggagatgatggttgtctgctatgtaacctgccaccatggcagtaaagaagggagtgggggaagggtgataatccttatattctgcagttttctcactttaatcaggtaggttaaataacatatccaacatcagatgtaggttgtagtggttctagtgtacttattctttctgcaaccttatgatgtcttttaaatccaagatcctttcagtaacggagtactgaactgtttttgtagctctatcaaggcttgtcaagcagtgtgctcatcacatggtaaatcatgcagcgtggaacctcataaaatctccaagaaacatcattcacccatactgactagtttcacatctctttggtaagtgatagtaggaaacctttttcccctggtttaaaaaggatggatgcaataacatttataggtaagactgaggagcattttaaaaaccacaggccgggcacagtggctcatgcctgtaaccctagcactttgggaggctgaaacagttggatcacctgaggtcaggagtttgagaccagcctgggcagtgtggtgaaacacggggcatccaccaagagaaataaatcaaagtccaagtacttgaattcataatctgaggagagaggtgtatgtaaacaaaacacattcagtgtgacaatgtcagagagtatatggggttgctttggccctgtagaagaggtacttggcctgttttggagaaagatgggaatgcttcatagtgtgcttcatagtggatgtaaagtttgctgattcttgaagggtgagtaggatttcccctagcaagcactattggaaggcataatcaatgtataaaagcacagagacctggagaggagtgggaagcaagttcagtcagtttaaacaaatgttttgaaaatgttaatctgtgcagttcaaagacattagaatagaacaggttgaaacaatactgattgaatttattggttatgggactatttatggttttcattttttgtgtcagtttttgttttttctccctgagaatcagactgggatcttgtatcagttttgataaattatttttcttctgggaatttcaagtttgtgggcacaaagttgttcgtgatattgtcttatctttttaccatctgtaggatctgtagtgatgtatcatttccattcttgatactggacatttaccctaattcatccctcactccctcatttccattcttgatattggacatttaccctaatattcattctctctctctctctctctctctctctctctctctctctctctgtctgtctctctctctttctctctctctctctcattctttctttctttttttgagacagagtctcactgtcgccaggctggagtgcagtggcatgatctcagctcactgcaacctctgccgcctcccgggttcaagcgattctcctgccttatcctcctgctgggactacaggcgtgtggcaccacacccagctaattttttatatttttagtagagatggggtttcaccatattggccagactggtctcgagctcctgaccttgtgatccgcctgcttcagcctcccaaagtgctgggattacaggtatgagccatcacacctggcccttctttttttttttcttaaatcaagcacacttacatttttaatttcttcccccccacctgcagaggcagggtctttctctgtcgccctggctagagtgcagtgacatgatcatagctcactgcagcctcaaactcctgggctcaagtgatcttcctgccttagcctcctgagtagctgggactcagctaattttttccattgtttttattattaaaaacaatttttttgagatggagtctcactgtattgcccaggctggtctcaaactcctgggctcaagcagtcttcccgcttcagccttcctaagtattgggattacagtcatgagccaccatgcctggcctaatttttaaattatttttgtagagattgggggttgcactctgttgcccaggctgatctcaaactcctggactcagacaatcctttgccttggcctttcaaagtgttgggattacaggcatgagccacgggctcagcacgagcatttttaaagactcaattggtattgtggatcctctttgtttcatatttctttgattgctgcttttcccgtttttttccttctagtttctctgggcttctgttttcaaatttattgagatatgtgtaagttcttaatttttagtttgcttttctaagttcaagtttatgaatttttattttcgaatcagggccttgctatgtcgcccaggctagagtgcagtggcataatcacagctcactgcagcctccacctcctaggctcaagtgttcctcccatctcagactcctgaatagttggaccacaggtgcatgccaccacacctggctttttttttttttttttttttttaatagttttaagttaaaaaaatagagacagggtctcactatgttgcctaggctggtctccaaactcctgagctcaagcaatcctcacaccttggcctcagcctcccaaagtgttgggattacaggcattagccactgtgcacagcctaattattattattttttttttctttttttttttttttttgagatggagtctcgctctgtcgcccaggctggagtgcagtggcacgatctcggctcactgcaagctctgcctcccgggttcacgccattctcttgcctcagcctcctgagtagctgggattacaggcgcccgccaccatgcccagctaatttttgtatttttagtagagacggggtttcaccatgttagccagggtggtctcgatcttctgacctcgtgatccgcccgcctcagcctcccacagtgctgggattacaggcgtgagccactgcgcccagccgatttttaaaatttttatttttatagaggcgaggtctcgccatgttgcccaggctggtctcgaactcctagattcaagtaatccactcacctcagcctcccaaagtgctgggattacaggcatgagcaaccacacctggcctaagtttataaatttctaagtcctgctttaattgtatcccacgttttgaaatatcgtatttttatgaacaaactctctatagcctatgtttttttttatttaaaatttattgattgattgattttgaggcagagtgtctgtcagccaggttggagtgcaacactgtgatcatagctcactgaagcctcaaactcctaggttcacatgatcacttcagccttctgagtagctaggacacaggtgcatgcaccatacttagctaacttttaaatttttctgtagagatggtagtcttgctgtgttgcccaggctggtcacgaactcagcctcaagccatctttcctcttcagtctcccaaagtgcagggacccctgagctgtgcccagctcttaatttctaattgatacataattgtacatatttatgggatatattgtgatgtttcagtgcatgtatacatcgtgtatataatatataccccatgttttagatgtatctcttttttttttttttttttttttgagatggagtctccgtcacccatgctggagtgcccactgcaacctccacctcctaggttcaagcgattctccagcctcagcctcctgagtagctgggattataggcacccgccaccacacccagctaatttttgtgttttgttgttgttgttgtttttaagtagagatgaggtttcgctgtgttggccaggctggtctcaaactcctgacctcaagtgagccaccacacctggcctagatgtatctcttttatttatttgtttattaatttttttttttttttttttgagaaggagcctccctctgtctcccaggctggaatgcaatggcgttatcttgctacaaccttcgcctctcgagagtttcaagcgattcccctgcctcagcctctaagagcagctgggactacaggcacgcaccaccacacccagctcatttttgtatttttagtagagatgggtttcactgtactggccagggtggttttgagctcctgacctcaggtgatctgcccacctcagcctcccaaagtgctgggattacaggcgtgagcagctgcacccggcctagatgtatctcttttagacagcatgtgatagaatttttttcctttttttaaatttttttttaaattaatacacagtaaaattgactcctttttgtgtatactgttctatgaattttaatacatacatagattcaagtaactaccatcacaactgggacatagaatagttatatcaccttctgcatgttacccttggtaacatacctagcctcccacccctaatctctagcaaccactgttctgttctgagttactacagtttttttttttttttttttttttgagatggagtcttgctctgtcgcccaggctggagtgcattggcgtgatctcagctcactgcaagctcagcctcccgagtagttgggactacaggcgcccaccaccgctcccggctaattttttatatttttagtagagacggggtttcaccgtgttagccaggatggtctcgatctcctgaccttgtgatccatccgcttcggcctcccaaagtgctgggattacaggcgtgagccaccgtgcccaacctcactacagttttatcttttcgtgaatgtcatataaatgaaatcaaacattatgtaatattttgagactggcttatttcattcagcatactgcctctgagattcatcaaagttattgtgtgtgtaaatggttagttcctttttattactgagtagtattccatttatggatagactatagttatttttatccattcactccttgaaggacattttggttttcattctttggtgattatgaatacagttgctgtgaacataacattataggcttttgtggacctaagttttcatttttctagggtaaataactgtgagttggattgctgggtcatatgaaaaatgtacatttaacttatttataaagaagttgccaaactgttttctagaatggctatacagtactattttgcgttcacactagcaatgtatgagtttcagtttttcctcatcttctctagcatctcatcctctttagcatttcaagttaaatattggcagtatttaacttgtaatgttgaaaattttaggtttacagaagttacagatagaatctccatatatgcttccctcagtatatcctaatgttcacatcttgccataaccgtgatatgtcatcaacactaagaaactgggccagtcatggtggctcacacctgttatcccagtaactctggaggccgtggtggggaggattgcttgaggccaggcgtttgagaccaacctggttctcagaagttaggtgggcatggtggcatgtgcctgtagtcctagctacttaggaggctggggcaggaggatcgcttgagcccaggagtttgaggctgctgtgaactgggagagctaggatcacaccattgcactccagcctgggtgacaaagtgagaccccatctctaaaaataaataaataaataaaataattaagaaattaacatcggtataatactattaactaaactacaggctttgtttggattttaccagttgtatcctttttctgttcaaggagccagtccaggataccacattaatttagtcatcatgtctccttagtatcctccagtctgtgaagcttcttagtctgtctttaattttcattacttggaaacttttgaagaagactggtgatgtatgttatagaatgtccttcaatacaggtttgatgttttctcaagattaaattgtggttatggatttttgagaagactaccacagaggtgaagtgcccttctcatcacattatatcaggggcatatgatgtcaaagtgacttaacactagtgatatttcagtaaagtctgccaggtttttctactgtagagttgctatttctccctttccaagcccattggacttaggaatacccttgtaatgaataagcatggaaagggagaaatttaggctctctttccatgcttacttatttcctttccttaaaggagaaaaattgagctccacctcctagattcctcacatgtgcagttcacaatagggttctcctatgagaatctaatgctgttgctgatgggacaggaggcagagctcgggcagtaatgcgagtgactcccgctgctcacctcctgctgtgtagcctggttcctaacaggccatgaactggtacaggcccatggcccggggattggggacccctgatataaatggaagtatacaatatgtaggcttttgtttctggcttcttcacttttaagattcaccatgttggtcaggtgtagcagctcacacctgtaatcctagcactttgggagactgaagccaaaggattacttgaggctagacgtttgagaccagcctgggcaacaaagcgagaccctgtctctaccaaaaaaagaaaaacgattcatccattttgttgcacaaatcagtaatttgttcctttttattgctaagcatcacatggcaaaccatttgtttgttcatgtaactgttggacaccttggttgtttctgttttttcacaattatgaataaagctgccttaaatgtttgtgtataagtttttgtgtagatacgggtttccgtttctcttgagtaaatacctaggagtgggaatgctggttgtatgcttaagtacatgtttaactctataagaaactgccaaactgttttccaaaaccattttgcattcctaccaggaatgtattagttactgttactctgcatccacaccagcttttggtatagttttgttttctgtttttttaaattttagccattttaataaatctgtagtggtagttgtatgatttaatttcattttccctgctgtctggcagtgttgtgtatcttttcatatacttatgtgtatatcttcttttgtggtgtgtatgttcacgtcttttgcccatttttaaattgagctgttttcttattgagttttttaatgttacagatacaagttctttattcgatttgtgatttgcaaatacattcttcttgtgtctggcttattttcttaatagtgtctttcacagagcagaaatattttaacgttgatgaagttcagtttatcagttttacagcccatgcttttagtgtcatgtcttcaaactctgcctaacccctggttgcaagaaggtttgataattttacatttatatctttttttttcccccccagaggtagagtcttgccttgtcacccagcctgggattatacagtcatgagccaccgcatctgacccaagttttacattgatatctgtgattcattatgaattatctttatataaagtgtgagatttagattaaagtttatgattttgcatattgatctccaagtcttccaaaacaatttatagaaaagattattatgcctgtaatcccagcactttgggaggccaaggcaggtggatcagttgagctcagaaatttgagaccagcctaggcaatatggtgaaaccctgtctctactaaaaatacaaaaattagcagggcatagtgacacactcctgtggtcctagctactttggaggctgaggcaggagaatcacttgaacccaggaggcggaggttgcagtgagttgagatcatgcccctgcactccagcgtgggcaccagaggcagaccctatctcgaaaaaaatacataatatatttatatatatatgtatatatgtcctttctccattgaactgcctttgtacctttgtcaaaaattaattggccttgtttgtgtgagtgtatttctgtactctttattctgttcccttgatctatgtattatccttttgccaatacactgttttgacaactatagctttgtaataagtttaagatcagttagtataattcttccagctttattatttttcagaattgtttggattattctggttcatttggatttcttttttaatccagtctgatatgatagtctttgtcttttacctggataatttattccacttatatttaatataattaatcatattccaattcaactttcttcccctatgcttcttatgttctagatttttttcttctcccttcttaacattcttttggattctttttatgattttacttttccctctttctggtttggaaatatatgctatttttattctgtaattagttgtcatacatcttgtgacttgcagctataacttagcaaaacctgatattataattttatcttcttttcatataataaaagacctttagaaagaatactttgaaatctcctcaatacactgtgtttttattgttatgtattctatgttttaaagctcctcaaggtattgttattcttttgtataatcagtgtttgtttggagctgtctgtaaattttcctcttttttgctctttattttttctttcaactcagaccttccaaaatgggattatttttcttttttctttagagacatttgcttgataacagaattttaatttggcggctatttatttttttcagcacactgcaggtattaaactacttggcttcattgttggttttgaaaaatcagctgttctaatgttgctctttgaatataatctgcctttttctgtacttgcttgtctttagttttttgtttttgtttgagacaaggtcttgctgttttgcccaggctggcctccaactcctgggcacaagcaatcttcctgtatcagcctcccaaatagctgggactataggcctgtgccattacacccaactcatctttgttttttcctgctattttgtaattatatgtttggttttggatttctttttattgatcttgtttggaaattgtttgcttctggaatttgattgtgtctgattgcttctgggatattttcaactgtcttcagttactgcctttatcccattctcttttctgctagtaccaattaaaagtatatcaaactggctgggcacggtggcttacgcctataatcacagcactttgggaggccaagatgggcgggtcacttgaggtcagaagttcaagaccagcctggccaaaacatggcaaaaccccctcactactaaaaatacaaaaattagccgggcatggtggcatgcacctgtagtcccagctactctggaggctgaggcaggagaatcacttgaacctgggaggcagaggttgcaatgaactgagatcgtgccactgcactctaacctgggtggcagaacaagactttgtggcaaaaaaaaaaaaaaaaaaaagtatatccaacgatttcactatatttttcctcttgttttttgagatctgctaggacattgtatttaaaaataaataattggctgggtgcggtggctcacacctgtaatcccagcactttgggaggccaaggcgggtggatcacgaggtcaggagatcgagaccgtcctggctaacacggtgaaaccccgtctttacttaaaaaaaaaaaaaaaaaaaaaattagccgggcgtggtggcggactcctgtagtcccagctactcgggaggctgaggcaggagaatggcgtgaacccaggaagcagagcttgcagtgagctgagatcaggccactgtactccagcctgggtgacagagcgagactctgtctcaaaaaaataaaaaataataaaaataaaaatagatatttgtagtgatcatttgaggcccacagtaaggtactttcctccatggagagcttgcttatatcaggtatgcatgggcactaatccagagaccaccttaaaacaagcttaagatatgatattcccttcagtagggctttaattcctccctggatcttccactccctagtcactctcaccattaggaagtatgcctctgaagtcccaccttatgaagagggcctcctattagactttttgtcttgtgagagccctgggctttggtttatgtgagaacaaaattctaattttcaggatcaacaaaggctttccaggcttccttgcttgcttatatctctgggtttgcattttctattcccttttggctataattacttctctgtcttatttaaagatgagtgggccaggtgtggtgacacatgcctgtagcctcagttacttgggaggctgaggtgggaggattacttgagcccaggaatttgaagtggcagtgagctacgattgtgccactgcactccagcttgggcaacaaggaactgattagtgttggaagtagagaaaagaaaataaagagaaagaattccaaagcttgtgaattaatgatactgtttgttttaagcacaaaatggtaacagtcgagtaaactaatagtctccaaatcagatataaaaaggttgctgacctgatgtgcaaaaaaagcacatcaggtgcttttttacacctgatgccacgttgcatgtggcatccaatgatgtgtttcttatagaagataacaaaatgtgccagcctttggtcattttagggtgcaaaattataggtctttaaaattcttaacttgctttaaagtgttacgctttgcaatttcttgttttaatgttttccatctgaataattcctgtgcgtactttaagtgcagttttttttttctcttacagtttttccccattttaggtactccataaatatttgttgaatgaatgatgggttggtgatagtttaaatacccttcaacgtctgtacaccaccatgacttaattgtttcaagcactgatcacttgagattgtaatggtctgttttctttgtctgagggcagagatactttctccaggaccaagagaaagaatgcctttctggcagtcaggcacacatttcctggtacatagtaaacgttcagtaaatgcttgatgtatgagcattctgctcttgattggaaaggaagaaagaaattaaggttaagtatggacatttgaaataagtaattcaggtaacattagctacttgtgcttttttgtattaagttggccttctaatcagtgccccttttgtaaagggaaatgggcaagtttgactgaatttttctctttgcttctgtagcaaggtagaaaagtatacatatttaaggtctcgctgagttccacaagtcttgtttgtctcttaccagtttatgttgcctgattgcttggaaaaagagttcattctctgcagcagtgcataaaaggtgtcttcctgtatagctgcttttcctctaaacaagcagtcctaaaccatgcagtcagtgcaatctaagcacattcctcattctttgctatagaaatctttgtcctgtcgggatgatgatgagatcttgttcatttgctatggttcatttagggatgagaaggagattttttttttccttttaagatggagactaataaacattagggttaaaaagaactaattatattacagttcaaaaattgacttaaagttctagaatgatcttttccatttctgatactaggaaattcatcaataaaaatacattagcagaaatgactaagcaaacttgtttgtatagttttctggtattggactgttactaagcctctagttttctttttagttgccaaattgaaaaataacaactgaacataagagattagaaggagggactagctaagggcaagaggagtttttattgaaattaattctgctgtattcagtgtatatcagtaaacttatgattttggcaatggacaatttttccttatggtttaatggcattttctttttatttacttatactttattaaagaataggtcatgcagacccatgcagttggcttcgatgtgatcttacttcagtcgggaaaaattcattgacatgatacttttttcgtagctgattaattggcttctgttaggctaaacgttgagcatacaagacctagccatgtcttcaaagtcattctgacggtgttaaggtagatgtagtggtctgaaatggttagccactaaagttacacctccttttatgcaattacatgagaacagtaagcactaagtaagacaatttaaaatggaacttaataagaaaggcagtgcattttgttagattgccttaagatatactagtattatgaacagtggagaggagaattgatcttccaaatatctaggactcaggcactttttccatcttccaaataagctgctataaaaattggtaaaatcaagtttcttcagtattctcttaatttgaattatcgaggggaaaaagacaaatcctagttgtagtcctgtgatttaatagaagctgtagtattgggaaagagagagagggaagggaacaattactcaagaacctttgacttggttttccagttctcctagttgcgtaccagatgacctgaagtatttaggaacaccctatactttggatgcaacttcattttcatttcatttttaaaaaataaaccaagattaatttgatcaccaaatagtgtttactgaacgtgctacaaaatgcaagccttaggctaggtactataaattaaaaaggtaaattaaacatggttcttaactttgtagaacttagggtccaattgagaaattaagatttgaagactggtgtgtgtgtgtgtgaatgtgcagtagaaagtgattgtgttctgtaggagtgagaagacttgaaccttggaggccaactcactgtctttgaatcccagctgtaactgtattggatattcttggtcaagctactgaacttaggctgttcttatttgtagattagagaaactaatgcttgcctcgtagagttgttggaagagttagatacttaaagctgagaaactcttagttccagacttgtaatatctaactgcctattcagaatcttcgtttgaatgattcaaagccattttaaccttaagtccaaaacctatcttgtgcactcttatctccatgaatggcaccaacagtctgtcaagcaagaaatccaagagtcacctcccacttcatacagcattttccagttcactcagagctattgattttacaccataaattttgttcctcatattagtccactgatctccacatgccaccaccttaggtcatcatttctctcacgtgtgctactgttaacagccttctccctaagtcctgtcccacactcagccagagtaaaaattttaaaaacaatatgtatgggtcacttttctgcttaaaacttttcaatgaatttctgttacccttagtccataggtaaaatcttcaatggcatacttgtctcacccctgttctgccttgctcacttatattcctaaggcctaggatagtactttttcatagtagatggttatctatttaagggatggacaaaatcaggaatgtagggaagaatcaaaccaaaaattgagaaatgtaggctgtgtgttttcttcctgttagcttacatgtgatatacatatgcatttgcagaggtataagtgaaatactatttctaaataagataatgtttatcttggttgggcatggtggctcacacctgtaatctcagcacttcgggaggctgaggctggtggatcacttgagtccaggagtttgagaccagcctgggcatcatgacaaaaccttgtctctacaaaaaatacaaatattagctgggcctgatggcgcatagctatagtcccaactactcaggaggctgaggtgggaggattgctcaagcccaggagatgaggtggaggtttcagtgagccgagcgagattgcaccactgcactccagcctgggtgacagcgcaagaccctgtctcctgtctcaaaaaaataataatgataatatttggtctttgacctcccttttctgtcttttcacatcccctcttgtttttgttttttgtttgtttgtttgtttgtttttgagacagggtcttgctctgtcacccaggttggagtgcagtggtgagatcatggctcactgcaaccttgacctcccaggctcaagtgatccttccatctcagcctaccaagtacctgggaccacagttgtactccactacacccagctcatttttatgttatttgtagagaggaggtctcgctgtgttgcccagggtggtctcaaactcctgggctcaagtgatcctgccagagtgctgggattataggtatgagccaccacactgggcttcacatcccctttttatcaccatcccttaacccccaatctcttagtacccttttatctatctgagattacagagtcacagttgaagaatcctctgttttattttcccgtataattaatgaaggccagccatttgaaattcatgtgaatacctttcttactataagcagattatttggtatgcgtgacagtaaggtgaagcacctctttgggggtactgcaaaaatagttagcttgttgtcttcccagtggagaatcagatctgctagttcataaattaggtcccagttgatgagccccaaagcttcaagggtcattcagacaagtactggagaatctcaagagtttcattagttattagtcttttcccactcctcacagaggatgccagggccttgaaacagcagaagaagactgggtgatgagaatgtacatgactagtaataggagttggctattctccatatgtcagatggtttccagggagaaatgaggactcattttgtaatgtcatgtatacttgggagttagccctcagtggccgggaattaaccacggctactataatttttgtattttaaagaatgaaggttccagcctgtaaagataggtttctgcttattagctttcactaaggagctaggggatagtaattacttaatacaaatttacatgcatttcatgtttctaagccctttctggaagatcatctcacttcatcttcccttcagtctgcaagcacagttagacaggttttataagtgatgaaccaaagctgggaaaagcccaacagagagatcacttttaagcataggaaaagggctttgagatccacagacgaaggctgtcttacacgtataaaatgttaaccagaagagtaaagtggctgtaaaggttatgtagagaaagatactgtttcctgtcagaggagaggctgagaatttaaaagtttagtatattaaaagtaataaatttctggggacagcatttctgttgggttcatgctgctgtttctactattttggccatattcacacctacacctttctctacggttttcctagtgtctttcattgctgtcaaggcaggcatagtagtcacagagtcaccaatcctacaacatagatgaccttatttctttgggaagaagaaaaattacaagaaaacatctggtttttgcatgtttgatgtgtttgtgtgtgtgtgcgtttacagttttaactgatattaagtgaagatagattaatgtcacccaggttttacaaaatcaaagaaatagaaataattttaaagacttttggtacttgaattactttgttgttttctggtcatttagtacatttatggaacctcagaaggtttgagttgaacagaggcaagttacagcagttttttgggtgggagaattcataagtcagcatgtgaatcttttgatctcatatatttggagtggaatgtcattaattgtgtttgtcacggttaaggaatagagaattaatctccatcccagtcttgctattcttctgaaagcctttagctgccgacaccatgggcataaggaggtatctcttctggcttctctttgggtgtggtagctaagttacagcttaccttggaaagatgagcagcttgtaagcaacaaaaaaacagtatagttaacaaatgcatcgtcaacaaacaaaacaacccaatcaaaaaatggacaacagctttgaatagacattctccaaaacaaatatacaaatggccaataagcatgtaaaaagatgctcaacatcattaatcattagggaaatgcaaattaaaatcacagtcaatgagatacaacttcatactcattaggagggctgttactgaaaaaaaaaaaagaagaagaagaaaagaaaaccaaaaaataggccaggcacagtctattttgagagcactttgggaggccgaggtgggaggatcccttgaggccaggagctcaagaccagcctgggcataagcaagacccctgtctctataaaaacaagcaaaaaacagaaaataacaagtgttagtaaggatgtagagaagttgtagcctttgcactgttcctgggagtgtaaaatgatacagttgctgtataggagtgagccaccgtgcccagcttgttgaaacaatatgctggttcttcaaaaaattaacatagaattactacatggttcagcagttccacttctggatatatacataaaagatttgaaagcgaggtctcaaacagatgtttgtacacctatgttcatagcagcattatttacaatagccaagctgtggaagcaactcaagtgtccatcagcagataaatggataagcaaaatgtggtgtgtgtgtgtgtgtgtgtgtgtgtgtatatatatacacagtgcaatatcattcagcctttaaaaggattggaattctaacacatgctacaacatggatcagccttgaagacattatgctaaattaaataaacaaaacaaaggacaaatattgtctgattccacttatatgaggttcctagaatagccagctcaggcagaaaatagaatagtggttgcaaagagttgggggagggaaaattagtgtttagtggatacatagttttcatttgggatggtaaaaatttgtagaaatggatgatctggtgattactgcacaagaatgtgaatatacttaatgcaactgagctttaggtttaaatgtggataaaatggcagtttttattttttttagatgaggtctctctcctgtcacccaggctggagtgcagtggtgcaatcacagctcactgtagcctcgacttcctggtctctggtgattctcctgcctcagcctcccaagtagctgggactgcaggcagacaccatcacacctggctaattttttgtattttcagtagagatggggttttaccatgttgcccagactggttgcgaactcctgggttcaagcgatccaccctcttaagcctcccaaagtgagccactgtgcctggccataaagtttatgttatgtatattttaccacaatttaaaaaagtgtttcaacaagctgggtatggtggatcactcctataatcacagtactttgggaggctgtggtgggagcatcacttgaacccaggagtttgagaccagcctgggcaacatagggaaaccccatctttacaaaaaaaaaatttatttaattagccagctgtggtagcccacgcctgtggtcccaactacttgggaggcagaggtgggaggattgattgagcctgggaggtcaaggctgcagtgagctgtgatcagaccactgtactctagcctggcctacagagggagaccttgtttcaaataagaagatttcaacaaaaagtaaataaaaatagtacaaagggcatctctattccctttacgcacgtttacctattgtaatattttacccagcttgttttatcatttgtgagtgtgcagtcatgtgtgctatatatatacacatgtaaacgtgtgggcacatttttttcctgaatcattttagggtagattatatgcatcatggctgtttacttctaattacttcaggaaaatttcttaacaatagacatattcttgggctgggcgaggtggctcacgcctgtaatcctagcactttgggaggccgaggagggcggatcacctgaggtcgggagtttgagaccagcctgaccaacatagagaaaccctatctctactaaaaatacaaaattagccaggcatggtggcgcatgcctgtaatcccagctactcgggaggctgaggcaggagaatcacatgaacctgggaggcggcagaggttgtggtgagccaagatcacgccattgcactccagcctgagcaacaagagcgaaactccatctcaaaaaaaaaaaaaaaagaataggtatattctcttaactattgtgattatgtaccaacttcacaaatttacattgatacaataatttaataccctctgaattccagttctgtcgatattgttttttatagcatccccctccacctcctgcagtatgggatacagtctagagtattgcatttatgcaatgtctctttagcctccatttgtcttttatgctgtggacatgttttagaagtatagtaccccttccccctttttaaatagacacttcctctttttctgaatgtttcctggtaattgaattgaagttatggctgggtgcggtggctcacatctgtgatctcagcactttgggaggctgaggtgggaggattgcttgagcctgggagttcaagaccagcctgggcaacatggtgaaacaccgtctctactgaaaatacagaaaattagctgagggtggtggtgcgtgcctgtagtctcagctacctgggaggctgaggtgaaagaatcaccggagtccaggaagttgaggcttcagtgagccatgatcacaccactgcattccagtctgggcagtggaataagaccctgtcttaaaacacatacacacatacaaattgaagttatgctgtctcagccaggagacttgcatacgtgttatatccttctcacgttatcacaatctggagactcaatacaatttcatctaaatgcataatgaggggaatcagcacatgctgtaggagatagggaagacatcattggaaaggaacctgatttgatagcatatttctaacatcttacttattttcccccggtgtcaaattttgcattagctcagctaatctgtattactgttttataccagtttttaagctcctgtattaaatataaagagaatattactgatttctgtttttaaatttaatgaaaccaagtgtgtctttcaaatggtgatcaaggttctactgattattaccttaaggttcccccaaaagatttggattggtataagatgacatggagctttgatgtatgagaacaagcctttattctcttcctggtttcatcaaatatgagtcagaatggcaagttgtactcttagctttgccgccattctagaaccttttagcacccctacttaagttacagaaagctgctgaaaagaaagtatttttcttgccaataccttttgtagaatatataactagtggtaatgctgatgtatctatcctcaatgccatttttctcttccaggctgtcttacaaaaatcattcaaattttgcctgcagaggtaacaggatatttggcaaaatatgattaaagcaaatatcagtttactgtatttcttgggatttttcttctcatgttataggaagcactggttaacacagttgagctatatttattggctgtaggtaggagagccagaggtatatttcaggccattattatttgtaagattatttccttcccatataccttctgtaaatgattccttggactttgtgcattttgtttctgcagtttgaagaaaacaggtctgaaacaaggtcttacccccagctgcttctgaacacagtgactgccagatctccaaacatcaagtccagctttgtccgccaacctgtctgacatgtcgggacccgtgccaagcagggccagagtttacacagatgttaatacacacagacctcgagaatactgggattacgagtcacatgtggtggaatgggggtaattgtttttgttgacttcattatactcactcaaagggctgaatcttgtggatctgttgagtagtttttgtcagaaaacctccgtgactctgtatgtgtatacctcaggatcaaagcccaatttgtgttttcttttgagctgaaaatttggttttgcagtgaggaagcagagttgctttggcaagtgaacaattttaatgggcttaccatttaaaaatcattttagtttcttatccttttctatgatgtatatgcagtcgtgcaccacataacaaagtttgaattaatgacagaccacatgtaggacagtggttccataagattataagagagctgaaaaatgtctgtggcctagtgatgtcatcgtaacatcaacagtgcattcattaccttttctacgtttagatacacaaataccattgtgttacaattgcctaaagtatttattacggtacacatttgtatcctaggagccgtaggccataccctaggtatgtaatatgccataccatgtaggtttgtgtaaacactctgatgtttaacacatttctcagaatgtcattaaataacgcatgacggtattctgtatgggcacctggcaacaaaaagttacctatcagcttgcttatcaagccaagggcattgcagatcagtgagaagtgatacttgagagactttgaaaacaccaaagtcttatataaagtatttttgaggtagagaatgttgtttcgtgttaatacaggaggacgaaacagttctccaaagaggtaacttctttctgatgagaaacaattaaattcttaaacatttgcccttatcctgagactaggcatgtcttagcatggaattcagcccaaattctatcttgaacagttgtagtctgcctgaacagctgtgtttgccctcctaattctctgtgcagactcatttggatgtttgcatttcctgtcccaatgtggtagacatttaattgttcagatcatacttttgtgataaaagcattttgacattcaagtgcaaaagaaagcaatttgaaaactaaagctacagctcctgtatgctgtattttatatctgactgcatgtgatttctgtaacctgtaagtggttagtggatggcttccctaaattgtcatagggcgtatttttaatcttgagtatgccatgaatttgtgtatgtgtgtgtgtggaaatgagtcttgctctgttgccctggctgcagtgcagtggtgtgatctcggctcactgcagcctccgcctcctgggttcacgtgattctcccacctcagcctctcgagtagctgggattacaggcaccttccaccctacccagctaatttgagtatgccatgattcttaacagtaaatacattgcctctgaatacagaggcactgtatgctgtaaagacaccattaaatgccagtgtggtttagtaccaataaatgttgttattactgataatctaacaattctcctcttatgtcacaggctttggactctaggtgacactgtgtttactataggaatttcagccgctatcttcaaattgagtgctttgcacttggttctgcttaaatggcactaaagagcccttttgggcttttggcatggttctgtttgcttgctggcatttgttttgtatgccctcccataggaagagaactcaaccagaagtaggagcattcttcccctacacctgccatgattattatgttgtccattgtttttagtaccttttgtcttttcattcactttctttttagctacttgaggaaaatgaatggttgaggtggttgatttggttcatattggatacttagtaggtccagaggattctatccagtaggatagaatttaggccttattggaactgtgtttgtcattcttcagagcaaagcgctctacattggaagcaggcaggggcaggaggaaaatgttggcatttcccttattctacctctgtttattacctctgatgttgcttattggtcacagaatatgggtatatgtagaggaggggatcgctgattatagtttacaatctataatgtgcttcgtactacgcatggactatccccagagcttgccctggagggcaaatagattaagcctatacatttgaaagccatttaccttcaaagaggcctgttaaaaatcagctgctgccaaagtgtggctagattgaaacagtcttgcaaaatgtttttagttcctgctaagtgccaacactggaccaagcactaagggacaagaatatataaaaattattctccggccgggtgcggtggctcacgcctgtaatcccagcactttgggaggccaaggcgggcggatcacaaggtcaggagatcgagaccatcctggctaacacggtgaaaccccgtctttactaaaaatacaaaaaaattagccgggcgtggtggtgggcgcctgtagtcccagctactaggggaggctgaggcaggagaatggcgtgaacctgggaggcggggcttgcagcgagccgagatcacgccactgcactccagcctgggcgacagagcaagactccgtctcaaaaaaaaaaaaaaaaaaaaaaattattctcttggggaaagctgtctcttgttggagacaaacgtatttagaacaaaccttaatacaagccagctccatgtcatgtgccaataaagatgtaaacagtttgggattagaaagaataattgaaaggtataagtttttctaattctaggatttgaaacacacgtattttaattggcctaatttaaaaaaaaaaaaaatacaatgggccaggcgcggtggctcacgcctgtaatcccagcactttgggaggccgaggcggacgaatcacgaggtcaggagatcgagaccatcctggttaacacggtgaggacccgccgtctctactaaaaattcaaaaaattagccgggcatggtggcaggcgcctgtggtcccagctgctcgggaggctgaggcaggagaatggtgtgaacccgggaggtggagctggcagtcagcagagatcgcgccactgcactctagcctgggcgacagagtgagactccatctccaaaaaaaaaaaaaaaaaaaaaaaaacctatttgggaattgtttgaaatacttcttatttctattacagctgctggtaatagattcctgtaatttgaattgatgctgataatttgaccgtttataagtcattttgtttgtgtccacagaaatcaagatgactaccagctggttcgaaaattaggccgaggtaaatacagtgaagtatttgaagccatcaacatcacaaataatgaaaaagttgttgttaaaattctcaaggtgagtacaagagataatttcagaggtatttggaatatagatttttaaaagtagttttgaagacttttttaaaacagcatttaaaaggtttttggtgccaaagcaaataaataaaattttattgtatcctatgaactcaatagaacaagttctgcttatttgacagatcgggaaactgaagcaagagaagtgatttgagttgactcatatagctaggttgtggcagagtaagggagcaaaggtacagtctcttctctcccagttattgcctaatacttatttcctttacttttcattatataatgaggcttttgttttcaataaataaatcattgcctctactttgtaaagatgaggagtcacaggactcgagggggacagacagatgatattagtgcagctagtcgggtgtaattgcccttgcttaggtgatgtgagtggtagggactgaaacaaactgggaaacacatgcctcttcaaaaggagttagctgcttctcagctgaagctgatgattgccctgcagtaatgcaagtccattgttgcttgatactctgttttgcaaataaaagccagaaatttatatttgtatatgaattttcctgacttttaagtgttggctcaagattttaaaaaaacaatgcacaggccagatttggcctctgggagaccaatatacaacttttaatttagttataactatgctgtgcactgtcatatattgggaacttagcatatagttccttaccacaggaactttttcatatttgacactgaaaagtagaagtttccaaactttctcaatttataacacttatactgtctttaatttttcacggtactcctaagtcaagaaatacctcatagttctctgtattaagtagcaaggtccaaatagctaagtaagttttgttttttttattgtttttgtttttgttttgagaaggagtctcgctctgtcgcccaggctggagtgcagtggcgcgatctcggctcactgcaacctccgcctcctgggttcaagcgattctcctgccttagcctcccaagtagctgggactacagatgcacgccagcaatgcccggctaatttttgtaattttaatagagacggggtttcaccatattggtcaggctggtctcaaactcctgacctcaggtgatccgcccgcctcggcctcccaaagtgctgggattacaggcgtgagccactgcgcctgcccgctaagtatttatatcttagcaacttggtagccatttaaaaagttattcacataaattaaaagaaaaaagttaaatttgttcttatataactataatttgttactgttgggttatgtagacctgttgctgcatagcttttcaaatgttgtcattggttggacaccaccaccctcatttcctgtcattgatttttgtgcagtacttgctttttaccacagcaactactgcaaacccagcttcacaaaaatatgccatcgcgaggagtataacacaatccatcacgaggagtgtaacacaatctaatgttgaaactacgaaccacctcaagctggcagtgcacccagtgtctggcagattcaacgatgggttgatgtgtcttcctcaaaaatgtaaagtgttccacagtattcctgtgcattgctggggtgcttcacatgccctttgagaaccagagagtttaagtatttatatctgtcttgaaatatgtagaaagagaactaggttggaaatcaaaacatgtgggtgactagccatagtagtccttttaacctaggacatgtttatccatctattaaaaagaatgttggctgagcatggtggcatgtgcctttagtcgcaggtcctcgaggggctaaagtgggaggatcgcttgagcctggaagttgaaggttgcacggatctatgatcaaaccactgcactccagcctgggcgatgagaatgagaccctgtctcaaaaaacaaaaaggatcaaacacaaaattgtgtgtatatatacatacgttggagactggagttctttgtgattgtatggtgatattcatatggaaaggtatatgatagaatgaggtgatatattattatttagagccacatgaaaagcatgcatagtgggtctacagttcagaagagggtagtagttaggaaaagctcccaggagctgtcttcaggctgaatgggaggaggatttggataggtgttgggtggaagtggtgaagggaagcaggctgtagagtgcaccaagataagaaaagaggaggagggaaaagtgagagaaatatttcatgtgaaagatgttatgtgaccatacataggagttgaacttggaaagagagattaagttggcgaaggcctggaaaaaataatctctgcatttccttgcagtcttaaaattatatgactatctcttctaggtaattgtgagcccttgatgattttgaatgaagggtgatttagaaagatttttttcagctcagtctttctaactgtattgtatattttactgtaactgtgggtaggtggtgtaagtatagatgaatttcctttgtaaaccatatttaaaatttttaatctcccctatttaataagacaaaagttgcattgatcgcattaaattcgggcctgagtcagctgcctggtctgtcacaaaccagctttttaagtttatagatttgaagcattctgtagagtagttttgtcaaccagaagctttttttttccactaaaaaaccagcagttgggttaatggaaaacaggaggtaagttgttgggttagtctctgcagggtggaaagatctcccagataatataacagtttataaagatctgaatagttgaagcaggaagagaagacttatattatcttgtttcttaggtagatattgtattgggtaagaggtcgtgggttgaattcaatggactacatggaagtcattagtaaaatagcttctgtttattgggtaccactttgcattggacctgttctaactgtggtatgtaaatcactaacaggcgagtatagtccctttcagcagtgagaaacatttaaatgcttttctgaacactgcacaaccacaaagccaggttttgagaactgtcaatgtttccaaaatctgcttgctttctgctatcatgtgcttgaggcttaagacaaagttaaaagaatttatagtattatttggtagtttctggacctggatcatcagcctggaaagtatctaaaaataaatcccccgtttccctctcaagattttgatttagtgaatcttggtgggttctgtgagtctgtatattaaaaaaatccaggtgattgttggtcatcaaactttagtaaccaccaatcttgttaatgaagagatgagatgtacttaacttctaagagttatatgcagtgcatctagtctgaggtgaccaacaccctaggaaaagacctgcacagtccagtacagcaggcacgcaggccacatgaggctgttaagcacttgaaatatggctgggctgaattgagatatgctgtaagagtaaaatacattagatttcaagggtttaatacaaaaaaaggtaaaatagattaataatttttatattgatttatatgttaagattttagattaataaagtacattaattttgtcctttttaaaattttcttgatgtggctactaacacatttaaaattacacatgtggtttgtattatatttcctttgggccagcactgttttagactattcaggagaaggctttataatataagcccaggcacagtggctcatgcctataatcccagcactttggaaggccaaggcaggcggatcatgaggtcaggagttcgagacgatcctgaccaacatgatgaaaccctgtctctactaaaaatacaaaaattagctgggcatggtggctggcgcctgtaatcccagctactcgggaggctgaggcaggagaattgcttgaacccgggaggcggaagttgcagtgagctgagatcatgctactacactccagcctgggcgacagagcaagactctgtctcaaaaaaaaaaaaaggctttataaaggaggtgcagtgggaccaaggccctcctcagaaaaaaatgaaaaggattccatactagaacagatgtggaaagaatgggtaaggacaaaggaatgtttaagatatgctctgcagaatactctttagaatggaggggttcatttataagagtattggcactttgggaggccgaggcaggcagatcacgaggtcaggagatcgagaccatcctggctaacacggtgaaaccccgtctctactaaaaatacaaaaattagcctggcctggtggcgggtgcctgtagtcccagctactcgggaggctgaggcaagagaatggcgtgaacccaggaggcggaggttgcagtgagccaagattgcaccactgcactccagcctgggtgacagagcaagactctgtctcaaaaaaaaaaaaaaaaaaaaaagagcattggtgatcaggctagacagttattattatgttatgtttcagccatattccgaaatctttcgaatacctcatttgattcttgcaacaatcttatgagatgggtactcttgttactcattttacacttaatgaaaggcttagagaggttatgtagtttgccattaacagccagcaggtagtaaaggtaggtttcacattgggcattgtgactccaagactcaccctttaccctcagggttgtgctacacaaagatgttttggccatccttgttgttggccctaattagaggaagaaatggaaagggcccatgtttcatcctaattgataaaaagtttgatatactttagtattactaacgatttaaattgctactttgtaaggttttaagacattaacatgtttaacatgttttaaaacattaacatcaagactgatgattgaaatgctaattctgcagaagtgtctggtctttggaatagaaatctttttttctttcaattcaacatttgtaagtacctgcagaatacctggcacagtgctaggagaaggattcagagacgaatgtgacacattttcttccttcaaggtgtgctcataagtaagccatttatcatttatgtattacactacgtgttgaaatactctgaaaaaattttttttttttttttttgctgatgtacttttcccctttcagccagtaaaaaagaagaaaattaagcgtgaaataaagattttggagaatttgagaggaggtcccaacatcatcacactggcagacattgtaaaagaccctgtggtgagtatagtaggtgttagcaaggcccgccagagctgagatggtgtttgacctggagcacaactggcctctttttgttccctcccccaaccctcatcattaagtcctgctttgaaagtgcttaatcagatataccatttaactagcttgggtctttctttcaaagagacctccacccacagactatttcttattcttctaggctaagagactgatagcactggaaactgaaatgtgttaatccattttgcaaactcaggtccgatgccgatgggcgatgggcgcattgtcgggctgcctagagcctggtgagacttcagctccatgtcttctgtttgaaatccatcccaaaaatgacctaagtgcggtgatgatcagagcggggagggcttgtagcaatagagggtttcttactactgaggcgaggactgccaaatttcaccacgcagcatccgcaaacattgtccccattaaagctgtcagggctattgctaatgtgtgtttttgtttttgttcttttcccctagtcacgaacccccgccttggtttttgaacacgtaaacaacacagacttcaaggtataatatataaccaactgtttcgggctagtgggtttttagaccacatagcctttggggatgatgctgttagaagagcttgcttcgcatttgtttttaaaaagcttttcatccttacagtgcaaattttaagatagaagaactcctatataagcagtgcccactttctgcatcttgatattttgcccatttgtttaatgttctttttaatgaccaacacattgacttctcactacttagttgacagtttctgctgatgtccaacctaatgaaggcagtaacacacgttcacttaggatctggccatatggcaattcgctttaaacaatagtgttcaggaagaaatatattgtatgtataaaagtagggactgcttatttcttaggattcctcataaactgtgggctatagatcttaaaaggcagggatcgaggaaggataatgtcaaattctgccataacacaaacctctataagagatatctcagaattccagtctatccagtggcctacttatttcacacagttccaattttacagaagaatatagctactcttttggagtaaaagtaaaaatcttcgatttgcctttccaccagtccagtatccagaatgttatatattaataaattagtgaattctgttgcagagatagggagaaaggaagaggaactgctttagagtcagaatgataatttcaagaaaaactttgtcagaagacgttgctaaccattaaagagacgtacctgtggctgggcatggtggctttcgcctgtagtcctagctactggggaagctgaggtaggaggatcgcttgagcccaggagtttgaggttgcagtgagttatgattgcagcacggcactccagcctgggcagcagagtgaggaccctgtctcaaaaaaaaaaaaaaaaaaaaaagatatgtccatgtaaaaaacattctgcaactctttggaaactggaaaggatacataacagttgttcagagtttactttccaattggaacaagaatagttttgttaaattgactcaacaggtttggtatcatgccatctgcatacccactggtgatctgcagggccaactatgtaaggcaaagatgagttagttccctactaaggaggcagtatatttgccaaaatgcctcttttgagaaggtctgaagatacatgaaaagcaaactaaattataggtgggtgtcagtgcatattaacgtatctagatcagtatgtttctgacagtggattatagcttccgcaatatatgtttaagtaattcttcatttttaagagttgaagacccaaagtatctctttaaagttaatgtaatgttggagaaatagagggcagtgaatggacagatcttggaacaacggtaaatgagccaagtcttggtttgaattactgtgagtgagggtgaaaaatgcctttctgtcagcattatttcatggctcaaacatttgtctttaacagcaattgtaccagacgttaacagactatgatattcgattttacatgtatgagattctgaaggtaagtgaaccttgaatactaaatattttttaaattggtcttctttttgttaaatagtcaattgatggtagaaaagccagcagattaactttgtaaagtatgttgaaagaagggacctctatataagtttttaataagttaatagtatcatacctgtaatcccagcactttggaaggctgaggcaggaggattgcttgaggccaggagatcaaaagaccagcctgggtgacatagtgagatccccatctctacaaaaaaaaattgtttaattacctgggcatggtggtgtgcacctgtaagtcccagctacttgggaggccaaggcaggaggattgcttgaggccaggagatcaagaccagcctgagcaacatagtgagaccctgtctctacaaaaaatttaaaaattagctgggtatggtggcttatgcttgtaattccagctacttgggaggctgtgacaggaggatctcaggaatttgaggcagcagtgagctatgattgttgcacaggctggagtgcagtagcacagagtaagaccctgtctctaaatacataaataaataaaaattaataataatagtatcagaacccttgtgctaagggttatggaatggggtctagtgggagtataatttagaacaatttgaaaaagggtatttgtaagatagctgggactgaccccttaacaaatatttgtaatttctgtggcccctatgtaagttaatattaaattttcaaaactcgtgaaaacacctgacgtgctagcttctggtatactttatctcacttaagagtcagcaaataaaacagtaaactttaactcagttctcaaagggtaattgtcctaaggattgtgtaaatttctgcttatagatgctaattgaaaatttacttacatttctaaagtggggtcaccaaatatcttgttcccagtagccacaagatcagcttcctagaagagagaattgctaaaagttggctaagctttcttactaaacaagagttgacataaagcctgctgttggagccttagaaatcccctgaggagattgtgccagcagagatacttgatctttccattggctcatgcagtttgtggcaagcaaggctttagaaagttacagatatgattgcccagccctgggaactgtaggaacccaagttgcccttcaggaaggacaagaatttggccaacaacgtcggctgactgaaaggctgggattaacaaaccccaaagattatactactcagttccctttagtttgaggttggaaacatttcagattggatttgatgacctaaatcaggcattggcaaacttctttaaagggccaaatagtaaatattttaggctttgtgggccatgtagtgtttgtcacactattcaagtctgctgttgttgcacaagagcaaccataaacaatatgcaaacaaataggcatggctatgttgcaataaaacattatttacaaaagcagacatcaggccaaatttggcctgtggtctgccaacctctgttacagactcttaatggctaaagaattactgttcttagaataagaggtttgtagtaaagatctgttttctttctttgaggggtctgtggaaataatctaggatctggacaagacagaaaaatttgaagtggtgcaatttgggtatactttgggtcttttaggacagaaaacatgttgaaacaactgtgtcagaaaaagatctctaagctcagagagctgagtttgcttgactgtgagatcatgaacaagtctctgaagcattgctgtggaagtgactgtgtcctcagcttgaatcccaggggtattgtgaggctaaaaggaaaatttacatggagggaaaagtaaaggactcttacgtattattcaggctaactcctttctgacccgttcatcccacaggccctggattattgtcacagcatgggaattatgcacagagatgtcaagccccataatgtcatgattgatcatgagcacagaaaggtaaagtgataggctgacaagtgttatttatctacatgatgtagctaattgcccatcttcaacactttatcccttgtgttgtcacaggccctagtacctattcggcagttgagaaatatttggtgaatgaatgtacgaatttacaagtcaacatgtttgaaccattatttatattcctaagaatattcccaagaaggaaacatgagtaaagtgggcaaaatgttcatcttctaagcccggaaacgtggcttctcgccttatttattgagtaactggtttcctgagaaactactttctctccatttgccttctttttcttacgtgtacagtgtgggtaataatagccctgcaggcgactaggtattcgtgagaattaaatgtgcacagttaagtggacgagatatacagaaaatgctgtttctgtttattggatgtcataagggccctgttgtctgcaaatgcttttacatgagagctgtaatggccacatgctttagcatttcagttttttaaggtgacaagctgtgatgacttgcctgttgtggtctctggggaggcaggtgatttatttatgcaactgaattacttttagacacacaccatgtcagaggcaccaccctagggctggggatatgtaagtgaactcaacatacaataaatgcttgtcttttaggagctacatttagggaggctggtgggatagaaagttattttgatgtagaagaaaaaacgaatagggaatggcaagagggtatttgcagttttaaaccagttataagggaaggtttcattggaaaggtgacattttagagagcactgggagggacccagccatgcagtcttatgaagaaacatgtcccaaggcagagtaaatagcaagtacaaaagcccttcaggtaaggatatgtttggcatgttggaagagcagcagcaaggataaagctgggacagaatgaatgcggggaaagaaggaggaaatgaaatcaaagaggtaaaaccaaatcatgtaaaaccttattggtcattgttaggccttttctctgaagatagagagcttttgcatattctaagctttagcatgttctcacttgaaatttaaaagttaactacacatttattagaacagctaaaataaaaaatagtgatggtaccaagtgctggcaaaaatgtgaagaaacttgatctctcatacattgctggtaggaatgcaaagtttggcattttggaaaatgcttaactattgttttatagttggttggtttcttgaaaagctaaacatatgcttaccatacaatcctgcagtggcatttatctcagagcaacaaaatcttaggtccacacaaaagcctatatatgaatgcaactatatttgtaatagcttaaaattggggggaaaagctgggtgcagtggctcacacctgtaatcattttgggaggccaaggcaggcagatgacgagttcaggagttcaagaccagcctggccaacatggtgaaaccctgtctctactaaaaaaatacaaaaattagccgggcctggtggcatgcacctgtaatcccagctactcaggaggctgaggcaggagaattgcttgaaccccggaggcggaggttgcagtgagccgagatcgtgccactgtgctccagcctgggtgacagagcgagactgcgtctcaaaaaaaaaaaaaaaaaaaaatggggaaaagtgcccttcaatgagggaatggttaaacaaactggcatatccataccatataatattattatgaagtagtatttctcagcaataaaaaggaaagaagtatgacacatgcaacaacttggatggatctcatgcttagtgaaaaaaggcagtctcaaaaaaagttatatgccaatgactccatttttgtagcattctcaaaatgatagagataaagagcagaggggttgccaggggttgggctaacacacaggacatgtgtgtggtgatggaacagttctatatcttgttgaggagattatatcaacttacatatgtgatgaaattgcatagaaacacacacacaaacacatgcgtgcatgtaaaactggtgaaacctgaataagatctttctgaattgtgccagtgtcagtttcttgattttgatattgtactgtagttatgtaagatgttactattaggggaaactgggtaaagggtgcagagaatctctactactttggcaatttcctgtgaatctataatctctccatagcaacctgaacaatccttttaaaaagctgtttatatttatttttaaatatttaattatttttaaaataactattaaactatttagtatttattaaactgtttagactagagggcaagagtgaaagcagtgagaccagttaggagaaggggctatggcaatatatcaaacaagaggtggtggtggcttggatcggggcagtggcagtggaggtgatgataatggtcacaatatgatagaaccttcagaattttttgacagattaaatgtgaggtctgagggaatcaagaatccagggtgaatcttaagttttggcttgtatgacaggatgagtatcacctttaaccgaacagggggagactgagtggaggtgcttttgcagggagtaatcaaaggtttagttttgagatacaggcagtaaacttagtgccagagcagtccgatgtttttcctcagggcctactgctggcacttcagatcatggtcatgctatgcacagtgggcagataagcttgcctcttacccctttttccatgtttaggatgcattttggtaaaagctgtattgtatgacttttctgttatttcatctatccagcaaatatttattcatttttctcctgtataccaggcattatgttgaattctgaaaattacaaaggtgaataaaacagtccctacccctaaggagcttgtcgtccatattgaaaaagaaaggtagaaaacataaagagtttaggttctgttaaagaaatatatctaaaattcagggggctgaaggcaatgatcagacttcattgagaagctgacttaaatattccaaaagttaaggaaatgcttaccaataggattataggctgggtagtagggacattttagtcattgagcagtttaagaaatttgtaaaagcacaggtgagattgtgtcttccaggaacaaaatcatggagaaagaggtttgtcaagctaagaagttttattttcattctaaaggctataagtagtcagtggaggggtttcagtaaagagtgacgtgtctggtatattttatcaagagtatgctaatggcacagtgtgggtagcttagagaaagataagattgctcatggtttattctttttcagctacgactaatagactggggtttggctgagttttatcatcctggccaagaatataatgtccgagttgcttcccgatacttcaaaggtcctgagctacttgtagactatcaggtaagaacagaagggcaggcacagttttgatcctgtgtttatttcgcacataatttaccaaaaaaaaaaaagtatcattttgtgcatttaggtaggccacttaatgcacattcacagctgtcctttttatatgaaatgtaaaatataaatcaccttaattcatgtaccatgacttacattacttttattgtcataatgtcggtagaatatgaataggtttgcatttgatcctgacttgagggaaagtagccaaagatatgttctataatcagcagttccagaactgttttgaattgtaagctgttttgtttttgtttttgtttttgttttgagacggagtctcactctgtcgcccaggctgcagtgcagtggcatgatctcggctcactgcaagctccgcctcccaggttcacacctttctcctgcctcagcctcccaagtagctgggactacaggcacccaccaccaccccagctaatttttcttgtatttttagtagagactgggtttcactgtgttagccaggatggtctcgatctcctgccctcgtgagccaccacgcccggccttttgtttgttttctgaggcagggttttgctctgttgcccaggctggagtgcaatgccatgatcatagctgactgcagccccgaacttctgggctcaagtgatccttccagcttagcctcctgagtagctgggactacaggcgtgcactaccacacccagctaatttttaatttttttgtgtgtagagagaaagtctcactatgttgcccaggctgatctcaaactcctgggcacaacccatcctcacaccttggctccccaaagtgctgagattacaggcatgagccaccatgcccatcctgtaactaagtttaaccaatcttcagagtaaattcaagaatgttttcttgttcttctgaattgtatactaaataaaaaggtcttctccccagctcccccaaaaagccttctttctcctcacagaaaaaggagaaaggaaccaaattaataatagatttgccaagtgtttaaaaatctgaagttttcttgggagtatcttttatgcccagtctttccaggttattatcagttgattttaaaagtttcagactttttgttcttgtaggaatttctttcttggggtcttaaggctatagccctgagttcaaaaagcattttatgcataaaaatagtttttacagtattactaataattgtgaaaaacagaacactgtcctattataggaaaattaaagattgaattctgaaacatttatgtaataaaatactaatgatacacattagatggtctccatgggctaacaatttggaggttttttttttttttttttcatgtaagtgaagaaaacaattcaaaatagtatgtatattagctgagcatagtggtgtatgcctgtaatcctacctactcaggaggcctaagcccaggagttggaggctgcagtgagctatgatcacgccactacactccagcctgggcaacagagcaagaccctgtgtctttaaaaaaaaaaaaaaaagagccaggcacagtggctcacgcctataatcccagcacttggaaaggccaaggcaagtggatcacaaggtcaggagctcaagaccagcctggccaagatggtgaaaccctgtctctactaaaaatacaaaaaaattagccaggcgcggtggtgggcgcttgtaatcccagctactcaggaggctgaggcagagaattgcttgaacctgggaagctgagttgcaatgagccaagatcacacccctgcagcctgggcgacagagcaagactctgtctcaaaaaaaaaaaaaaaaagtaaaaattgttttaaaaccgagtgaaagatgcataaaagaaaaaactaaaaaaaaaactaaaaaaaaaaaaaaaagaaaaaactagccaggcacggtgggtcatgcctgtaatcctagcactttgggaacctgaggcgagcagatcatgaggtcaggagtttgagaccactggccaacgtagtgaaaccccgtctctactaaaaatacaaaattagccaggcatggtggcacgcgcctgtagtcccagctagtcaggaggctgaggcaggagaattgcttgaacccgggaggcggaggttgtggtgagccaagattgcgccactgcactccagcatgggcagcagagtgagactctgtctccaaaaaaaaaaaaaagaaagactaaaaagaaatatatgaagatgttattagtgttttgattttgagtcagtggagtgatttttttttaattttaaaaattaattttttattttgaagtgacaagcctgaggattcacagataataacagtgagtttacttttatgcagatgtacgattatagtttggatatgtggagtttgggttgtatgctggcaagtatgatctttcggaaggagccatttttccatggacatgacaattatgatcaggtaatatatgttatacccattgaaaaatgtactggcctaatgcaatgatagccagcactgcctgtaactttcagttcactgtttattcagccaccccgatattgatccttagattgatgtttcgggagctaccagcttagccttttgaaatcagacattcccccctagtctttgtcatttgcattgcttattttattgtgaagaatacatataaattgtcatccagatttttaaaataggacattaccttagaattctcctaataaacccttatctccaatatggtgttttctccaatatgtgagcccatatgtggtatttctgtgatccttttggctctttatatgggttgagttacagatgtttcttaaactaactccacttcccccttgaagatcaaagggctctttcattcacaagaacctggaatgattctaggaccttgtggaaggtaccattgtcttgttccctttgagcaccatgtccaattttaatgagtcaaagaatacaacctgaattccattaaagtcaataactctgtatcaagtgcatgcagtactgaggaatacagaaaaaagaaagaatagttttcttcccctcagatagttcatagctgatcttgtaagggagtcaaacatacaacaaaataggttacagtcataacttcagagtagaaatgtggacaaggcacaaaaggcagtagtggtgagtagtttgagtgtgcaatgggagcttcccaaaagaagtgacatcttcaattgggttttgaggggagaaaaataagggttcaccagggtgacatttcaagaggaagaaaccagtttataaagtagtttgctttttctaacactatcacattgagttgaagtctaaactgttaggaggtagcattcatacctgtagacatgatgacccgtttatgtaaattcaatcattgttaattgttgatttgttaatataatatgcttgtgatatgggtttttgtctttctttaatactagttggtgaggatagccaaggttctggggacagaagatttatatgactatattgacaaatacaacattgaattagatccacgtttcaatgatatcttgggcaggtaagtcatgaaacaaaatatgtgcatctgtggcttaagcactttgagagtgaactggcacttaggatcttcaaaatagttatgttttctttgccagcactgtcaggatgtcagtggtccagtgccacaggatgctgcattgagcaggcctctgataaaggcattggattgaatggccctttattcaaattaacttacaggagtctgatggaggggttatagctagaggattcctacaaaatgaatgtagattctagtagaagggttacagttgaggcaaaaatcaaaatttaccttgcttctttaagtgaaaaacctctctccaagagaaagaaattgaagtagaaaatgcatgctttaagactgatgtgcaggctgggcacggtggctcatatctgtaatcccagaactttaggaggatcacttgagcccaggagttggagaccagcctggacaacataatgagaccctcgactccatgcatggtgatgtgtggcagtagtccagactactaggaagctgaggcaggagcttcccttgagcccaggagggaatgctacagagagcaatgaacatgtggctgcgctccagtctgggcaacagagtgagaccctgtctccaaaaaaaaaaaaaaaaaggctatatgcagacaaccgactcttaacagtagtgactagatatagtacttatacacttaaccactcaacaggaggagatggactttcctgatgcaaaggcttttgctggccaattggcagagatgccaggaatatgtgtggggatgggaaataggcctggtgagctcagccacctgaccctccttgctacacagaagcggtcacgtcctgtcaagtaacctgaattatgtttcttaaaattgagaggactcagatgtcttttttcactctagctatgttgtttccagtctccagttagctttgttgtcccactcagtggcagagcggtgcaagactaccctcttgagtttggatccctctttgcttttgtctgggctgttagccactaagaaaaatgtaggaatgaaatgttgggcttctgtgcccacgtggcccatttctcatgccctcttttggtcctgcagacactctcgaaagcgatgggaacgctttgtccacagtgaaaatcagcaccttgtcagccctgaggccttggatttcctggacaaactgctgcgatatgaccaccagtcacggcttactgcaagagaggcaatggagcacccctatttctgtgagtccagatatctagcccacagagtttgtgcaggcgcagagtcctatagaacagagtcgtaatcccagctcctgtcagcttgctgcaaagttaattcacccacactgagcctcagattcttccagtggggatagtgatggcaactacattgcagaattactggaagaattcttctgtaacagaatacatgacacaagagcattcctaaataaactcttttcatactgtgaggatgacacttctcagtgcctcagtctggaatggttgaattagaatacacagccctgtatctttcctgtccctagtaatcattcgttggaaagagctaatgaggcttacaaatcttaaaattgtatgaacaccttgacttagatttgtgagtatagccacctgtgccatcctaagtgaaaataccactgagacccaccccatctgcactgtgatgttagctgcaacatgacatttttccttcggtgtgatggttttgtactgaatcatttatacttttgcccaatacctgaagcagatagataggctgattgggatagagaatgtggtcatagccctaagctacatggacctatagctttggcctacttggtactgggctgtggacacactggtaatatattaccgtctttgccgagttacagtgtcttgtctccattaaacctcaacaggaccagggcttcattaaattcgctctgctataaataattacctcatctttctaccatttgattgaaaggttagcttttaccacagtttgataggaaagctatttctgctttttaccacttgtctaattcatggtgaaggcaattgccaccttaagttctttggggaataatgtagagtatatataaattgcaaagaatgaagctggctgctttcaggcttccagaccattagtttaatctttcaagcaaaacagaacctagcctttttgtctcttttctagacactgttgtgaaggaccaggctcgaatgggttcatctagcatgccagggggcagtacgcccgtcagcagcgccaatatgatgtcaggtcagttcattggtaaattttctttaaaaaaatgtggaagtcaattactgttcttagctttgtggtctgatttcttgtataccttctcttctccgtactggtggccttgtgacttttttttaaccaggtttcagcatgcttgacatttggtatactttagtgatactgtcttgagtagggtatccccttctaggctagaatctcagcattcctggctgaaaatttttggcataggggcttgaaagtgccaagccatgaaaaggaaaaatacaccatttcatcttatagtttgaaatgacagtagttacatggcccttagaaacaatgttaagaaatggggtatagaggtggggtttatacataggtgtgtatgtgtacaaggacagttccgtgacatgtgccagagcaactatagagtgcctatcagttgtaaaaacataagtaaaatggttttccattattggatcattgtgacgcacagtgaatttttatagagtacccagttattccaaaggaactacaggcacatagcataagaattatacatataggcaacatccaagtgggtgcatatctggtagtgaaggcatttacttacatatcctcaaataattgctgttgccctcctcttttttaagaaaagaactaactgccttctagaatttaccccttgagtatcctacctctgtacagagtaatgtatatccaaacttacttgtagccttatttgtaataacaaaacattgagaatagctatcagtaggaaactggttaaatcagttatggtatatccatttaatggaatgtggtgcagccagtagaataagagtttcatgttctgttagatctccaactccaatataataatgtgaaatttaaaacgcaagatgcagggccaggtgcagtggctcatgcctgtaatcccagcactttgggaggctgaggcgggtgggtcacttgaggtcaggagttcgagaccagcctggccagcatggcgaaaccctgtctctactggaaatacaaaaaattagctgggcgtggcggcggcgcctttaatcccagctacttggaggctaaggcaagataatcgcttgaacttgggaggcagaggttgcagtgagccgagatcgcaccgttgccctccagcctgggtgagagtgagactctgtctcaaaagaaaaagtgagatgcagagccatgtctaagaggagtggagaagaatgtataataatgttctcatatatatatatatatatatatatatattttttttttttttttttttttttttttttttttttttttttttggagacaaggtcttgctctgtggccaaggctggagtgcagtggcacaatctcagctgctgcagcctccgcctcccgggttcaagcgattctcccacctcaacctcccaggtagctgggactacaggcgcccgccatgacgcccagctaatttttgtatttttagtagagatggggtttcaccatgttggccaggctggtcttgaactcctgacctcaggtgatccgcccaacttggcctcccaaagtgctggcattacaggcgtgagacactgcacctggcctttgtatacttttttgaaccttttgtattttgaaccatgtgaatgtattacctgtgtgtacacacacacacacacacacacacacacacaaaaacatgattagagaggtggaagaaatcaaatggaaataaattccaaaacacaattttatcttagaaaatgctctttccccattcaaattgactttcagtaattttgaaagctgccagctatcaagacagcatggtgtaagagcacatgagctttgactgcagtcatgtgctgttcagtatggtagtgactagccacgtgaggctatttaattacaattgaataaaatttaaaatgtagttcctcagttgcactagccatatttcaagtgctcagcagccacatgtggttggctactggtcaccagggtggacatctctgccctagacaggcctgggttagaatccaaccatggttgccacttgcttaatcgtgtactttggacaaactccttaaattgtccaagcctagatttctttacctgtctcttaaattgattaggacttgccactttaacttgaatttgtgagggtcagacttgaagtatatgtaaaaatccagctaagaggaagtcttcagtaaagaattattgtgttccttttgcagtgagtgctatgagaaactggtaagattgccatggttggtgtctttggctcactgacagctcttttctttcagggatttcttcagtgccaaccccttcaccccttggacctctggcaggctcaccagtgattgctgctgccaacccccttgggatgcctgttccagctgccgctggcgctcagcagtaacggccctatctgtctcctgatgcctgagcagaggtgggggagtccaccctctccttgatgcagcttgcgcctggcggggaggggtgaaacacttcagaagcaccgtgtctgaaccgttgcttgtggatttatagtagttcagtcataaaaaaaaaattataataggctgattttcttttttctttttttttttaactcgaacttttcataactcaggggattccctgaaaaattacctgcaggtggaatatttcatggacaaatttttttttctcccctcccaaatttagttcctcatcacaaaagaacaaagataaaccagcctcaatcccggctgctgcatttaggtggagacttcttcccattcccaccattgttcctccaccgtcccacactttagggggttggtatctcgtgctcttctccagagattacaaaaatgtagcttctcaggggaggcaggaagaaaggaaggaaggaaagaaggaagggaggacccaatctataggagcagtggactgcttgctggtcgcttacatcactttactccataagcgcttcagtggggttatcctagtggctcttgtggaagtgtgtcttagttacatcaagatgttgaaaatctacccaaaatgcagacagatactaaaaacttctgttcagtaagaatcatgtcttactgatctaaccctaaatccaactcatttatacttttatttttagttcagtttaaaatgttgataccttccctcccaggctccttaccttggtcttttccctgttcatctcccaacatgctgtgctccatagctggtaggagagggaaggcaaaatctttcttagttttctttgtcttggccattttgaattcatttagttactgggcataacttactgctttttacaaaagaaacaaacattgtctgtacaggtttcatgctagagctaatgggagatgtggccacactgacttccattttaagctttctaccttcttttcctccgaccgtccccttccctcacatgccatccagtgagaagacctgctcctcagtcttgtaaatgtatcttgagaggtaggagcagagccactatctccattgaagctgaaatggtagacctgtaattgtgggaaaactataaactctcttgttacagccccgccaccccttgctgtgtgtatatatataatactttgtccttcatatgtgaaagatccagtgttggaattctttggtgtaaataaacgtttggttttatttatcaa

SEQ ID NO: 36833 - DNA, 9454 bp, Homo sapiens
gccaattagcggcccaacgccccttccgcgcctcatccgggttcccgggacgggaaagtggcgtggtaaccaggcaactactgatcaatcccctccccggctgatttgcgcatcaggtagtcgccgctctactctcaacggtggcgagctgcagttgccaagtgccccgtccccgttgccataacagcagtacacaacccctccttcccctcgcccgcttgctaaacagtccttccctctcgggaccaagggcctctccagaactgcttctgattgagcagaaacagggtctgagcccctttgctaaggcgaattgagtgggagggttggagactgcgctttaggctggtgtaccagagggcccaaggaaattggcccagtggggagggaaaagtagaagaaatgaatggagcagggattacggatggcgcaatgggagctgagaggagaggaggaggaattggtagggaagattggagagcatggcttaagggggaggtgggaagaatgggggagagggaagcccaggaaatagggacacccggctgctggaggagagctggagtcactgtgaaggacaggaaaggcctgggggtgtgggtgacatcctgaagggagggggtcctcagtggaaagtgtgaagtgggagttgagaatcaaaatgagatgttcacagggataaggaaagaagcctagagttggtgggtcagaagtcatgggggtgatgggagtggcacgtgtcaatgacgatgaaggagctgaaggctggcagaagctgatgagaccttctttttcaggaggaggactgagcttatctgactccagagctttcaggagggaagaaagatgtcagatgaagatgatctagaagactctgagccagaccaggatgattctgagaaagaagaggacgagaaggagacagaggagggggaggactacagaaaagagggggaagagttccctgaggaagtgagagcctggacaaggaggggtcctagggctgaaggagggggttgggcaggggagagacaccttactccacttctacctgcagtggctgcccacccccctcacggaggacatgatgaaggaagggctttctctgctctgtaagacaggcaatgggctggctcatgcttatgtcaagctggaggttaaagagaggtgcgttttggggggaccagatgaggactgtgagactgtagggcccctatctcctttcccactgtcattcctgggtgttctggttgagagtttgactcttctcatgcctagtggaaagggaaggacagaatttacttttcaggagctctgagacttctcctatcaaagctgacctggggaattggagattgagagtatatggggggattcctgctggattcccttatttgtctttcagagtatgggttctctgtccttcacagacacaggtctctctgcccactgttaagaacccacctaccttctcttacccttcttctcccctaccatctgttgcccattcttctccccattataagccatctccatattgccttctgctttagcaactctgccagtcctcactgggtgcttaaccctaaacctggtttcttctccctcttccatctcctagggacctgacagacatctacttgctgcgctcctacatccatctgcgctatgtggatatttctgagaaccacctgacagacctgtctccactcaactacctcacccacctgctctggctcaaggctgatggcaatcggctgcgaagtgcccagatgaatgaactgccctacctgcagattgctagttttgcttataaccagattactgacactgaaggcatctctcatcctcgtcttgaaaccctgaatctcaaaggtgggtctttaggatgggctacacaagattctttccttcctagcctgaggccaacagaagtgggcagtatggtccttggctagggcacatggcagtctgcattcattcattcattcagatacgcaatatgattcattatgacagttctacatgctaaccatataggatccaataagacaaggaacgtccctattctcatatagcttatattctaattgggagagacaaacaagtaacaacaaacacagtaagtacattcatgtagcatgttaaaaggagacaagtgccttggaaaaaatagatcagagtaagaggaatgggggacacaggtggcaatgtcaaatagattggttaggacaaccatcactgagaagatgacatttgagcaaagaattgaagaaggagagggaattagacatgtcagctgcttcattcactcttcaaaggcttaggtggatatgtccatcaggaccttggactacctaccacaccacttgcctcagggctccagaggtattaagtctggagctggccttcctcagtatctaccctgctttgcgaatggtaggatgatttagaggctccccaaattcaggctctaatgctgagcatttggagtggccctttgagctcttgaaaccctcctccccagggaacagcatccacatggtgacaggtctggaccccgagaagttgatcagcctgcacacagtggagcttcgggggaaccagctggaaagcaccctgggaatcaatcttcctaagctgaagaacctctacctggtagctcactgggtcagagggtggtgcagggaagagggcactgtcctgggggtcaggatgcctgctttctagtaggctcagctactaacttcatcattatgataataactggtattattatcaagaccatagttggttccagatgctgtggagatacacagccacctagcagggctgataatatataatgtgtggataatacagagataatttaccttgatacaggtagtagcaaaatggaccataattgaggtacaaacatcagtctgtggaaatgttttaggaaaaccctcctctcagactgggtttttcttcagctcttacactaccaccacaacaatcatcaacatacgacttccgggaccaaaggtgtgggggtttctccccatacaccaagtagtagacaccagctgggtgatctctaattcgattcactgtctacctggggatggcatcaaatcccacagattgagggctcggttcccaagagtgacccctacaccgcccacatacaccagttgcaagtccaagcctccagaacttctgacacaccagcttcaacatgaagctggttcccatgacctcttctctggatttaattaattttctagagtggtttttattagtttattgcaagggcaaaggatacagatgaagagatgcttagggcgaagtatggggatatgggtgcagtgctccatgcccttcccagatgcatcaccctccaaaagctttcacgtgttcagctacccagaagctctctggacccagtcctcttggcttttcatggaagcttcatgatcttagtattccttcccccaggaaactggggaggctgtcgctggggagggtcttaagaaccacaatcaggccgggcgcggtggctcatgtctgtaatcccagcactttgggaggctgaggcgggcggatcacctgaggtccggagttcgaaaccagcctggccaacatggcgaaactctgtctctactaaaaatacaaaaattagcccagtgtgctgacatgcgcctgtaatcccagctactagggaggctgaggcagcagaatggcttgaacccagaaggcagagtttgcagtgagctgagatcacgccactgcaatccagcctgggagacagagcaagactccatctcaaaaaaaaaaaaaaaaaaaaaaaaccaaagaaaaacacggtgaaaccccgtctctactaaaaatacaaaaaaaaaaaattagctgcgtgtggtggcaggcacctgtagtcccagctactcgggaggctgaggcaggagaatggcgtgaacccaggaggcggggcttgcagtgagccgagattgcgccactgcactccagcctgggcaacagagctagactctgtttcaaaaaaaaaaaaagaaagaatcacagtcagaaagagggagtggggggaaagattagcgctttctcttggagcaggtgaaaagacggctggagaagttcctgagacctgcccctgaggcccagcacacccaactttataacaaaagactgcaagaagggctattatgggggttataagctagggactgtggatgaaaaccgatatatatattatatattatataattatatattatatataaatatatattatatattatataattatatattatatataatatataattacatataatatataatatataattatatattatatattatatattatatataaaatatataatatataattatatattatatataatatataattatatataatatatataattagatataatatataattatatattatatataattatatataatatattatatataattatatataatacataaatatatataatagtatatattatatataatatatataatatataaatatatataatagtatattatatataatatattttatataatatataaatattatatataatagtatattatatataatatataaatattatatataatagtatataatatataatatataatatatattttatatattatataatatattatatattatatatataataactccacaggaagccactgaaatatttagtcttttagactcttaagcttcgttattctgggatggtgctgatgccaatcctcagtggtggcctgggggctcctgggccgggtaggggtgggttgaagcatctcctccatcccaagtggctttgatggggcgaatggtagagggttactgctgacctttctctgggatggcagcttctcctgaacttctttactttctatactgatctctactcacccccactcctttcttccactcctccctctctacctcttggatttcctcttttgctttatctcattctgacttctctttcttccctatccctgctccctctcaatcaatccactgtgccctgggggtctaggcccaaaacatgctgaagaaggtggaaggcttggaggatctgagcaatctcaccaccttgcatcttcgagacaaccagattgacaccctgagtggcttctccagagaaatgaaatcattgcagtacctcaacctgaggtatgcaccctctccaagccccaccttgcccctacccctgaccaggtgcagcttttgagtctgtgttcttccctggcccaatcccccagtcctagcccacagctggattctcaaggaaagcccggctttccttcctttcttctgcactgagttgcaacactaaatcccttatagcttgtgacccctgaatttttattcattcaatccacaattattgagaatgtgctatgtgccaggccttgtgctgtgttttggggacatttaaagcaatcagaggctgggcatggtggttcatgcctgtactcccagcactttaggaggaaggatcacttgaggccaggagttcaggaccagcctgggcaacctagtgagaccatgtttctacagaagtgaaaataatggcccggcatggtggctcacacctgtagttctagcactttgggaagccgaagtgggcagatcgttggagcctaggagttcaagaccagtctgggcaacatggcaaaatcccatctctaccaaaaatacaaaaattagccaggcatggtgacaggcacctgtaatcccagctactcaggagacttaggcgggaggatcgctggagcctcgaggtggagtttgcagtgagctgagataaagccgctgcactccagcctgggtgacagagccagaccctgcctcaaaaacaaaacaaaaataaaatattaaataaaaattaaaatattaaattaaaaataaaaattaactgagcctggtggtgcacacctgtggtttcagctactcaggaggctgaggttggaggatcacttgagcccaggagttcaaggttgcagtgagccatgattgtgccactgcactccagcctgggtgacagagtgagctgtctctaaaagaaagaaaggaatcagaggtgattcctgttcctaaggggctcacagtctggctccaactcttttttcctcaccctatcctatataagtttccactgcccttctccatttcctcggtcccaattcaccttcccatttcctgcctctcttctcctgagccccacctgtaagggatgacctttttactgattaaaaaaacacaagatgtgctcagatttgaggagagaaggacatttgtaagaaaatcttttggtagaaaggcactgaagatcagcaactcttgtcggatggaggactttatgtgtgtttatttcagcaaacatgtaaggaaactgcctctttccttagtcaacaagaccagattcttgagctggtaatggaaagagcatctccaagtagggagaggtggttgcatctggaagccccaactctcatcctgaccccctgggcattctcttattcatgaactctgccacacggatctggtggggtgtgtatctgtgccatcttcctgttaatgatctagacaggcatgatggacccttcctgagtggctattaaatggggatgttttgagagtaagtcgggtgtgtgtgtggaggggggtgagggtgtctcaatgattggcaggtgcctctggggccagagatgctaagcatccaacaatgtatggcagagtccagtacaaagttcctgtagccctcctggtgagaaacactgcatgaggctcagcacgaccatgagatcaggctgaaacacttaaatagatttcataaaagcttaaagccagaacatgaaaataaataaaattccaggcatggtggctcacgcctgtaatcccagcactttgggggggccaaggcaagaggactgcttgaggccaggcgttcaagacaaacctgggcaacatagtgagacccagtctctacaaaaaatttaaacattagccaggtgtggtggcacatgcctggaggtacttaggaagctaaggtgagaggatcacttgagcccaggaattcaaggctgcagtgagctatgatcatgccactgcacccccaaccggggtgacatagtgagaccctgtctcaataaaaataaaataaaaacagagtatcatataatgaggcacattaggagatgaagtttattcttcaggttgggaggctccaacccatccatagccttaggttctctttgtggagagcacgaaccgagcatccaccaccctaaactccagcttagatcccagttccttgtccactgacctaggtcctacagggtggagtgcagtggctcgatctcggctcactgtaatctcaaactcctggggtcaagcaatccctcctcctcagctaagtagcaaggactacaggtgtatgccatcacgcccagctaatttttttatttttagcttttgtacagatggggtctcgctatgttgcccaggctgggtcctaccttctaccctccatttaggtgtgatcacagaaaatgtctctccctgtgaggaaaatttgccctctcctccccagctacaagacagggttgtggcctagctttgctgcaccaaaagaacacatgaatgtattacagagtagaatatggcacttagggattccttgaagggcagaagcaggaccagagcggggtcacacagcacctctgcagtaaatctggcaaggcttggcaggccagtcctcacagtgtttctagggacactggaaccccgagagtcccccagaggccccattcctagcaactggcaaccaaagcccattattcctgcatgaacccctcctgaccacactggcaggggcaacatggtggccaacctgggggagctggccaagcttcgagacctgcccaagctgcgagcgttggtgctgcttgataacccatgcacggacgaaaccagctaccgccaggaggccctggtgcagatgccataccttgaacgcctggacaaggaattctatgaggaggaggaacgggctgaggctgatgtgattcgacagaggctgaaggaagaaaaggagcaggagcctgagccccagcgtgacctggaacccgaacagtcattgatctagcagcagttctagcctctaaagatagtaaggaagcctgcagggaggcagtgggaggaggccaagggctgggcaggtaggggaagaggcaagaggggaagctgctgcagaaggaggtgggagaggaaagcatcagacaagcaggacccttaaagagaggagggttaggagtcagggagaggaaaagggacccaaggggcctgggaccagctgagaaagacttaggaggccagaagagtaagtgaaaagaattggggtggcaggcagaggagttggtggggggtggggcagccatacctgacacagagtgaagtcggctaggaaaggacaggtgtgggtgcatggtaggggctgcaggggaaagttggtggtgtatgcagctggacctaggagagaagcaggagaggaagatccagcacaaaaaatctgaagctaaaaacaggacacagagatgggggaagaaaagagggcagagtgaggcaaaaagagactgaagagatgagggtggccgccaggcactttagataggggagaggctttatttacctctgtttgttttttttttttttttttttttttttttgcgaggtagtcttgcttagtctccaggctggagtgcagtggcacaatctcagctcactgcaacttccacctcctgggttcaagcaattctcctgcctcagcctcccgagtagctgggactacaggcgcatgcaaccgcgcctggctaatttttgtatttttagtagaaacggggtttcaccacgttagccaggatggtctggatctcctgacctcgtgatctgcccgcctccgccttccaaagtgctgggattacaggggtgagccacagcgcctggtccctatttacttctgtcttctacctccaggagatcaaagacgctggccttcagacctgatcagactcccaggggcagccaccacatgtatgacagagaacagaggatgcctgtttttgccccaaagctggaaattcatcacaacctgaggcccaggatctgctctgtgccggtcctctgggcagtgtggggtgcagaatggggtgcctaggcctgagcgttgcctggagcctaggccgggggccgccctcgggcaggcgtgggtgagagccaagaccgcgtgggccgcggggtgctggtaggagtggttggagagacttgcgaaggcggctggggtgttcggatttccaataaagaaacagagtgatgctcctgtgtctg

SEQ ID NO: 36834 - DNA, 229264 bp, Homo sapiens
gggggaagagacgcttggggctggggctcaccggacgggtaggtccggctctccagggagaggagctgcccggccctggagaaggggcgagtcctgcgcgagtccccgggaggcgccgcgcgcttggaagggacggtcgggcttccccggcccgctgagggctcggcggcgggctcccctcctttccacctcgggagggagggaaggaggggagggaaaagtcccacggaggaggcagaatggccagtcgaggggcgcttaggcgctgcctttccccagggctgcctcgactcctgcacctgtcccgagggctggcctgagacgggactcccggttctcccgctgcgaagcagcgcggccccccggggccggggcagcggcgccggcatgtcgtctggcaccatgaagttcaatggctatttgagggtccgcatcggtgaggcagtggggctgcagcccacccgctggtccctgcgccactcgctcttcaagaagggccaccagctgctggacccctatctgacggtgagcgtggaccaggtgcgcgtgggccagaccagcaccaagcagaagaccaacaaacccacgtacaacgaggagttttgcgctaacgtcaccgacggcggccacctcgagttggccgtcttccacgagacgcccctgggctacgaccacttcgtggccaactgcaccctgcagttccaggagctgctgcgcacgaccggcgcctcggacaccttcgagggttgggtgagtagcggtgaccccttccctttgtgtccacccaacccccgttccccttatgtttttcaaaactcacccgggtcccgctttcccatcgctttgtggctgagggaattccctccagactttggtcttcgtccacgtggccgcggcactggtgacgcgaccgcggtgggtgtgtgcaggcgcaggtgtgtctccaggaagccggcctggacacgatcccctttcaggacagcggcttggcctaacgggaagtcgggcaggggtccagggcggtcaccctttccgcccagtctttgggtaaggagctccaactttcagcacgagagtgataggtaggaaaggcagggaaggagtgatacaaaagggacttgatttgggtaaagtgcttcaagcgctacttaggagaaagccgtacattctcgcgagtattattcataatgtttatggatacatgttggttcagccgctcagacgtgcacacgtgtttcggcttgcacatcccagaggtacatgagctacactggcagggaaatgagcgcctgggtctgcacgttggcagttttattatttagcatttttccaaggagatgagatttacatatacttgcaagtaacttagtcagtccgaggtgggagtcctgcagtgtgggtttctgctgctatgggtctgagaagaggctgtaaggactcctcaggaggttgttaactgtcttccctccccccatcaccagcctgtgttcctgggtattgacgtgtagctacccgcagctctccccttgcctctgcttttcacatagttcccaggaggcataatttctgctgtaaatcaattaaaacttctagagcgctctacacggtgctaacatgcttttactgcctaatcctcacactgtctttgtgatgcaggtgtcatcgttcccactttgagatgatggaatgataattataataaagtagtctggtttggcaaagtggagtacgccatttgaagactctcaggagtttaatagtttaagttctggagggagtcagttttgaacccaatatcagtattgaaaatgtttgaaatttacaagtggtgaaatcagatggatggtgatgaaggctcatttaggtatttattttatactttgtggaattagtaattttaccgtatattttctaaaattaaagatggcttgtggagctattcctttcttttaaatagaagtacaaaaaccataatgactaaccttaatcgtcaaattatattgagttaatttcccttcagcctaatttactttgtggtacttagaagtggggactagagaggaattgctaaaatacagttagatatttacatttatcctgtgaatttctggaaatgaaatagaagtgagtgtaggcatccagatggaattgttgagttctattagtgtctgattaggagttaggtcgggcaaagctctagaggaactaggttctgaattatggtggtgcagattggccagtggccatgagaagcatctcttcctggagatagcctagactcgtccttctcaaccataatcttcccacttgaatcacccagggacctttaaaaaatccccacttttaaagattctagataggaatctctggctgtgggaccccatcatccgtacttttaggctcaccaggtgattccagtatgcagtcgaggtggagaacctgcagcctacatgaagaccaaaagatgaggacttcttggtgtcataagtgtaggaagatccacgttatctgactaggtggcatgtacagagctgcttattgttccactggatgaatattcagtgtaaatcagatatcgatatttataatggtctgaaataattacacttagatgtttaatataacccactggtggtgttttggaaaacgttgagtggttggtagggagggtcagcatttaaatgaccttgaaaccagcagtttttcatgcgtttgcatgcatcagaaggcagattttttttttgttgttttttttaaaaaggttttgggtatttcagaactgtaaggatatggaacataggttgggcagagtgttgtttcttttctttttaaagaaaatcttgttaaaaaaatttggaaatatatggaatgcatgcttttttaaaaaagtatcctttataggttcaaaaatgctttaaaaaaatagagatggggtcttgctaccttgttgaccaggctggtcttgaacttgtggcctcaagccatcctcccacttcaacctcccaaagtgctgggattacaggtgtgagccactgcatctggcccaaaggtgcttttgaagttcaggattaaagaaatacttatttatctttagtattttaaattgacatgtagtttattcagagagttaaatgtggaataattgaatttactccataataaatttatggttgcaagtggaactacagattactgacttaaaaaaaaactattgaagttgcaggttcaaaaaacccccaaaacctagtgacttagtttttgctagatccagagaagctcttagctgtaggttatggatgagaggattcaatatggttaagatctcaattcttcccaaagtattcaataggttcagtataatctcagtcaaaatctaagtttgttgtagaaattgacagactgactttaaaatttatatggaaatgtaaagtactgagaccagtctaagaatagttttgaaaaagaacaagttgggggacttagagtatctgatttcaaggctaactgtaacatgaccgtaatcaagataatgtgatattggaataaagagagtcatacagatcagtggaatgaatagaagagagtctaggaatagatccacacatatatgacccactgatttctgataaagctgccaagaaggcaactcagtgggggaaatgatagtcttttcaactaatggtgcttgaacaactggatagccacatacagtaatatgagccttgacacttacctcacatcctacaaagacattaattcaaaatggattatagacctaaatgtaagagtttaactgtgaaacttctataagaaaacaaaattgtagtgaccttgggttcagcaaaaaatttttagatagcgtacaaaaggcaccaactataaaaaaatcagtaagttggactttatcaaaatgaaaaactattgcttcccagagaatgtttaagaaaataaaaacccaagccacaaatgggggaaaataactgcaatacgtaaatgaaagatgtgtaacatgaatatataaaagaactctaacagcacaataataatgagaaaaatacctaatttaaaatccaacaaatgacttgtaacttgtcaaatatttcaataggcactcaccttcatgccaaatagcacattaaaagatgctcaaaatcatgagtcattaaggaaatgcaaattaaaaccaaaatgagatctcagtatgttcccactagaaaggttaaaattaataagactgaccataccaagtgttggtgaggaagtggagcacctggaactctcatatgctatggtgaggaatgtaaaatggtaaatcatgttggaaaatagtttggcagtttcttaaactatcaaacatatgcctactatataacttactgtttagtatttactaaaagaaatgaaatcattcatacaaaagcttgtccacgagtgttcatagcatctttatttgtaataacccccaaagtggaaacaactcaaatgtcaacagatgaatgtttaaacaattgtggtttatccatacaatggaatattactcagcaataaaaaagatgaactattacacatgtaacaacaggaatgaatctcagaataattatgctgagtgaaagaaactagacaaaaaagtacggtttcatttatgcaaaattctagaaatgaaaaggagtctatagtgacaggaagcagatcagtgggtgcctaaaaatggagagtggaggtaagggaggtggattacaaaggaggcagaaacttttaggggagatgaatatttgtgttattctgattgtggcaatgatttcacagttatatacatatgtcaaagcttattaaatagttcactttaagtatgtgcatgttactatatgacaattatacctgaataaagctgtggggaaaaaaaccaatcagcgcttatccatattttactgaaggtgttaagtaagatgctagtaaatgacagaatttcagctgagccaagtctgactcttgaaaactacatttcctctttagtgcagaaaatatttatgagaatgggagcgtagaaaaaatgaaatcacaataaaacaaattagtttctgatttttggacatggtctcattttctaaattatcactgtcagttttttttctgctgcttctagaacatgtttattttgcataatttctctggcttccaaaatctgaagaattgcctctgtttaaactctattttcttctttcgtgtacttgctcttgatttgctgaccttctaaatggggaccagcatctaatgcttaatgcagagtgctggggacatggggaggcaggaggagctggaggctgcgtcatggaaagaccttggcgccccctcaggaaggaaggactggcttggcaggatcccaggctgttttcctggttcagccctcccgaagacattgtgttctctgcagccctggagggcctctttctctcaatttctcagtgaggtacctgttttgtaatcagtcctgtcaggtgaagcagccatgttactactggacaatcatggattatcttttcccttccttcctggatccaggtgtctgaatttataccaccaaaattcttccagattttctatctagtggttcattctcttttgtactttgtagtgccgttgtttattctcatgattgatttttttctgagccaattggaaggaatgtctaacactgactgatcaacccacagtgtttaagaggaaaaatatattttagaatcttgagggagttttatttcagtgtatgtgaattgtattggctatgtagcgtcttcattttcattgtaagaagaattttgctacagtgggaccggctgcttctcatcacaaacaggttgtggctcagatattttcccctttggagagcattttcctggtcatattattatcttgttgtctttcgttgcactcattgctctctgagatcattttgttaatgaatttgcttattatactttcctcctttagattacaaatggcttgagagcagggacccacctctcttattcactgtcctaaccctgggacaatgtctcatatgtagtaaacattaaatatttgttaaatgaaattttatgtgattgggggacaagtaaagtgtaagtactttgggagcatctttccatctttctaaaagaaagaaatgaaaatagttgaggagttactggatgaacagtattcctctgttaaatcaatcaatgacataccaatatgtgcttgaaagactgggcctgggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcggtccgcagtccggcctgggcaacagagcgagactccgtctcaaaaaaaaaaaaaaaaaaaaaaaaagaaagactgggcctgactgctatattctttgaatatggtaatggattgaaaaccttgtgtatggaaaattccctgctcttacgtcattttaaaagactatgattttaaaacttgtaatacgttataacgtttttcacttataattttcacgcccaaaatgttaaagtcagggcagaagcaagacatcagcatttaaaaggttgtgcctcagccttggagaggaatgaggttggtgggtggaacgtgaatcattttatcttatgcaactcttagtgaagttttggtatctagtaagtgttaagaatggtgattagtggtgatggtaaaagtgtggtgcatttttatgagaagagtagcatttgcgtagaataatagaggtgcctgggatttttggtagtccttttttatttaataaagcaactggggccgcgtgctatggcttgcgtctgtaatcccagcactttgggaggccaaggcaataggatcccttgggcccaggagtttgagaccagcctaagtaaaatagtgagaccccatctccacaaaaaaataaaattagccaggcatggtagcacatgcctctagtcccagctacttgggaagctgaggtgggaggatcacttgagcctgggaggttgaggctgcagtgagccatgatcatgtcactgtactctagcttaaatgacagagcaaaaccctgtctcaaaaaaaaaaaaaagctgaaaaaacagtcaactagattgtgttccccttttgtgttgacttcttagctccactttattagaatgtgataaaaatgagacctaagtggaaacaatccctgtccattgttttccactcttatcattactgtatccaaaatagtctttctcaattgccaaaccaatagtcatttctttatttaaaactcctcctctgtggttctccactgctcttagataaactcctgagtcttttttttttttttttttttgagacagaatctctctctgttgcccaggctggagtacagtggcacgatctcggctcacttcaacctccgcctcccaggttcaagcgattctcctgcctcagcctctcagtagctgggattacaggcacacaccaccacgcctggctaatttttatatttttggtagagacagggttttgccatgttggccaggctggtctcaaactcctgacttcaggtgatccgcccgccttagcctcccaaagtgctgggatgcaggcatgagtcactgcacccagccaaagtccagagtctttaaaatggtataggatgttctccatgatctgtaccctgtgttcctcttgagccttttctcttacatttccccaaattacaatgagcatctttcagttcctcaaaaggaggaacacttcgctttgctaattcttccttgtgcttcaggtctcattatgggcattaattacccagacaactgtccctgatgtgccagtctgggtttggtcctcctcctagtgttccctcagtatcctgagatctcttttgccgctgtctcctccaacctgaaagaacggacgtatgaatggattggcctctaatggaagcgtgtgacactggtcacagggagttcagggtgtagttgtttgaatgattgactaagattcatccgcttggctcttgtagtagtgactctgacagactattacatgtttctatttgaaatgccaagccctaggtgagcatccagccaccaatgagcatgtactaagtaccaggcattgtgctctatcctgtaaagtcaagtggacaggacacacatgacccattctttcgtagggcttgtaattccaagggggagggagattgggataaaaagcaaacaaaagcaactagggaattacagaagtacttacaggcaggtaagcccctggtttggggaggtggggaacatcttcctggaggaaaaacaaagagctgacttttaaggacccagcctagagagccacagcctgcttcagttaaatgactgtgaacagtctttgctcaaaagaagaaaaggaacttctgacctgataatgtttcccagagggacatcgcagatgcccttttgaaaggtaaatgttcctgacccacagaaatgtttccatctttggaaagtttgggagggaactgtttccatgcttgtgaacagatgacctgcaaaagaacttttgactccacaaaggcagaaagtaggaacactatatttgaaccatcaaataccttaagttttgtatagatcataaaataatcatagatgttgaagcaggatgatcatctaattcagaacaacaacaaaaagcctgatagctcttaggcctgcagacagcctgtaggtctattcatttggcacagatgtttttaacattgaaactgaaggcatttagtgctgtggtgctccagtttgccacagacccctccactccctgttatgaaaccaactctcttgactcattacttgcttggacctgggacattttaaattttgtgacactatagctcaagcctttgttttctgaatgtgggaaccaaagttccagccaaatcattactgttgccctaacaggggtgtccaatcttttggcttccctgggccacgttggaagaagaattgttttgggtcacacataaaatacgctaacactaacgatagctgatgagctcaaaaaaaatcctcaaaaaaatctcataatgttttaagaaagtttacgaatctgtgttgggctgcattcaaagctgtcctgagctgcatgcagcctatgggctgtgggttgaacaagcttgccctaactcatgagaagtgtaatatacatacatttaatatgtattaatatctatctaatctatatctacaaaaatacagatatacttacttagatttatttagatatgtaataatttattaatttataaaatgcattagtttagatatatatttacttagatttttacttacataaagatttgtgtcctagtatttcagagaaagctagcttactagtaaatatatggggagttaacttttactgcaaattagtattatattaactatccaatttaaaaagaaagcaaactctgccaggctggtatggtggtgtgcacctgtagtcccgtgtactggggaggctgaggcaggaggattgcttgagcctaggagttcaaggctgcagtgagagctatgatcgagctgctgctcctcagcctgggcaacagagtgagactttgtctcaaaaaaagaaacaacaacaacaacaaaaaaacccctctttttatttcgttatacaactcccagcaataggggaacactgtactttaatgggtgtcaggagaactgggttcaagctgtgaccttaggcaagcgtctgcttatctgggtcccatttccccgttatattgtgagggggctgcactaaacggtctccaaagacttttatatctctaaagcctctgcttccatgtgttaggcaatcacataatttcttcccttttggagtaattggtttggtttaaactgtcaaaatgaattatgtgttatcaaagttagtaactcctaagaattaaattggtccaaatctaaattgcttagagttggagaggatttagctcccatctaagtgacttgtatagcatcgctagtgatgttggtattattttcttggtttagaatcagccttaaggcaatacatttcaagccatgcagttgtatttcttgatttatgctaacgcactccttgttctatgggatggttgtaagttatgtccctgttacggcaagtcagagagagactgagaatcccactgttttgctagaagccattctcactagtttggcaattacagcattattgtcccaaagtatctgtagctaccagtctatgtatccacccagggtgatgacaaatactacaaatcactgtaggacagacattttaattagagggaggaatgagcccaagggtattgactatggtagtgtttaagtgctgtgttaaagaattttatgagacaggaaatttttgttgagaatcatggtcctatctggagatatttatcaagattattatgttagtgtgcttctgtagcaccagtaaattagagcagtatctgtcaaagcacataggacttttgtagtagaaagcccacttaataggaagcttaccagcagtgcttttattatgtactgccttcccaaaagttcctttgattgcgtataagttttacccttgcacgcctttgacctcacagggagataaatgcttaaaagttaccaaagatgtttagtttgtgcttgtggtaaaaaattaagaaatttgccagagcataaaaccatggtcaacatgatccctgtcataattgcattaataagtcatataggccagagtgagcatattctatacctcgtcctgtatttccaatttcagacctagcctctgttctccatgcacttagacaaaaaccgcaaagctgcatatttattcgtaagtcacatctgtcccttgtactagcatagctctgtctctccacctctcgtgtcgcaagcccttaaatatgatacactctttccttacaatggactttggtttttgcgtctgtgatgttggagggctgggccccttgagctctgtggtccttccggtgtcagagttttgtggttctggtaatggttccgttggacaatggaaattctgctcccttctgaaatatattcaggagacttctgatactcagatttgttctgggctctgaaattattttgggaagcgcacccaaaagtcatacgtgtattagcctaattccataaacagaatacatttatttatttgcaagctgtgggcctcttagatgctttaatatagattactgttgtttaattatggtacagaagagttgagagcagattccatctaaatcagtgcttttgaaactgttgtcgagccctagacccttttagagatgatgagagctatggagctgtttctggaaaaatgcacatatgtgcatattgatgatattctgggaacaatgtcatctgattagtagccctcctaaagcctttcctaaaccttaaggacacaggacctcaggttgagaaacctcagttgaaagggttcaaaaataaggcttttattaattcctaacattcagggtgtggttccagtgttttcctttgtatttgaggacattttcacttcaattaattatagaaaatagttacttagtagaaaacaggagctaggagctataaattttagagaaaaagatgttcttaaaaatgtgttctcacttatggcttctggtgaaatatactagatgatgacccattttaggacctatttggttgtgttatttaggtgttttcaaaagcctctatttttttaaagagtttgtttgaggtttgcagtagatgaaaacttaaaaaaacaaaactaggacagtttgagtgaccctggcttggtatcttttgttaatataaacttttcccttgtaaaaagaaataggattcatctttttcatacgctttttcttaaaacattcaccctctttttgagctgcagtgggcattatggtgttctgctgtgttagtctaagacaaaatgatgagattggtgaggcctgcctgatcctcttaccctttgagccccagtctcccatggtctgggtccccgtgacccagcagattttttggtcctctctggaattccagttcactcagtcagcatcttacagacaacccgatgttggtggaaactgagctgaatggagactgtccacagagcagccccctagctaaaggtaaagtgagaatccagctctctagacttcaggccaagattctttcccgactccacctcagtgtgtggtggaggcagcagggtagccatccagtcagtcattcataggtgtttattaagtatctaccttgtgcctgagcctgttctaggtgttacaggtagggcagagaacgcaagacccagcatctcggctctccagcactgccgccctagcacagggaggtggataacaagcaggcaaacgcacgatgaagaaaatgacaaatgctgggtaggtaccaagtagagaatcaaagcagggtgacttgattcagtgtgacaaggtggctgctttatctggagtggtcactgtctgcgaaggacaggtaaagcactgtgcagcagacttgctgcacagagcgggtgacaattcagctgaggcctgactgacaagaagcacacagccctgtgaagattagagaaagagcattccaagcagaggcaacaaaggccctaccgtgagaacaagcttggcaggtggaaaaacagtggagggtggcagaaagagagtcggcttggtgtcagaaagctcggggcattgtcccagatctgttgcttcctaggagtgtgaacgatgagcaagtccctccatctctgatgattagttttttcttttggaaaatggtgctaatgtttgctaccttataggcttggtgtgaagattagatgaactacattaaacatgcccagcacaagataggcactggagaaatgctagctttgggtgctttttaaattaattaattaatttatttaatttttttagatatgggctcgccatgttacccaggctggtcttgaactcctgggctcaggttatcttgcttcagcctcccaaaatgctgggattataggcaagagccgccactcctagcctggttgctttttttattttaatctttaacaaaattatttatttatttattttttgtaatcttggcaggcaaagctttggttgcttttaatttcctgaggaaatgaatatttttgacaagggccttctgaaaagaatcgtactggctgaggatagacacccacagggttgcctcttagaaaagagggtggtggtatgaaagtttcttaggggtggggtagggtatagtcttgttggcgccctcaaatgacatcatagaagcatctagttatctctacccccttcagtaacatgttttctaaagagaggatggggaaaggaaacaaagactctgaagtttattccgtatttttcagtttctgaaaagtgtatttgttttctatggactcataaatattaatggaaagtttcaataatttagatggacaggataattgcattgtagtggtataactgatagggccccaacttgtttttatttgttacaaaactatacatttatggctgagaattaataaacatactaacagtaatcataaaggaaataaaacctcagccattgtaaaaaataaaaataaaaaaaaccacaacccccccatctgccaaaactagatataattgattcttgcttaattctgaaagctcatttactttttggattataattttgtgaactaactctggataattttgcctattttgaatagttttagataatgcctattttggcatctccctgaatatttctgaccatcccttcaacatttatttggtctgtttaaagaagacacattaacatttgcctaagtcacatgaattaggatgcagaatctataattatggactaatgatacacaaatacaggctttgaggagtatttattggacaactaccataattatcagtgcatcatagtgtgatggttgggtgtcagccagattggggttcagctattcattctgcctctcattagcagggataatttaacccctgcaagcctgttctctcatccacaacacagtacctgcctcacagggttacttcagaacacagtgaggacttatgtaaaccatctacacagggcatgacatatactaccgcagaaaaatgattgttgatgtcactttcattaccaccactctaccctcagcacttcaatatgaagtgatgggcccagcccttttctgaagttaactttgaaagcagtaagatatttatttacatagaattcaagagaagggatttttgagtacaacttcctcactggttttgcttttaatgtaggattctggaatgtaaatcagtaggagatttctagttactggtggaagagaagatggcttccttatcccggaatcacagggattgggggtaaattctgtacataggtcctctctggaagttcttgtaaggaatatgggaaaatgaagctggaattattatagttacaatgttggctaaagttggttcatggaaaccttgaaattaagtttgttggtttgcttattcaatattggacagcagagggtctgagttagtgagaaccaacaaaccagaaataaatcaagttgcaatatttagctgcaaaggacagaaagaggcctttgaaaagctgaagtgagtacttttattgctgtaattaagggaaataatggtaaacaggctctttcaattggcattaaaatatattttccttggttagtttgaatatccaatacaagttggtggatgtgaattgttctgtcatgctttcaaggaggaaaactctagttttaaaagtacgtcattagggccaggtgtggtggctcatgcctgtaattccagcactatggggggctgaggtgggcagattgcttgaggtctggagttcgagaccaacctagccagcatggtgaaactctgtctctactaaaaatacaaaaattagctgggcttggtggtacgcacctgtaattccagctacttgggaggctgaggcatgagaattgcttgaacccaggaggcgaggtggaggttgcagtgagtcgagattgtggactccagcctgggttacgaagtgacagtctgtctcaaaaaaaaaaaaaaaaaaaaaaaagtacatcgtttgaatatggatttatagatgtattcaaggacaccaacaatttttttttttttttttttttgagacagggtctcactgtgtcccccaggctggaatgtagtggtgtgaacatgactcactgcagtctcaacctcctgggctcaagtgatcctcctgcctcagtcttctgagtaactgggaccataggcgtgcgccaccaagctcagctaattttttaatgtagagacagggtcttgccatgttgcttaggctgaacatttgatttggcttgcagaaaatatgaagtactttttttcctatgtggactcaattaaacaaaaaattttattttacagagataggatcttactctgttgcccagtctggagtgcagtggtacatacaatcttaactcactgtaaccttgacctcctgggctcaactgatcctcttgcctcagccacctgagtagctgggactacagtcgtgcaccaccgtggttggctaattagaaaaccttttttcttatagaggtagggtctcactatgttgcccaggctgctctctaattcctgacttcgagtgatgccacccttcatggcctcccaaagtgctgggattacaggcatgagccaccatgccccacctggggactcatttgaaggtgatcatttctacttttatttgtttactggacacttgttctgggacctagatctttcacagttgattttaagtgaaaggtttctgaactgtatatatacaatatttcagaacagtaatttcctttgcttcatagtacggcacaacagtgtttgcacttgatgtttagcgtagccttggttttggttgttcagaagcctttgttagctctttggttgtgccaagaatatattgtttttgagtctccttgccgggcctcctcgccttcttgtcatgcacatcctgtacctgggttgtggttgtattgatttgctggggcgctgctgttgcaaatgtctggagtgaatgagaatgtgtttgtgggtgtctgccctcaccttggccactgatctgctttcagccctgaagtactgccatctgcatgaacattagggacccccagcctcccccaccacttagtaaagtaccctgcacatgtttgggattcaggaaatgtttgtagaaaggaaaaattccttatcattccttaccattctctgtcttgagtctgagtcatgattcaaacacttttgctaaaaggttttcgcttgaaaaattcatattcaggtacagatttacttttttttggtgtgtgtgagtttaagagctgcctcaggagtagtttagagagaatgaatataccagtatggtttttattcccttgattacttaaataagtattaaaggtgtgtgaaaagattagctgaatcctaggttcctcaaacaaaatgttaacttttgtttgggtggtaagagatggatttcaaaatgggaaaaagcgagactgaaaccatcatccagcacacactatgtcaggaatgtattaatgacagcctgcgcttgataagaacaggacaccaacagggggcataaacaagatctaggtacaactgtgaccttgaagtgaccttgagtttaagttgccatttaaactcattttccttaaactgtccttttctggcaaaataagtgactcctgaagttgcctcattagaactccaatatgcatttttctctctgaactgtttctgatgggtgttgactccttctgttgtcatttggtcctataggaccaaacttgtatatgtagaattttattttaaaataggaaaaatcatgattctgaaaaattgtgcctgtcaagatattaaatgactgttcccattaatattattgccattaatattttgaagtcaaattacatagtgacagctctctgcctgaatgatacttacgttaaaaggaagaaactgtctgagagaattggaagagatgataatgaggcctccccaccactttcccttttaagcccctcacctatcacctactcctccatcccctagacttaagtaggttcccttacttttcttctgcttgggccattgtttagaaaggtctgagtcttgggatgagctggcctcctgttcaggcttagccctccacctgctctgcctgggtcccctctgtgttctccctgggccaggccttcccttctgtgttttcatcctctcctgtcctcctgacaccttcatttaattgtaactttttttttttttttccgagacggagtctcactctgtcgcccaggctggagcgcagtggcgcaatctcagctcactgcaagctttgcctcccgggttcacgccattctcctgcctcagcctcccgagtagctgggactacaggcgcccaccaccacgcccggctaattttttgtatttttagtagagacggggtttcaccttgttagccaggatggtctcgatctcctgacctcatgatccacctgcctcggcctcccaaagtgctgggattacaggcgtgagccaccaagcccggccttttttttttttttttttttttttataattaaagttaaggttgcagtgagctgagattgcaccactgtactgcactccagcctgggtctcactctgtcatccaggccagagtgcagtggcgcaatctcagctcactgctaccttaactcctaggctcaagccatcctcttaccccagcctcctgagcagctgggattacaggcatgcgccaccatgcccccagctaattttttaatttttcatagagacagaaaggtcctctaggttgcccaggctggtctccaagtgcggggctcaagcgatcctcttgacttggcctcccaaagtgctgggattataggagtgagccactgtgcctggcgaaaccttcattttaaaaacatacccaaatctttctgagcactcagcctttcagtcctctgttggccttgcccactatccttttgaggtggggcacagtgttttcctttcccttctcagcctcttccctgacagctgtctgcagatgcccttccctgccctgttcatttttcttcccggtgcccatccccaggagactgcgctggcgaagcccaggagtgacagtgtagtcaggtcagttcttctttgtcttgttggctgctaccttcttcagattcattgctcccctgtttctgtgtttttccaatgcttactgatgtgtttttaagtttctttttgtatctttcctcatccctcaacctagtaaatattggtgttccccaggtgggagggggcggggtggggggcgggggtgggtgggaggtggtttgtctttaccttcttttctttgtcatggcgcatggtctcgtcaacttttaagtctcaacaatattgcccatatgccaaggacttccaaagctctgtctcttgtcttcccccctgagcccaactattgcttctggaactggggcaggcttaggacaaaccactttatactccgtctcctttaatcctcacagtagactgtgagagaggaggagtgctgtggcacctgcatttctcacccgaggaaactgtggcttagacaggcccgatatcaggtccagggtcccatgtctgatatgcttgctggacagacctgcttggacatcctttaggcatctccaagtcaacatgtccacaattaaatatcccatctttccccttgacctgctcctcctcccattttcccggtcagaactggtcttgccgttgttcagtcacctggccaccattctagacttttctttctcctttacctctttccccacctcagttgattgccaagtcatgccagattggcttggtaaatactttctgactcaatttcttcttttccccacaattaccacactcgtttgtatcatacatatggattattgtgatggccttggaactggtttccatgaatctagttgtattccctcaaatccatcctccataaactgcctggatgagctgtctaaaactcagccctaacctccctcctgccagaagtcgtttaaaggcttcctgtgccctataaagttcaggctcctggggagggttcccaatcggctggccctgccttccccattccatcttccacctctccttgccttccagtttatgagctaagtactaatggacagactaggttttcttgcctctgctcatgtctaattcaccttatttacaataaatgttggaggaggaaggaagatactcctttgtaatttgtacagaaggacttgtataacattagaaaagatagggttgaataagttacatagaaaaaatatgtcactctccatgtaactacaaagacatccataaacaggcctgagcatgccacatgcacatgtcagcacagttcacagcattcactgagcacctgctgtggccagagaccacagtagatgctgggggtgaaaagctcaaggagctctccctgtagtgagggaggcagcagaaacccacagtttcatcatagggtagttgagtttaggaataggaatgggtacgggatagtaggggattgtgagcctgagtattcagggaggacttcttggaggaggtgatgcacaagttctgtcttcagggaaagtcagtagtaaccaggtcgaaggtagtgtaaattccttttctcctttttcctctttgggatttgtatttttcccatggaattttacctgtacaggtcattttacactggactaacaatgcttaagtgctttttaaaagcaaactgtgccagatttatcccattggtaggaactttcttcatgagttcagaggctttgtcttggttcccgttgtattgccagtgcatggcccctggtaggtgctgagtaaatgttggttgaattggatgccttgaggtgaggcatgagaaagggttctcctcctccccctgaaggtggtgaagatagttgtgacagttgagacttgcatggggctgaccttgtgaggtcctaagcctggtgaccagcctctgcagtgtaactgggctgtctcatgggaagggcagagcctttcctacgtggccaactctgtgttctgaacaggagtgccaaactcatttggaggggaagggagcgcccttttaaagcctcaactactaattaaattcaagcagaagatggtgaaggtggagctaactcatttattagcatataatatgatcaacctaactcatataaatgtagattatcttggtttgtcttttcctggctgcagaaaaggcttggagaggtgccttggattgtgagttagtcagtgagcagctgcttaaagatttgaaaaatcctagaatatgtcatctctgtaggctttatcctttaattaattatggatttttatctgcatatatgtgaagctaatgattgacttggttcggacactgaattgtcggcttaaacctgccattccactgggcttcatcactatgttctatgggtgtgaagcctttgttttttcagagacccatttccaccagcgggtttgcactgtaagtgtttccacaggaactctgccctttgccagtgtcactgttgtggctatgcagcagaacccacagggcggaggtgtttcagccctcactgaaaatgcaacagatcttaacatctcttgctgcaaattttccagtgtgttctggtctaccttggtatcttaaaaccaggctcactgactaccacatgagaaatgacagtggggtgtcttaaatgatctgttgaagaccagcagccaaaaagattgcccttagtgtttctctctaccggctaacattagacaatgccatgtagaagctgctgttagggtttgagaactgtgtcgcctcattctcaagatagccaaggaagtgtcatctctggagaaggcagttctgtctctttcagtttctccatggatccgatattgttctgaaagaggtggttttaccaattcgtctcacacagacttcttgcctttacttttatctgactgctgacagggtgggctggaatataatcgctacttaactggacttgactttcaaggcctgattggcgtttccagtatagcagttgcctgagtcatctagttttggaactgataaatcaaaggactggcttggaggctagtgtcctgtctggagaatgggcttaatgtaacttcagttaagaaattaatgaatctgaaatagttataacccaaggaagagattttcctaaagaatgtccctttagagaaataatgaccagttccctcaaaaaaaaaaaaaaaaaaaaaaaaggaaaaacagacactagactggatagaaaagacttacatgttgaggctgatgatttctcttatggaactataaaaggactggactctaaggaaatgagggtcttcaacttcattggtgatatttccagttgttctggagctgtgatagaaccaggactagagaatgcagggcacgatgatagatttttttttatgtagcacttttaaacataaaaaatatatatctaatgtgccaatgcaagacctggcctttttgtaatcaagtaatattttgagtaataattgattgcacaacatcctgtgacacactgtgaaagagtaaaattggcttaaaaattttaagtacaaagacatttcagaagagttttgtccataactttgttagactgaaatgaggaattacatttggcaccaggaaatggatctggattatttagaacaaatgttttccaggtttgaatcttctatgtggaagtacagcctgacttctttgccttttccctggtccgggatcctgacagtcagttcttcagctctgtgcctccagaatttcatgtttatgctgcacaaggcctgtattttataatggtggctcttttggacgatgacttcctcgatggtgaaacttccagtaatctccctcatcatactgaaatgatatcagtatatcatcagaacaccatggagcttgtcatttgagggacacagcttgcttgtgtgcttgggaaagaagaggtttagcatggtttcaggtcagtgatgagtccaatgatctctgcaagttcccttagctctgagaattctgatgtcatatgcacttctgccgccagagttgctgcttactggatgcgtaagaagaaaggaaaataaatgtaaaatgcctggcaccactgaggaagtagggtgaggagttaagttagacagtgactggcatttcccagccacactagtacagaagtgtcctgtggtacgaacggaggcaggctggggggttccattgtgtgccaggtgtttccatgaaaataaactgttgagtgccaggtatggcagctgcaaacagggatttggggggcaaaatttaatctttttttgtgatttgttgaatgaagtgcctaatgtgtctcagtaacttacttgagaggaaaagagccacaagcaaggtagtggagagtgctggatggttgccttgtgaccagacctgttcttttaaggcctctggagccagctgtgggacgatcaatccagcagctgcaggtacgcctcgggtgacacttgggtctgtagtcagcggggttgcctgtgactgagagtggcagagtggtcccttgcactgatgaatcctgaccctgctgatctttgcttgggtgatggctgtttgtgtgctatttctagaagttcctcccgcctgcctatgtgacctgttttcaccagatccagattgctagccccttaaagcttgaagaaccttaaaggtcatctggaacaaaagatttatttatttttagcccggtggccaccctgaaccccccagttgattgattgaggctagtcttgagcgtgccctgcttcacatgctagttttccagtttctactttgggagaatgaccttatcattaggctggccaagagggcttctttctgttcctgtcacagtactaggctgtatactcattcaccctcagttcccttttctggtatatttcttaacaaattatttccctctttccactatttttaggggtaacaagtctaagatatttacatataaatggctctcccttctcaaacccttttctagcaagcactttctgggaggacagtgtcttaccaggatcttctgtcactgtggtccctttgagggtagaaagaatagattgttgtgaagtcttttgtcagcctcttcatggttataaacgtacttagttttccagactatgtaggttttagacttcaagtgaaaagagtatacgttgttatgcagcaatagaaaacaaaacaactaccacaaaattgtattttttctccatccagaggctttaactttcaacatttgtatatggaggcaaggctgacagccacagcagtaatttcatgatggctgaaatagctgtgaactgtgcattaacttgttccttctctcttaaattctgctgcagtgttggagcagggaaggcgagcagaggagtgatgaatagagtagcaagtgggataatatacaataataggagatacacaataaggattaattaggtgtcaggctaagtatttcatgtgcattaactaatttaatcctcagaataccttcaagatattcagattctcttattatcctcctctttgggaggcaactgaggctcagagaggttaagatacttgccccaaataagtggtgaaggctgggcacggtggcccagcactttgggaggccaaggcaggaggattgcttgagcccaggagtttgagaccagcctggacaacatagcaagaccctgtctctctttttttttttttaaagttgtggagctagagtttgagcacctgcatggaaccactaagctgcattacacctgcctcaggtggttgatatgaagaaaagtaaaaatttttcagatggactctgggtatttgccttttaaggctatatgccttttaattctgatgtaaagtggtagagaaatgattaaaggtttaagagttgatagggccctgggtagcagggacactttacatgtgttgtgtgtgcatctgcagcagatgacagctccccaaatggacatgcctcccttgttcaagaaagcttgtcagggtggcaccaatttttttttagcaatttaatgaatgaggtatcaaatgatcacataatacaaatttgattgatctccttttggatatatctccccttaaacattgtgctggctacactatccatttctataatacctttgattttatcctctttactcctaacagtgaattcctaggtaaagtcacaactgaatttatcagcacaagcatgctgcatcatgttgtacgttctgcaaacagtaacttgagatagtgtgtcatttcccagttcttaaggctgtggcctacaccaatggtcttattttcccttttgattttttcaaaattaactgttattttgccaataagtttaacatttcattggagcaattattacgtgtctggggttatgcaacacatgggatgtgcagaaataaaaagatagtttccctgccctcaaggagcttgtcttataggggaaacagatacataaacacttctagggcacacagattttcatgtatgtgtgtactatggtgttaatgcagaattctgtaaaggaataaagcttccatgatcaaagcaagcatgggcaaatgcttcacatctttctgcctgtgttttgcgagcccattctgtttaatgtggacttgatttaaagtcgacctgcagtcctggacttcaaccaaacagccattatagtaatgaacatttaaaggagttatttttccaaagcattatagtttttcacatccatcttttcattccctcattagctaatgatgttgatgtcctcacaagcattgtttaggaatggcttaggaattttaccgtatgtttactttggcttgtctgctgccccttgctttgtaatctgttcaccggtgattcagttgtttctttgagtccctttgaaattgcaagttgacgggtggggactggtggggaaagaaatccagaatagatattcctaaaactgtgaagtgaaaattcaggagagactgtcataactctgcttatttaaggtggtttggtttgtgccaagctaaaggagggaatattgattgaattacttttttaaaatgcaattaatttttatttaattgttttccctggagttgtggggttgaggtattgcagtttaaagcagtttggatgtgctgataatttttttctgattatcttcaagtctccatggacagtgtcactgcaggtctattcatgctttcgttcctcctttacctgccttcatctgctttctctgggcattggtacccatacccaggtgtggtcagttggagtaactcctgccttgctgggcttaactgtggtgtttctgggcctaaggcaattggaacatctgtagtttatttcctaatcccaattttgtggaggtttgtgttctagctttgattcaattactcctaagtagtggcccgtattaagtagaggctgtgtgagacaagacacttaatgtaggccccttggagctgctgggtccttttcatcagaatttggctaatgatgcctctctcttttttacacactaaagcctaatataactagtaatgaacctcattaataatttgtattggcagatgtgaggtgtcacacattaaaactgttttacaccatgagcattgacttcattcggtcagtgagggaggatgcaaccacctttgccaaaataggaaggaagagaagacccagagttttcagggaacggaattaaatagcactttaacaagcttggcggaggcagtggggtgaggagaggaagttaataggcccagggaggagagtatctcactggtttctccaagctgattcttctgggtgccaagagagctgtggaaacccacagaggaatgccccggttcctttccttccttctttctggtaagggtttagatctatttatttgatggtcagccttccagttttatcagcaccggtctctttgtacaacttcccaaatgtacaaactccagacagatgagtacagttggtgttttccggggagggtgttgctccctgtggtctgtcacagccagagagcagggggccagagagaggactgattgcccatatgttccacatgagtcgtcagtggtgcacccagttttaaaatgctctgggggtgtgtggccatgaagtggattttgaatgaatagaaggaaaaagctcgtggatgaaaaccatgagccatttgaaccgtgtgtggtgtctggaaaaacaggtggtctggcaaaactgacaaagtttgcttggggaaacagaagctttgcctccacctctgatgcttgggctgggatgaaataagccacttttctgtttagactgtgtttagatggagggaagcttcttcagttctttattgggtgcagtgaatggcagaacttttattacttgcattcttaattttagttagccatgctgagctgggtttacacccaccttggtatgtaatttctgtgacctgttccgcttccttctctcctgtcacagtcaccaaaagccactatgggtagccatttgttaatatcacctttattaggagtcctccaggctcagttaaggtctccctccatctttccacccccactattttatgccttcgtagccactggcactctgccttgcggcacttgcacatatttataatcagtgagtcaccctcctagactgtaagcaccatgagggcaagatctgcagcccaccagcagcctctgcttccagcacagcacttggcacacaggaagcactctcttagtatttgttgtacttgtcagtgtttgttgcctgaatgacacagaagtgttccctgctggagaagggattcgagttaaatggaatcatccagagaatttgataaaatgatgatggctatccgtttatgctcttaaaagtatgcacttgagacctctaagtagatgtttatttgtttatccctttccagggttcatgtgtttatcttgtttccttttgtatgcattttctgctttgcccctcacatagtaattcttggaagcaagtagatcattgtttccatttcagttgagatcactttaggggcatgtcttggacttgatgacagatcttccactatcttatgctccctacctcacatttattgagtacctactatgtaccaatccttaacatttgttattccagtttatcttccatcagtcctgttgaggtagatattgtgccccattttacagatgaggaaatcaaggttctgagagattagataatttctaggaacatacaaccaataaaagggaaaggaagagtctgagttcaaacccagttctttggtgctaggggtacagctgctgtctgcagggcatgccagatgacacctttttgactcttttggtaggaaatggggaggaatgcttgtcaccttagaaatgctgttcgaggttgctcacacctgtaatcccagaactttgggaggccgaggtgggtggattacaaggtcaggagttcgagaccagcctggccaacatggtgaaaccctgtctctactaaaaatacaaaaattagccgggcatggaagtgtacacctgtaatcccagctactcaggaggctgaggcaggataattgcttgaacctgggaggcggaggctgcagtaagctgagatcatgccactgccctccagcctgggcaacagaacgagactccatctcagaaaataaaaaaaaaagaaatgctggtatgtccaagtctgtgttcactcttatgttcatggttgttttacaaaagctgtatttagcaagcactcaatgacaagttatgccagcactgtgcttggcataacttggatatataggtgaatgaggcagccatacagagaaatatgacaagagtatgttttaaatgccccaaagaaggtttatggaaggtgctacaggaatgtggagctgggaaaataaccatcatttatatagtgctttatatgctgtctcttgcttttatatttgcccccattgtattgtctttctctctcacctttcctccacgtctcctcccctctccggaatttcaggatttggatgcatgtgtacatttaagatttgttctaaatacttgaaagcacgcttgcttgttagttacctgtccaaagcctgttgactgctgggccccagaggaacactagcatgtgcccttgccccgcctgtttctttgtatacaaacagtatacaaaacatagagaagagaactgacagatatttagatctatgggcttttatagaaaataagaattacttttcttctgtaaggtcagtgtttacaccttgtctgcttgctccatactcctctagagactaaaacacctcattgcttctcagaatcatttctgaaactgaggctagaaattacaacagagactctcttctcacctcttcaccagcatcccttgcctcttaaagtcactgaaagaatatcccccctcccccatggaggggtcataacacttttttgtctgtctattccaggaagctcgagtgctttacaacgctttacccagcatccctgggggcaggatcggtgcatgtagatgtttactgtgccaaccccttaaaaggccttctcttagcttagaccctcatctaacccagactaataataaaaagtccccaataactttgctgttatagatcttacagtgctcagagattggccctttaatatccatggttggcaaacatttctgtagagggattgtaggttattttgactctccttgtaagtgccagtttgtcttaagtggcctcaatcaaggaaacaagtagttcggctgcttcctctttatggcatccttttgatgaagcaccacttactttactttgcatattagggtcccaggatacatgggtacatgtatttttaatctatcaatcatttcatataacgttaagtagaactgatttaggaaattgcagaagtttcataaaaagatactctactaaaaagctttaagagagctattgattcccaaaaatagttgattgggccatagcatcaggtgtgctgatgcagaaccacatcgttgtgatttatttctgctgtctttgtgaggggatggaggacacaggcttctggaagaacatgtttataagtcttccttctcccagatggcgcttccagctaaggtcctgcagagttgcattctgccacccttcctggagcctgagagatgggcgaggagtgcaggtggtggtgttaggtggtggcatgtcaaggaggcaggcaggaaaaggcagactgatttttggtagcattagtctttcttctgtccttctctgcttttctttattctgaattttaagatttggatgcatgtgtacatttaagatttgttctaaatacacgaaagcacgcctgcttgttagaaggacatatttgagggaactaagtggtgttcggaggcacagtgacgattcgagagattctggaggacgcatgttgggtgttggtggttttccagttggtatcatagtgtcatattctcttcaattgtaggtttagctctttgggacccaaaaagacaagattagtcaggatagtgacatgcacttggcatgctgtggcttctgttgaggaaaaagtgacccaaatttgaacatccaacttcaattcttagtaattggcaatggctccttgcatctctttctgcttgactataaaactataaaatgctgctattaactttgaaggctgccacttacaaggctaggtgaacagacttttatattaacaactcagattaaccctgggaagcatctgtgctccctaacggagaagttgctttcacgtttttcacggtcaacctgggtggccctcaccatcaggagtgtggaatctcaagagtaacagcacaaaggggtggcaacttgaacccctgggttctagtcccaggtcagctgctaactgctgtatgaactcaaggaagtcatccaatgggatcatcttttgacaaaagaatcaggccattaatcaccaaggtcttttccacctctgaattctgtgatctctactcttgtaggtttcctccctaataatttctgtaggtctgctttttgaactatttcccttatttatcctttccttaaaatcaggtttgttctcattcttctggtcccacccacatccacatggctgttaaagaacacagtgaattgatgcagaaagatgtcccagatataggccgggcgtggtggctcatgcctgtgatcccagcactttgggaggccgaggcagatggatcatttgagggcaggggttcaagaccagcctgaccaatatggtgaaaccctgtctctactaaaaatacaaaaaattagctgggcgtggtggtgtgcacttgtagtcccagctactcgggaagctgagacaggagaattgcttgaacctgggaggtggaggttgtagtgagctgagattgacagagcgagactccatctcaaaagaaagaaagaaagaaagagagagagagagagagagagaaaggaaaggaaagaaagaaagaaagaaagaaagaaagaaagaaagaaagaaagaaagaaagatgtcctagatatattgttgagtgaaaaaatatactaacagagaggcatgcctggtatgacctatttctgaaatgagaatgataatagtatcagtataggcctgcatcgttaatttgaagcagtttaagtcagatgtgtttctgaattcaggattttttcagttttacataggacaatgtattaaatacatttactattaaataacacctccagtgggggctggggtggcatctgtaatcaaaaacattaatacttctgtggcaaaacatggatattcacactaagtggggtaaataaagattacacattgccttatgtcagttcaggtaagattttgacaacaaatgttacaaaatttgtttgggttttgaaactttttgaatattgggattgtagataagagatcgtggtggacctgtatagccaaagtggggaaaaatctggaaaatgaagcatcgagcacttagcaatacttttcttgagtggagaagtagggtggaattatgggggactttcatttcccaagttatattctttactagtaagcatgtataattttataatcagaaaaaatgattaaagatacttatgagatataaagatttacataaagtagctggaaacatttaaccaatctgtagctgtttgagacttatttatattaggacaactaagacttgttttctcaatttttcaaacttttgtaatgtgattatatttcatacacacttaaaattttttgtaggtgatagtattgggaaaaacgaaaaggaatatgtgatcgtaattaaaatgtcagtggataaaaataaggcccttggagtaccctgtgggaaatcaggagccacttcctcctggatgctttatgtagcacattatactgacctattaaataatgagaatcaggctgggcatggtggctcatacctgtaaccccagcactttgggaggctgaggtgggaggatcacatgaggccaggagtttgggaccagcatggacaacatagcaagaccccatcgctacaaaaaaaataaaaatataaattagccaggcatggtggcacatgactgtggtcctagctacatgggacactgagacaggaggactgcttgagcccaggagtttatggttacagtgggctatgattgcaccgctacactccagcaggagcaacagagtgagaccctacctctgaaaaaataataataagaagaatcacatggatgaagcaaatgatgataaccaaaatataatgtatgggagatcactttataaagatgtaaggctatacaataatttaacgtgtttttgaagtaacattgcaattcctaaggggaccaaaatgaatggttggtcttaatgggctttgtctgaaaattgactggaacaattgcttccaaacagaagatacttggaatttcatatatggaatatagatgagatggttggcatttgaccatttaattttatcagtcaatataaaatgatctatattattcttaattttcacacttttccatatttctaatcctaatatactcatttgttgccttttcccacttaattgtataattgcagttcccatgttgcttataatagctgcataatatttcagtcactggtttacataatttaccatcttcttattgctgtttctatttgtgtgtgtgtgtgtgtgtgtgtgtgtgtgtgtgttacaaataacacttccgtacctatagctgtttctttttcttttcctttttttccccctatatttaggggttgttttcttagggaatatttttttctgaatgcgtgaggaacttaaagtttattctataagcatttattcagcatctactgtgtacagggccctggagatacagagatgaattttagaacctgtgcacaagctgtctccatttcctggactctcttcctccctctcccttcacctgacgaattctccatttaaatcccactttgccaatgaggcctttatgtattccccagagtattttaggcttttctgtactttttcttctcatttagtcacagttatattgtgtacatctcagaataactaagattacttcatttttgccttcctcattagactattaaacagtaaactctgagaacaggttttatgtctgatttattttccttggtaccctcagtacctgggacattatgtctggcatataccaggcacagaaattcaaatgagtacttgcataaatgaattagatgaacaaatatttgaatatgattcttgccttgagaaatttagattagaactgaaaaatggattcaatggataatttcgatgatgtgtaagtgctttatagaaaatagaaaataaaccttttcctagctattatcttttcctcctttacagtgaatcccttggaagaggattcaattccagcaagtcatttaatgtcttacttttgcccatactctgcagcagaaatgggcttgtcttattttctgctaaaactgttgcttttctatgcaaatcctactttatttctcattgcactgaacaccattatcattcacctttttcacttctttttgacatgttggttatctttgttttttttttcttattattaaaaatcctgtttcttcagcatcccctttttcctggtcttatctgatagctgtacctattctgctgtttatgaccttttaaaaactgttagctccttgagggaagggatagtgtgatcttttggtaggagactttaaaagatccactttcttatattttagtgtatcccttgggtcaaatggaggatttttttttaaaggatgatcatcaaataaatattttaagtaatttgaccaaaatttatcttcttacctttttactaaaaatatacactaaataattttaagggaagattttatagtctcatattcaacatggaaatttcttgattagtattgccctgactttattggttgcttcacgggtggcttctgaattcatttcttggaatgttactattcagggccaactttgttagtattgctacgttgtgatttaattttttgccacttacacattctagccagtctggaagatctccaccaaaacacctgtatagttcagtctgaatttagaagtgtcacttgcaagagaggcagcaacgtcaggcccgtgagactcaagagaagtctctttccatgatagatcttcttatacttggtagaaactggcaagtgactcaccaggggtggaagcctggaaaacagcctgccgaggagggtagtctttctggtaacacatcgccacccctttgaagcatccagagaaccggaagagcaggaactgcctgtcagactgactgagcgcttggcattctttcatggaaagatgacaactcatccagggtgaaagaggaagtggaggggggtggcagggaacaggagggtgaccttacatttccattgttttgcaggctgcctggtcgagtgcagtgggttgtttgggggttgggaggaattggaatcatgtacttctattgttgctgtccaaagtggatgtcctgtgctgtgttgccaaggaggggagcttgtacccattttatccttgtgctccttcgtaatccagatggtttgtgatctgatatttctttcgtgcttagccctggactctatcggttagaatcctagtatcattttaagaactgggattctcctatgccaaatttctgtgaaatctgagagccaacagaccgacatatttttccgggctatctctggctttgacaatggcatattttgagtgtcagttgatttttgtctcagtttattggcttaagtagtaagagtcaagggattgaactgcagcagtagtgttattttgataatttattaagtgttgtcttgggagatcttggggggaaaaagagtttagtttagttctttcttataggaaattttgttttgttttgtttttgagatggagtctccttctgtcacccaggctggagtgtggtggcatgatctcagctcactgaaacctctgcctcccaggttcaaacgattctcctgcctcagcctcccaagtaggtgggatgacaggcacctaccaccacgcctggctaatttttgtatttttagttgagacagggtttcgccatgttggccaggcttgtctcgaactcctgacttcaggtgatctgcccgcctcagcctcccaaagtgctgggattataggcatgagccaccacacctggccttatttagttctttcttactatggctagaaccctcccaagagtaaaataaagacttcagtggacaaccagtggtgagttcactttctagagaatggcaagtcatcggaacactggtcagtactcccaattctatggcatatctgcacatctgccatctttggtcagcaaccctccaggactgccttcttcacacctgtgcgtgaacttccaagctatactgggcaggttggtgctgcccgtttctcccatgctatttaacgattactccatgcagttactgttcttcttaaggcctctccacccgcctcactcttttaacatatgactttgtatctgactttactaagcaacttgaaacttcttagaatgagctcctccatttcctgtcctgatgcctgcaaacttatgtgtagtcacagttatcttcatctggttttctccaggggtatcccatctgctcctgcatcctcctaggccttgctctgttagtcattgtccctccctctctttctaattttcagccacatttatttactgtctgtttctccctccaatgtgttactgtctctttctccttggctgtcaaatgttctctgcgttttccatttttgtgcttctcgtacctactaatgacttacctatttgtcaactccagtggacacgctatagtccttatctttctggagcttcttcttgtatttaacccaacacatccactctcttctctagaagagtttttagcttctgcaaccgtccatgcttctgttctcttgctgcctctatgtcttgtatctccttggtgggcttctcttcctttgcccacctgttactgttggagtttagttctgggagtgttgcttttctctcctcatatatactctggccttgggacttcatctgctctctaggttttcactctctgtgtgccagtgattcccatgtctctgccttgcactgcctggtgaccagattctgctggttgtcatgtgagtatctgaaagcctccttaaattttccaggagctgaatgcatgaccatttctcctaaacctccccttcttttctgaatttagagaccatattatatatggtggttaagattggggctctggaatcagatttggatttgaattggggctctgatacttcctggatgtttgagcttgaacaagtcacttaattccctgaccctcagtgtctttctttttaaaatggggataaaaatactatccatctcagaaattcttatgaggtagattgtaatgcatttgtacagtgcctggctcagaataagactggaataaatgttagctgctgctgttctctttcagtttccctcatccacggagacatccaagccagaaacctgggagtcatctctaatgccattttcctttagctccttaatgcctgttttctttagcttccatacatagccagttacccagtgtggctgatttctaatcactgtttacttcttccttctggacatttctgagttttcctttctcttgattcccattaccactacctgtgtgaggcctttatccttactttccaagatgaagccacagcctcctgcctcctttatgttcctgtgatcctccctccagtgtgttaccaggctgcctctctgtgtctaacagggtttccaccctggttgaagccctcttgtgatgctccattatatgcaaatcaaaggccaatctccttagcatggtattcctgggtgtcctcctggcccttggtggcattctagcctcccttttaccacttcctgattccggcttcatccttgagcaacacagtcttgctgtgttccctgtgcaggccctgctctttaggctctttcccacctttgttagcgacactgcttggaatgctcccttccctgcttttgacttagtaactcctcatcctgaggactcagctcagctatcacctcctccaggaagccttctctgacccttccaggataagttaggtaatcttccatagagtcctgtcattctctgtgcccatgatgcacttaccacgttggatcataatctatttatgtgtctttcctcccagcctcagtcctgaagggcagaaaccatgtgtcattccacctcatatttttgtgcctagctggatgcttgacatgtagtaagtgctcatgaaatgtttgttcattgaataactgaattcaagaaccagtagacctctggatgaccctggtttcctgtttctgtggaccacaatgctctggggcagtgctgcgtatcagaggttcaagccatggctggagcagccacccctgaagtagacaccctaatatccttcccactgagttcctagttctacatgctggagtgaggctgtcaactctgaagtgtcagagtgtgtctgaaaatgattgctgtgaaaaataaaatatttcacattgcaggcctcatttttaagttatttttcccagagaacattttcatattttagaacttatggtaatgttaacactttctatttgcataagcacttccctgttgggagatactgcaggtgtaagtttttctgaggagtgtcataccaccatggaactattttccatcgatctggagatagggaacttcttgtatactctgagagagaacttctttgagatgtaaactagactgacctactttagaggctgcctgtatcctaattttctattttaaaagagtgatggctgaacactgaaaagctcgggacattttagaactgtgctgcccaatatggtggccactagccatatgtggctatttaagtttaaattgaattaaaataaaatgaagtggaaaaaattaagttcatcaattatattagccacatgtaactgatgactagtggctacctaccatatatagaacatttctattattgcacattattctactggacaatgctgttttaggatgtagaagtcctgatggataatatcaaagccaccttaccacagacagagttttacagagctgtgaagtaattcttactgggaacaccagatacttacttaccattttatatagcgtatgtggcattctctcatcttatcattagagcatgcctgtatctttagcgacaatagcattcaaacaccaaatgttatattgtctgtctggaaatgttttcttatacaactcaaaggggaagagaggaatatgtcgtgagtaaatggaattatttttctctgcaccacatcattataaaaactcgaagaggttgggtgcagtggctcacgcccatgatcccagcactttgggaggccaaggcaggtggatcacttgaggtcaggagatcaagaccagcctggccaacatggtgaaatgctgtctctactaaaaatataaaaattagacgggcatggtggtgggcgcctgtaatcccagctactcgggaggctgagccatgagaatcatttgaacatgggaggcggaggttgcagggagccgaagtcgcgccactgcactccagcctgggtgtcagagtgagactccatctcaaaaaaaaagaaaaaagaaaaaagaaaaactcgaagaggctaaaacgtatcctggaactaaatatttacatttcttaaagccatgtgtgttttctttggatgaaaggataacaaatgatttgtatcgttggataatataaaaacacttcaaaaagttaaaattgaaagaaaggcaggatcttctacttttctttattttcctccccagttacccaacccacttggcttccaggagcctgagaagttgaagaagtaaacagaggtttagttcagctgttaaccatgctaggaagttctagctatctggtaataccatggaactcaccagaatctttcatcatggaccagctgctttttacacttggataccagtaccctagatggtgggagagactggaaggatcgttcaggtcaggggtgatggacttctgcagtccctctcacatacactgttcaagttacctacagtagctacgcacggaaagtagggtgtgagtcattccatgattgacaaccccagtggaccacaggtgactcccacctgggtggcttcgggaactcagttcagaggctgcagcaggtgggatattttttggattatggagagctgtttgatttcacatcagtgggttcttccctcaaccttgttcagatcagtgcctgagtaagttctaatatattaaccttttctgagagaagagatgtgaggatgagggtggagggtgtgaatcttgttttttcaccatcctgttactcttctgcatgcggtgtccccttactgaggaacagaatagaggagctgtaagttggggtatagtgtggcaaggtttgtgagagacttaagaacaaagggtgtttatcataggtaattatcacagtgttgttagagtgtaggcagagcagctttctaaccaacattacaagtttattttgctagtgaaaccttttatttaccaatgaagcattagaatttcagagagttaattgtttgtgaactttgttcatggtctttctgaaactttcaactctctgtttagttacaataaggctcattttatagcctttattgtcctcttttgagaagaggcagtataggtagataggaacatgggcttgggatcagatagactgggaatagaaatccatgcctgacgcttggacaaattgtttaaacttctgaatgttaatttcttaaccagtaaaatgggaataataatgcttaccttacaggcaaggggacaatttctttgtgtggaataaaaaaaggaaggtaagctgactcattttcagaaagatctttaaaaattaataaacatgccatattccttaatcttatttatgattacatttggtttatttaagttttaccatgcatatctacttagtgttatcaaactataaggaggaagggctcttggtaaaatcagtgagataatctcagagtctgtgctcttaggaaattaataaaaaaattaaatctgataaaaaagatctgttttaatagcaaattcctttttaagactaattgctgtattatctaaaaggaaacaagctgagtgcagtggcccatgcctgtaatccaaacacttcgggaggctgaagcgggaggattgcttgagctcaggagtctgagaccaccctggtcatcatagcgatatttcatctctatgtttttatgttaaaaaaatagctaagtgtggtgctatgtacctgtagtcccagctacttgggaggcagaagagggaggatagctttgagcccaggaattcgaggttacagtgagccaagattacatcactgcattccagactgggcgacagagtggcatcttgtcttaaaaaaaaaaaaaaaaaaaggaaacaaggggccaagggaaatggggagactaggaaattcaaaggattatttattggcaaacagcaaaacccttgattatttgaatgttttgctattttgagtaatgttatttactgattacagtgcagtctgagtaataacaaatccatcatccagagagtttttgaggctagaccactcagttttgactgttcacatacattattacatatttgtaaaagttgagtttcatgtgactgacacagaagaggtggagtaatcaaatgttcctctctaggatactatgcagtgatcataaggaaaggaaatgaaggttcccttttccctaatgcctatattgctcaggccagcactcctgaagatgcttgttctgttgaagctccataatgtgtcgatgaccctctttgcatctgaggctgggttaatccccagaggtacaaagacaagtcagggatggcatctgtcttggagatgaggttatcctgaaggggatgtggacattggcacaggggataccagtatcaaatgattggtgttgaacagggagctgggagatcatagaaaacagcctcttccctcatgtgagaagaagggaggttagggcaagacttcctggagaagtcgcctagacggagtcttgaacaatgggtaggacttagatgatgaacgggtgagagagaaggaggaaggcattgtaggctaagggaacagcatgagtgtcagtgcattaaacagtctgtgtatgcttgcaagggcaagcctttccatgtcaatagcatataaagcataagggtgggaatcaaggactataaaggggtagttgggggcccagccatgaaaagccaagtatactctatgaaggcttagagcatatgcttctagctgatggggaactgttgaaaaattttaagcaggggtgtaaatggccagattttcctggtttgctatggcagctcattgagtcatagatttgtggctggatagcaggaaccgatcatgataggctcaatgtgagatgatgaatatgtgtaagaaagcagtgaaagtcagggctggagaggagaagatgggtttgagaagtacacaagatttggagttgatacaattttgatcaactggctacggggagtggatgagatggaagagaccagaatgacacttgaagttctggtggccattttgaacctggggaatataggaggaagaatgggtatgtaggggccaaggtaatatactgattttaaaaagtgtccatctggcaattgaatgtgagtctgacgctctgggaagatggcgtctggagatgggaatctgggagccatcacctagaggtggtagttagagccatgtgagtaggttggtgcccaaagagaactctgaggatgaagaaggcaacgggcaggggatggagtccaagggaacaccagacagaagtggagggatggagggaagaggaaatttctagaaaagactcagaagaatgggtctggaggtagaatctgtggtgtcacagaagctggggcaggggacagttttatttttaataaaaattttttacatatatatgtaaaaatatgtaaatatataaaattttatatatatacgtgtgcatgtgtgtgtatatgtgtgtgtgtatatatatatttgtgtgtatatatatatttgtatatatataatatatatatatatatttgtgtgtatatatataaataaattgcccaggctggttttgaactcctggcctcaggcgatcctcctgccttggcctcccaaagtgctgggattataggtgtgaactaccatgcctggcctggagacacttttaggagatttatagctgagatagctaacccaagtcacccttagtatttgatgaagtagcaggcaagatagaatgggattgggaacttgaagagaatggagactgtttggaatatcccagtcactgaaggaaatgggagatgagatgattgaggaaaagtaaaagaagtgtgaagagatgctgaggctcagctgagattagaaactgaatttacagtggcccaagtgtgtgtggctccccagcctgtgtgtcagaggcagcagatactgagactggtccagggtggatttttaccagtcagatgtggcagaaagaaggtgtgaggacgtgtgtatgtgtttgcagggggtgcttttaagaataggaatggccaggtgtggtggttcacacctgtaatcctagcactttgggaggctgtggctggtgaattgctggagcctcaggagttcgagagaccagcctgggcaacatggtgaaaccccatctctaccaaaaagtacaaaaacttagccaggtatggtggtgtgtgcctgtagtcccaggtactagggaggctgaagtgggaggatcacctgagcccagggaggtccaggctgcagtgagccatgattgcaccattgcgctccagctcgggcaacagggtgagaccctgtctcaaaaaacaattaaaaataaaaataaggaacaggaaggagtgtggctaggagggacctaagaggatagaaggaagcagttcgtagacctggatggcttgtatggttaaaaagcagatgtaatagaagggcaggaggcggtagggtgatgtagtctccaaggtagagcagtttgagggagtggccatgggaatggctgagagaagtggcctggaagtgaaggccagtgaggtagaggatagcccacagggaaacctttgtagaaatgggacttttattccacttgtaagattcacactgaattatagcattggatgtgtagaataagaaacttcattttggtgtttgagaacacagtagataggtgtgtgtcctaaatgttttgagccatatgcaggggcaggtataggatagtgtatctgaagatgctgttgggattctattgtcatttatttatgatgtggtaaaaagtctgactttgtgtctctttaaaggaaagttttgacaatgaatataacttataataatacttttatgtatttacacttttcaaagtcatttcataatgtttgctattcagtttagtttagtggctctgggtaatctatttaaagtccattttcagtttgttagtttctgtagactacaagtgtagagggaaaatgtatttcacgtatttcactgggtaagagaatggattattagcaagaacttaaatctaaaatttaagcagtttctagtgctgagggacacgatagatttatgctgaattgtatatttctgtatttgatttttttttaaactgcaggcatctgtgtcttccaaggtgagaaaaaacgttaaaacatatcatgtattttctggcctcctactatgtaccaggtggtatgaggacataaagaggcagaagatacgattcttgcccctagatagcttcacatttagctgaagaaacaagacataaacacaggaaaagttagctaatcatgcagggtttaaatagcaaggcatgacatgactaatggggagatgcattgtttaggcagtaattcctacaggagttcagaagaaagagattattttaggctgtgacagtaaaggaagggtgtaaagacttaaaaggagaaaagagaaaaggcttatgtagaggaactgaaacttgggaatgactgaagccttgttctaccacttatgccttaccttgtgcctcaatttcccaatctgtataacataatgatgatgtgttacctcccagactgtcagaagatgagacagtgattgcagaaaagctctttgcaaataatgcctggtccctccatactgtgtagacagtaaaaatcgtacactttttgaaagtctttgaaaatttaggttactagggtataatttctgtcgttcaagtttgccaagtaggattttttaaattagcatattgccagaagtttgactttcttctttttcccagtaaggagagatttgtaagactctgaaaaaattttaagcaagcaattagacacattattactttgggaaaattgcttttatggccaggcatccttttctgtttctttatttccttgagcaaagataatgattgataaggaagtaaaactagaaagaagccagatccaaacttagaaggaaaatattttgtcacgtatggaagttcagtggaggttgcaggttggctgatgaccactttgggtgaacccagcctgacactcagcattttggagatgatagtctcagagttcacaggtttcctgtgtataaggaaatggatgtcggtcatttcaactgtactgttaattgctttgggaaaatgagtggtattcattaggcaaggaagcttgtagccagccctgtaattaatgtgaaaccttttcatacagccagtggctcttcagcatctctgtactttatgtttatgtgtatacttaggcttgcttcagtggccagaggcttcaaggcattcagggctctgggggctcttattataatggtaatgaaaattggaccctagaactttggacctccccagccttaaatccactgagaggagctctctgtctagggatgtggctccttctgctggcttcttcccttctctaagatagcagtgagatgcactaaacatgagatttctaaaacaaatacttcgatgagtaggaaagtctgttttcctgaatatatccactttcctacatattccattgcttgtggaagcaatgacccaagggttatatgcaggactttttcttactttggcagactggagacccagagctcagagaaggcagaaagtgtgttaaagaacaataggaaaagtggtgagagacaggcagatgaaggaagcatgaactaccatcacagagaaagggtagagtcagcaggtaattctcaaagggatgtgcatctgcccctaacccaatctaaatgcctgactcaatgtcctcagaggacacgaaccctggaaaacaagtatgagatgatactactcaggtattgcgtgtgtgtgtgtgtatgtgtgtgtgtgtgtgtgtgtgtgtcagaggtcagccctgatgtaattgccaccgaggtcaccgtggatgaggtcattgtgggtgaggttacagtgcaagagctgtcttttggtgctgttctggtcttgtgatttccctattttcagcacccagtaggtaggtgctcaataaatgtttgttggaggaatgggtgctggggccagccccctaactctggcctctgttggacgttttgtgacctggaatcattctagaaggaaagagactgcccagagtggatttgtgtcctgcttgtgactttcttggtaacaactacaatgaatatgctccccaggctcttaatctggagaactcctttttttttttttttttttaaacagtctcgctctttcacccaggctggagtgcagtggcgcaatctcggctcactgcaagctccgcctcccaggttcacgccattctcctgcctcagccttccaagtagctgggactacaggagcccaccaccacgcccggctaattttttgtatttttagtagagacggggtttcaccttgctaaccaggatggtctcgacctcctgacctcgtgatccgcctgccttagcctcccaaagtgctgggattacaggcgtgagccaccgcgcccagcctggagagctcttgatctgtaggtgaatcttagtatgagggccttggaggagcttccaagtgtctgagagcctcatgaaatgggatgcaaagttaggaatttctaaggagaaagtcagaggagcctctgattcccagccggctgctaagcccttccttaaccaaggttcaccctcccatgttgcctgctgggctgccttacagcagcctctagttccaacatctgctgtagatttctgacactcacagtctacccttcacctcttctctggctattaccagtacttcctcactatccctagtcatgggaaaaaaaaaaaagagaaccgtgtccccaagatgatcttgcctttgagccttgtgtgtttcctgacagggaaaaggccctgtactgccatgtcctcccctctggctgcttcatgccgggtcttctgcctaatacctgacacaaggagactcctccagactgaactgcgaggaaaggctttacaggcagaacaggctctgcagagttgctgctcagtaggccaggggtcagcagacttcatgctgtgtgccttaggccacatgagtgatcctcctgtagatatttcccatcagtgaaaacagagctggcactgatcacctcctctcttacagactgcggagctaaagtgggctgctggttggaatgtgctgtgaaagttggaatgtttttgcaaattttattttattttttgaatttgaagtagaaagctgtttgattataaatggtgacttttcccttctaaaatcatttaaaatttttgtaccctttgaaaatgacatttaattataggcactcaaagtgcagttgacaattattgttatttttggggaattgtttaaaggatgttcattcatgcatgcatttttttcattatttacttattcagaaagatgtggaagtctaatatgtgccaggcactgggaaacagtgatcctgctgctcatatttccattctacacccaagctgtgtacttggtcatgtggcttggatctttgtaaatctcctttaccctctttgccctgaagaacgttattagaacttggtatgcaaaatacaccattggctgattgttggaatacttttgagcaggtttgtaaccactttcagtggatgctgtgtgaagacccactaaagcagtggttctcaaggtgtagcttgcatcagtatcaccgggagggtttgttaaaacagcttgctggacccccatgcccagattctgtttcagtccctgactgcatttctaacaagttcccaggggatacttatgctgctggtcttggggatcacactttgagaacctctgcattagagacatttctttagacctaagggctttgaagtctcttctcctgagaaattggtgtggtttcattagggtttatcgtgaaccttgtttgtgaacctggttttctttttgtttgctttgcttcgcgtcagaaattcagattcaaatttgtagctcaactttaagaaaattttaacagttacatcttaacttttcccagccttgatttcctatttcattttccccattctgattttacatgtttacacaatataagttcctgtatactgactgttttgtggaatgtagtatatattgagaaatatgattgcagtcagtgttcttttcttggacatttgtctttcgaatcaactctaaagtattacatgttttgactgtttaatgcattagttatgggagtagattccccagaagaattatattattaatagcaactaaccaaaggattggaaagaaaaaattgggaagaaagtgacagaaagttcttggtaaaaaacagaactttatttttaaactattgatgcatagatagtatctacaagcagtaatacatatgcatatatctgtatgtttatatgtgtatatatatgtgtgtatgtatggttttttatttttatttttatttctttttgagacagagtcttgctctgtcacccaggttggagtgcagtggcgtgatctccgcctcccaggttcaagcgattctcctgtctcagcctcccaagtaattgggattacaggcgcccatcaccacacctggctaatttttgtatttttagtagagacaaggtttcaccatgttgctcaggctgcctcgaactcctgacctcaagtgatccgcctgcctcggcctcccaaagcgttgggattacaggcgtgagccaccgcacccggccatgtgtgttcttttaaaaactgagaaccctaatacataaacaatatactttctttggttgttggagaaaaagcgaagggatgaggtggtgatgagaacagtgaaggcaaactacagtggttgcccaactttactggagtcacctggagtttgttaagtgcgatgccagtttgctaggcctgggggtggggcctgcatttgtaataagtgtatcaggaaattctgacccacgagaggtgggagaggtttagcactgggtagaaaaatgaaaggcccaatctgtattaaacctgctccaaatctttgtatccatttttggatgaggagttcctgttcagattttctgcaacttttcctgaaatcagagtgtaatgggcacaatatcattcatattagtcagtcttagctccagaaagtactcattatgttagatgttcattggaagtagtttgtagctgatttttttctctttcttcgctctctgtatttctgtcttctacttctgtttttagttgaagagaagatactttaccaacagcttgtctgaaaacaatttgcagataggagtactcatagaaaactcttggggttctcactgtgggtcttctccaggggtgtggataacaccaaacactgcagtatggaaactagcgcaaaatgggatgtgctgtgacactggccagctggagacagttgggacaggggatgacttaacgttaacatgggaatgttacatacacagtctagaaaggccagatattcttttgcactgctgcctctggctctcttttcatctatttagtgaataaccaaatttatcacctgtagtaatcagttactaatttagaatttaatttctttaagagttacctggatttagggctcagtgaaggcagtttttatttaaaagcattttcttgaataaacattttagaacagttttagtattacagagaaactgtgaagatagtgcagagaattcccatatacccaacagtcagttttctgtattattaatgtcttaggttagtatgctacattgtcacagctaatgaatcaataatgatacattattactaattaaacttcatagtttatcagatttccttagattttacctactgttccatttctgtgttaggatcccattcaagataccacatcatgtttatatgtctgcttaggttcttctagtctgtgacagtttctcagactttccttggttttggtgagcttgacagcttgacaagtcctcgtcaggtattttatagaatgtccttcaaattgggtttgtctaatgtttttcctgtggttcaagggttttgggaggaagaccacacaggcaggcatagtaccacatttcattccatcatgtcatatcaattgcataattagcttttacatgcatacatgctatcaaaacgacctatcactgttgatgtgaaccttgattgcatggctaaaattatgtttgtcagatttctcacataaagttcctcttccccttctttccatactgtactcttgggaaggaagtcactgtacatagctcacactttagttgtggagaattatgctctacctccctgagggaggtagtatttagagaaattattgggaattcctctgcttgggagatttgtctattctcccccatttatttattctatcatttatttgtatcagtatggactcatgcatattttatattttaggttataatctaatatcacatgattgtgctcctcaaattgtttcagatttggtttttgggagctgtttcaataggctcctgtgtccctttgtgacatgccacccatcctggtgggtttttgttgttgcatgtgtgctttttaaaatcacatccttattctttctggcactaaaagatgcccctggctcactttgtatattctttgccccatccctagaatcagttatttctccagggaccctggttccttttgttggagaatggttttagaaaccaagttctgggcactgcgtgtccttgttgctactgaggtgtcattgcttttaggtctgttcagctgacggaacagagaaataggtgtatactcacccttgtatatacacatatctgtaaatatttctatatgtatccatctgtatctatattaagttgaacatgagttcatgctaatgttttcaactccgatacagtgttacagacctttttttactagcctttctcccttgtctgcaaactcctgctctaacagtgaaaaactggttcctaccacccaccatccatttacttacatgtatagtggtttcagaattgttaacttgtatcccttatgagaaagaactttattggctagagttcagtggttatgtgaaattcgttatgtaaaattcattttgcccttagatctagagtccatactcatttctgaaggtccttaagccagcatcttttccctcacttctttcagtgaggttatttcatgcattttgatacagttgattctcatgtcatagtctgcatttcatattccaccccaggatctcttgataccctaactttttaaattgcatatattcaagttctgtgtgctataaagttctatgggttttaacaaatgcttagtgttctctgtctaccattatagtatcatagagaacaatttcactgccctaaaaaaaattctctgataggcctcaactcatcatttggcttaacagtcctgctgagagagtcctgccagttgcatctgagagacagtcctgccagttgcacctgctgagagagtccttcagttgcatctgaaaccagtctggtttttaattttacctgatgttcagaaaatgctctcaggctgtcaccgggctgaagaactagttgggttgtagctgtggctgtgaatctggttcccaagaactggctgtattagtctgttctcacactgctataaagaactacttgagactgggtaatctatgaagaaagaggtttaatggactcacagttccacaggctgtacagaagcatgactgggaggcctcaggaaacttataatcatggtggaaggcaaaggggaagcaagcagcatgacggagcagggtagaaagagaaagggagagtaaaggggaaagtgccacacactttcaaccaaccagatgtcatgagaactcactatcatgagaacagcaagggggaagtctgcttccatgattcaataacttcccagcagcccctcccctgacaggtggagttacaatttgagatgagtggggacacagagccagaccatatcattccgcccctggcccctcccaaatctcatgtccttctcaaccaattatgcccttcccaacagtcccccaaagtcttcgtttttgtttttgtttttgagacagagcatcagtctgtcacccaggctggagtgcagtggtgtgatcttggctcactgaaacctctgcctcgcaggttcaagcaattcttctgcctcagcctcctgagtagttgggactacaggcatgcgccaccatgcccagctaatttttttgtatttttagtagagatgggattttgccatgttggccaggctggtcgcaaacttctgacctcaagtgatctgcctgccttggcctcccaaagtgctgggattacaggcatgagccaccatgcttggcctgtccaccaaagtatgaactcattgcagcattaatgagtccgcaatccaaagtctcatctgagacaaaggcaagtcccttccacctatgagcctgtaaaatcaaaaacaagttagttacttctaagatgcaatgggggtacaggcattgggtaaatgctcccactgcaaaagggagaaattggccaaaacaatggggctacaggccccatgcaagtccaaaacccagcagggtagtcattaaatcttaaagctccaaagtaatctcctttgactccatgtctcacatccagggcacaccgatgcaaggggtgggctccgaatgtcttgggcagttctactctgtgcctatgcagggtacagcccctgcgactgctttcgtggcgttgagtgcctgtggcttttccaggtgcaagatgcaagctgtcagtggatctaccattctggggtctggaggacaatgtctgtcttcccacagctccactaggtagtgccccaatggggactctgtgtgggggtttcagccccacatttcccctttgcagtgccctcatagaggttcaccatgagggctccatccctgcagcagacttctgcctggacgtccagatgtttccatacctcttctgaaatctaggtggaggctcctaaacctcaactcttgccttctgtacacccacaggcccaacactatatagaagttgccaaggcttgaggcttgcaccctctgaagccacagcccgagctgtacattggccccttttagccatggttgaagctggagtggctgggacacaggatgtcaggtctcaaggctgtacagagcagtgagggccctaggcttggcccccagaacaatttttctcttctaggcctcccagtctgtgatgagaaggggtactgtgaagatcttggaaatgccctggagatcttcccattatcttgcctattaacatttggctccttgttgctgatgcaaattcctgcagctggcttgaatttctccccagaaaatgggtttttcttttctactgcatggttgtactgcaaattttccaaacttgtatgctgtgcttcccttttaaatgtaagttccaatttcacaccatccctttcttcactcatatgagtgtacactttgagaaacagccaggccacatcttgaatgctttgctggtgaggaatttctactgccagttaccctaaattatctctctcaagtttagagttccacagatctctagggcagggccaaatgccaccagtctctttgctaaaacataggaagagtgacctttactccagtccagtaagttcctcagtctccatctgagaccacctcagcttggacttcattgtccatatcgctatcagcattttggtctcaaccattgaacaaatactaggaagttacaagctttcccatatctccctgtcttctgagccctccaaactgttccaacctctacctgttacccatttccaaagttgctaccatacttttcagatatctttatagcagtaccccactcttggtaccaattttctgtattagtctattctcacactgttatacagaactacgtgagactgggtaattcatgaagaaaataggtttaattgactcagatttctgcaggctgtacaacagcatggctaggaggtgagggggaagcaagcacgtcttatcatggcagagcagagagagagagagtgaagggggaagtgccacacactttcaaacaaccagatctcgtgagaactcactgactatcatgagaacagcaaaggggaagtctgcctccatgattcagtcacctcccagcaggccccttccccaacatgactggattacaattcgagatgagatttaggtgtgaacacagagccaaaccataccacgggcaaaaattgattttataagaagtgagagaatgagacaggtgaatattttgaaggcttgtgtggcaaatattcattagccaggtttattaaaaactcagctacttgggaggctgaggcaggagaatcacttgaacccgggaggtagaggttgcagtgagccaagatcatgccactgcactccagcctgggcaacaagagtgaaattctgtctcaaaaaaaaaaaaaaaaagctcataaatacattaagattttattcacagtgtggtgggtgtggtactcaaggcctttaatgggattttaataatccaaacctaattcagtctccagatgactgtgcaatataatggagataatgctgctttacttttccttactcagaaggtggttgtgaaggtctgctcagggtagccagcgtgcctttcccaacacccttctttctgttttgctggttctgctttctctcattctctaaacatggctttggtccttgattctttgctctttgaactgtacaattgttccttgagggtcagtcagctgtcttgtggttcagttattcctgtgtggatgactctacctgcagcccagccctttattttaagtttcaggtcccatttatctttttgtcacacatttctaatctccctacaaatcagtatttttaaaaaccagagtcatcccaaaccaactgaccctctagattgccttacttcttgcagatttagtcttaccgtcttccagatactacagctgcctttgggcttttcatcatcccttatccttagccaccaagtcctgctgagcttcttttgtaatacttctctcctgcctcctccactgcacacttgtaccactgagacagtctcttaattctgcccagcacctccagccccatctacacccctctagtttgtcctccagcatgttgttttaggactgttgctagcctaattatttgaaatgaaatttcagttcttaacttggcatccaaacctttcgtccattgcatttctagctttaccttctaatttctagctttaccttctaattcacttaaatgagatacaatttaattaaaccatgtattccttgcagcttctgtgctgttttccacatctgtctctttccccatgttggcagggtaaattttagaggtgtaatgaaatttgcaggtggaagttatggggatatagattgtctttagcttaatgtaaggatgacctttccaacagaattgctaatgatggggtgggtatcatggaagaagtctacctgtcatctcccaggtcatctactgtcatctcccctttaaagacctcatcttccatatctgcacatttggcttctcctctcttttgaagctgcttgtttccatgtcccatgatgctaaacttggggactcctcccacctctcagattgtattttctctggttctttctttcactcctttagtgaatttgctttttcttttcttcttttcctgtgctctttcttgaaaaatttcactgctcttagacttagtgtttaccttttgagaaaaattcccaaatgataaccccagccgtatgtttaactacatgatttgtctttatttccaacatcttgccagatatttctatttgagtacttttgtgtccaaatttaaactcatttctttccctttaaaacatgttctttccctgagttccctggctgattagtggcaacagagatgggcagatctttctgtaaagggccagagagtaatatttttgtcttcatgggccataaggtctcaatcacagctactcatcttgtagataatatgtaactaaagggttgtgactgtgtttcagtaaaactttacttatcaaaataggcagcagctggcattggcctttgggctgctgtttgctgaccctgatctaggatacccaggccccaaactccatactcctttggcctttccactgcttttgtttgctctcttcacatgattattaattttcactgatttcacccttagcaaaccattcatacttctagaccatagctgtctgtctattcattcatctagtagacaaaatcttccttttacatgttaatctctatcattttacataatcaaaaacctctagtggctccccttggcctgcaatctaaggttacagttctctgggtgtagctctttctgtgttttgcctccagccttctctcttactcctgtatggacattcctccaatgacactgatcaagtgtgtgttctgatattagttctatcacttctcacaggttgctcctgactcagaatggtctcacttcccactaattgaaacttgccttcaggcctcaattcagggtctcacttcccaggtaaagcttcgccctagcccagtgattgctcctctcctagggctttttttttctttttctttttctttttttttttttgagacagcatctctctctgtcacttaggctggaatgaagtggtgtgatcactgcagcctccaactccagggctcaggtgatcctcctgtttcagcctcccaagtagctgggattacaagcatgtaccaccacatctggctaattttttttatagagatggggtcttattttgttgcttaggctgttctggagctctggcctcaagtgatcttcctatcttggcctcccaaaatactgagattacagatgtgagccgccacacccagcactgaatagtgcttttgatgttgccactgacctattcagttgagaccgcattgggttgtaatttgtggtgttcctccctctccatctgaattttcagaagctgttaaggacagcccagtagatgctcagatgtcataggtaaaggtcatacattgaactctttgtctttcctccagttctgcttcccccttggagtccctgtctcagttaatggcaccagggatcatcattgccttgtgattctgactccttctctttcacctccaccctacctgcatcagttacgaaaagtccagctgctgctccctcctatgtctttctcctatctgccctctcctctccatcccttctactgctgccttagctcaggtcaccactgtctttcactcagaccattggacttgccttgaacatgaattcccaccaccagcttctctcctcttataatcccaacagttatgtatcgggatctgacatgtaggtatgaccttgtaactttcctgattgaaacccctcagtggctccccattgccctgggataaggaccagcctgccagcatgtcgtgaggccattattgattggatgcactttcctctgcagtcctatttctgacttgtctcatttacacagcttacatttgatcatctgtaacccctatacatcttctgtgcatttgcacactccccgtctctgtgtagatgccccccctccccaggtccacttggaaaaccatcacctgaatttctaggcattgtacaaacgttccctcttttgtggagctttcgtctccttccctccagaagaccaagaggagtaaaggtgttatcatagaataactgttgggatagagatataggcttcatctattttctaatgcctcctcagattcagagtcttccaaagtttccctgcagactgagcaatgaataattaagcaaacaagtctctaaaacatcttgaaatgcttatgtatgctaaatatgtagttttgagttcttgttttggttttgctggagcttttgccttcttcctccattacaatggatgatgagaatcaacaatgtagaattattctcggttagtttatatcttgtttttaacctggtatcttcagtgtgttaagacatttttcctttcttgtgggggttcccctgcaaagaaggaggctcacttgtggggccgatgaccactgtctctaggcaacccagagaggtgtgaaagaaagaagggggctgtgaggctgcagggagtatattccccatctccagccagggtcacacctgtcacttctgtttagtacctcttcctagtaaggagaacgtatgctccctttctggaagggtctacttagcagaaacgaggagtggcgagctcatgtggaaagtgcttttttgatgtgttctttcatgtaggggacacacggtgtggaggggatgcacaattactcttctgtggttcctctttcttactccagggtctcctttgccatgaggtccctagggacgtcttatcagaggagaagaaaagtaccttcttagttcttttttgttttgttttgttttgttttattatggggtttcactttgtcacctgggctctccggggtgcagtgttggaatcgtggttcattgcagccttgacctcccaggctcaagtgatcctcccacctcaacctcccaagcagctgggactacaggtgcatgccaccacacctggctattttttattttttatagagatgagatctccctgtgttgcgcagactaatcttgaactcctggactcaagtgatcctcctgccttggcctcccaaagtgttgggatttcaggtgtgccttggcctcccaaagtgttgggatttcaggtgtgagccactgcagccaaccccttcttagttctggagagcagagtcttgcctggcatcctggtgctataccaagagtcctctcctggtttccagagaggacatttgacttcttcaggagaactcaccccactccttttggtccattaggagcaccagaagctttggacctgatgggctgggcttggtctcttcagagcctctgtcctcattcacagaggaggtatcaggtaggccttccagcacagaattacattacctgggaatttaagtgggaggaattgcagtggagtattttgaagatcctaaggcatccttcatttaatttacattttcgattcttcagatattggaatcaaagattgagacacacacataacactagagcacacagtagaccatttctaccttgagctatctccttgttagagaaaaaatagttttgactgtttgtgattttttactacgggcagaaaaactttgaaaaattaatttcaatgtaaaagagttttacttttgccagatgataacacttcctatgctagaacctgggggtactgggatctgacttgaagtaattctaagtttaaatttatagcaaccatgtgggtctgttcagctgggaggggagaaatattgcgagccataaggatgtattttagagagtttctttagtagtcttcagatgtctacttgccctgtacaaagttcagaaactgtttaggacttggaaccttagaatatcagatagaaaaggattgacaggcttagtctactctgtttttgagatgccgaagccaggtgacttcccctagtggcaggtaggcaatgtcagagttgtgatcatggcctggggctcttttccaacctgctctctgacctcacataggatccggattgagcagggtaaagggtggaccagtaaaggctttaatcagtaaagtaatgacagtgttttccttcatttgaaaccagtcagatttgatactacttttctgttcagtttttgccatcattgttttctggaagtttttaatctgtaatacctcttagtatgctttaacacataacacctagtgtcattgttatagagatgaaagtagaaaattagcagggatgtagtatttgcctattgcaacttcttttcctttaaaccccttcccatgtcggggggataccttgtgtgtctgcagcatgtgatgctgactcggactctccaggcagctgactaacggcacctaaactgcctgctgcattttccctgccccagcacagacttgcttagcagctcccgcctcgggccctcattgagaaccatccagcggcacatcaggctggtgccactcccagtggccttggcagtgaggaggtgaggcgagagcaccctcaggtgctagtggcacgagtcttgcccaggctcccaggggaatgagtggtgtgatgacctcatgtgccagaagccagggcaggcatgcttgaggctgagagaaagcaacagatggacctcaggcagaagcagtcagagcagcctcaagggaggctggtgcggcaccagcgtggcatcttcccagcatctgaatgttggcttgaccttcgctgtttgtgtgacctcacccaattcagtaacctcactgagcctccctttttccatctgtgcaacggtgatggtagtacttcactctgcaagcggtggaggtgagagataatataggtcaagcatttagcagttggccaagctaaagacatagctgttgtttttgttattagaaacacagcctcagccaggcacagtggctcacaccagtaattttagcactttgggaggctgaggcaggtggatcactggagctcaggagttcgacaccagcctgggcaacataatgagacctatctctacaaaaaatacaaaaattagctgggcgtggtggtgtacacccataatcccagctacactggaggcttagttgagaggttggcttgagcccaggagatggaggtttcagtgagctgtgattgtgccactgcactctagcctgggtgacagagccagactctgtctcaaaacaaaaaaacaaaaacaaacaaaaaaaaacaagaaaaaccaatacaatctcatttttcctgttaggttattcatacaaacctgttggaattttttttctttaggaatttgaatgctcatttttaagccagacagtttcaggtggaagagaatcatgaaatgctttatcatgtttttgttatttatcgctagagtaagacttaggaaagctatagaaaagagccatccagccaagaatttgaattttgtcaacttctctattacagaggtttgctcaaagcccatagagtctagatgaaccttctacctttgcccccaaaattgcttttttcttttaatatgctagatccctttgcttattccaggctgaaatgaatgttatgtagctagaagtttcctgtctgtgatcaattctaatggcttttgtgaagggaaatggttgtaaattattaccagttaattaaatgagtgtttctcttgagtcctttgtgtaggcttttatccaagcctgtttagaatcatggaacattacagctagaatatttttagacaactcttgtttcatggacaaggagacttaaccagtgatataagtacttgcctaactcctgcaaagtgatgccaaggaaaagcaaactttggctgagggtgtaggagtggctgtgctggggatccggtgggtacatcaagctaacagagtataatttctaagcagtgagcccttgtcatccatatgtcaccggtattccttggagccatcttggagtgcttttattttttacaaagtgctatcttgtaggactattctatagtaaatattacctttcctatttttataggtgaggaaattgaggtggtcagatgaccttatttagctcttagatcaactcagcagatatgtattgagtgtttacttggttcaaggaactctgcgaggctccttgggaacataatgtcagatcctgctggaatggaggttacagacttattgcaagtgatgagatatgtgtatgaaaatgtaagtaattgttcaaggtatagataagtgttaataatagttgagatgtgaattttgagaccggagggatcaatgtgaatatcaaatcctggcaccagtttcttccttctgctgctcatgaagctgtgtcatcttctgtgctcggtaacccatccaacctgtagccctaggagctcctctggggagtcttgagtaccttgcagttgtcccgaccctgggagtcattcaataaaggttcaaatgaatgaatagataggtgcggtgaagagagacaggttttccaagcagagaacacggcatgagcaaatgtgtggctgagtgatagagccaggagaggggcctgactaggacagcaggttttaaaaagtgatttttttcttctttttgtattttaactttctaaagtgacaatggaaggaagggaattttgaaaacaaagtttggatagattagtgggaaggcagcaaaaggggagcccaagtggtcctgaaagccaggtggagcagggtgttttattctgaagactctcggagaccagcggaggctttagagggggaagttgatgagatcagcactttagaaaaggctgctttgtttttggtggggtgttccatgactgcaggagaaaggatgagggaggaggcctgcagtgacagggatcctagaatgatggagggaacgaagggaaaaacagatggtcacggtgcctcaagtcggagtggctccaggattttaagcctgggaacgcagaagaacagtggttctagtgattcagtgatgaccactggaagctttaggaggaaacatgggattggagccctttaaagctggaattggccccttagagagaatctggctcaggcttcccagatggtggtccgtggtctggctatatcagagttacctacagaacttttaaaaacagcagatgcctagaccccgttcccttgccccagaaaatttaaaatcagtagatcacctgtggggtctgggaatcttatatttaatccctttctgtgattctttggcaaagaagattgaatggccttcctgatgtcgcagattggtcaggacagagcaccaggacccaggtcttctctagcattgctattactcagccacaatgtgggagataggggataagttcagatggggaggtatagtatttgaggcagcgctgattcatgtgagttcaacactgatggctctttgaggaaggggttacttggcatgagaactcaagggttagatggctctgagggtgcacgttgggaatcattcagtcaagaaatgctttcccgagtggctgctgcaaaccaggcataggatattttcagtccacttcggggactcaaaagtgtagaacagagtagtagaaacaacatagagaaccctaaaggctgaagttgtgtttatgttttcttctctgagctgttttgagtaaatttaggtgtaagttacaatgtatgggttgaaattcattattttgggtatggatgtcccgttgttctagcaccatttgttgacactgagtttttatacttttgttcatttgtctatttgtatagaagaatcacatttttttaaagaccactgttatctgggtttcaacaagggcccaggagttgttctttttaccaagagaagtggtctgtaggggagggggttagtgtgtttattgctccttgaatgactgttatagtaagaatgctaagtgtgttcatttctatgtggggctgccctagactctgacctcagctctgttctattagacactctgtcagtgcattagccaatgacataggtagcctgaggccctgatttggggagccataaaactgagaaggggagtgaatgaactgactggatttgcgatccagtgaacgctatgacctgggacaagccaaaatattgcagaaaaaaaaaatgaagcacttaggtttttatgaaggttttgagcctaaccactgcacgagcacaggatgtgggaagcaaagccttatggcagctagaaaagatgcagaggttttagttcattgcaagctcagcctgggtcactggggcttctcagagcgcccatgtattctcgctgcattggtaaagggcactgtcactgtcaagatcaacgttaatgataatcttgctcttgctggtgaaagtcaggtcacacactcagcctgacttcaccctttaatgggggtgtgaagaaattggggcatgtcaggaggaaactgactagaatggtgaaggaggagaaaatcatgtcctacatgaagttgctgagagtttgagatacccaggtctattttatttactcatttgttccacaaaccattttctgtccccttatatgcaaggtagggtctcctttggggacagggcataatgactacaacatgatgtgggttccagcagtagtcttcataacaggtgtggagttgcccacctgtctgaaagaggtctggaaaggtccccctatacaggtgggtcttgaattgatggacaaataggagttggacaagtataaaaaggaagaaaggagtttccagccagaaagatcacataccccaaatcactaggcaataagctacagatgggtaatgtgtaattttcataattttgactatattccccagtatgctgcttgatccataatgcgtttggttgctctctcagaataaatgaaataacatacctccctggagagtgtacaagaattaagagatggggatactggttgtatgcagctgcagtggtgggaagagcttaggctgaaaggtaggaaggggtttagtgtctagggctatgtgctgtgctaaagaatttggaccttatcatggacaggagaggaaacactgacggtttctaagttaggaagccacatggtcagattttaatttttgaaacatgtcactggcagcagctggaggacagtagtctggaaatagaaggcagctagaagcccgttcagggaggccagatgaaccacggcagtaggagtggagcaggggtagatccaggagagacttcgagagtggacgtgttgggatctgagagcgattcaatgtacctgctgaggagctgggcttctggcgtggcctactgggtaaatacagggctcaggagtgagaggagggccaggaaagggtggtgtcctggaagtaaggaatgagagattcatgaagaggaagatgtcaagatcagatgcggcagagagatcaactgagatgaagacagacacatctttgtatctgacagtaggacttcataaaagttgctggagctgtttcagtgctggtgggaggcagggaggcagacggcaggggatagcacggatgttagaaggcatagagggatgtgataattgttgtcgaatatttgacctattctctttggctgacaatttgaatatgttttttgagtgcaagtgatagaaacccctactcaaactggctaagacaaaaggaatttataggctcaaataacaaaaaaaaatcccaaagaatcaagcaaggcttgatctaagggtttaaatgatgttacgaagagctgttctctttctgtccctcagctctcccctctttgttggcttcattctgtagctcagtggggggacaacacaggtgccggacactcccaagtttgtgtccttccagattgaagtttagcagaagcgagatcttgtcccttccttgtagatccaggattcctagttggacctacttggatttttgtgctcaaacctgaaccagtagatgctgataccgggtagggagttgtaattacactgatagccagagagaaggaatgtgcctgccccaggccagctgtgcagagttcagtcagtgctctgatctgctaggcctgctcacatgtccactctggagttaggggcagaatcccagatgagccatttggactacatgtgagggaggagtagttctcaaataaagctcaagtgttattcccagaagctgggatggatgtactagctagagacagtgtccactggagctgtagagggcgaaactaaggtaaatgagtggaaattattggtcttgctgcgtttgtattcatagagaaagatctgtctatattgtacaggaatgaaataggccagctgttaaggtagtgaattggttgtcactggggggtatctaagcaactaccgtgaataaatgataacagcccatcagcagtgtatagaaggaacaaataacctccaaagccacatttttcaaactgtttctctgtgacacagtaaggaatacatctttacattaaaacctactgtacccttttatatgtatacaaaactacacacaaaagttgcatgaaacagtgcttttccttactacctgtagcatgttcatattttctgttctgtttttattctactttgaaatccctattgtccgctgggtgtggtggctcatgcctgtaattccagcactttgggaggctgaggtggacagatctcctgaggtcagaagtttgagaccagccttgccaacatggcgaaaccccatctctactaaaattacaaaaatcagccaggtgtggtgacatgtgcctgtagtcccagctatgtgggaggctgaggcaggagaatcacttgaacccaggaggcagagattgcagtgagccgagatggtgctactgcacaccagcctgggtgacagagcgagactctgtctcaaaaaaaaaaaaaaaaaaaaagaaagaaatccccattgtgtgcaacccactaagttgctttcatgtctctctaaaaagtttcaacctgcagtttgtaaaaccctgttctaaggtccagtgtcttaccacatctgccctaggtggacaacacttgaagaccgtgtttaaatccggcttttccaccacagtgggtgacatgggtcaaaaatgcggaaggaaacctgttctacttgtgagagctcctgcttctaactggtggaatctcctgctgtctgtcagagtagctcctgacccatcttggggtggaaaggcctttgtgggccctcagggaagtgttgaagggagtttacgggctggctgtgggctgcaggatggcggaggcggccaggcagcaactgtgcctgtgccagcagtagtttatgttgtgaggtcgaatgtatgtgtatgtatgtattctctggcaggcctttatattgaagatgagggagtgtggcttttaaaaataatgtatttttgacttgaaacaagtcaaggcagagagtggagacaattagaggctgatatcctgtttagtcatctctctagagagctctattttcagagctgttctataaaggttcacaagtggtattaagatagttaagaggatattgttaacagtagtcatgatgcaagtagctgatttgaacagggaggtgatttatagtgtggtaaccacattggtaacaggttttatgcagagaaagggtgggttgtaagaataggttgttatacaggttaagctttctgaatctgaacaaagcaggcatcttttattttgaaaaagtatataatcagggtgtggtggtgacctagggtaagtccagtgcatttttgggggctttgtcatgggtagatacaataaattttaaaaaagtaaacagtactgttaagaatctttgagattggctgggcatggtggctctcgcctgtaatcccagcactctgggaggccaaggcgggcggattgcctggtctcaggagttcaagaccagtctgggcaacatgcctctctaagccaggcatgatggcatgtgcctgtggtcccagctacttggggggctgaggcaggaaaatcacttgaacccaggtggtcgaggctacagtgagtcatgattgcagcattgaagtccagcctgggtgacagagggagactctgtcttaaaaaaaaaaaaaatctttgagatcatatgtggaggctgtgttagaaacgctaggccaatgccaggcacagtgactcacacttgtaatcccagtgacttgagaggctgaggtgggaggattgcttgagcctaagagtttgagactgggcaacatagtgagaccttgtctctacatacatacatacatacctagataagcaggcaagctggttatggtggcacatgcctatagtcctagctacttgggaggctgaggcaggagaatcgcttgaggctgggagttcaaggctgcagtgagctatgattgtgccactgcactccagcctgggagacagtgagaccctgtctcaaaaaaaaaaaaaaagagaaaaaatgctaaataatgatgccatagacttttcagattggaagagtgaggctcagtgtggtaaaggaccttgcccagggtccagaaccagctgtgacagaatcagactagagttcttggcctggtctagtaggggggctctttccactgtaccatgtgactatttgcagcttattttaaatttaatatttgaccaaaaatggtcattcgtatctctagtgaaacttctctatatgccagtcttcctcttcagatgaaaggtcaaaggcagaaatggagccacagccaaagaaagagaaaaataaaataaaaatggagccatgggcagaatctgaaaagatttatttaaggacaattgtaaattcatgtatttgagtccacaagagcctcacaatgcaaggcttagaggtgttcatggatagtgaagttagcatccggtaggaagaggggagtccgcccacctaagctagtggtgatcagaacagagccagaggtgctgttcatcctgggcgccatgctgtatggggtctttcggaaactggactatatgcagaggacgacaccatatgaaaagacttcaagctgcattgcttgcagaatgcatgtcttgatatttcagctgataggtaacttcaaggtatgttgatactcccgtgactaattaagagtagcagtccgacacagtgtctcacgcctgtaatcccagcactttgggaggctgaggcgggaggatcatttgaagtcaggagttcgagaccagcctggccaacatggtgaaaccccatctctactaaaaaatacaaaaacagatcagatgtggtggcacacgcctgtaatcccagctactcaggagactgaggcagaattgcttgaacctaggagatggaggttgcagtgagctgagatcatgccactgcactccagcctgggcaacaaagtgaaactacctctctctctcaaaaaaaaaagagtagtgaatgcaaggctcctaaacttccttccctagtgcttccttaagattgaccagactttggtggaaatatgtagcagagactctttatactttttactccataaaactaaagatttgcagttgaccaagccacatgtgttcattaccttgtatgttgccgttatttctctatttcatattcttgccatgtggtttagtaaaatgctgctcttataagccatatgcataagatatggaggtctcaaaaacaattaccaagtatgtggatgtgcctgtctatattatgacaagccaaaaatgggagagaataaaattcaagaggaaggaaactgataaaatgtggtttcttttcagtctttacagttttttgagctttcacttgtttccctgccactctactatttaatgaaagacttagatttatttgatttgtggctgtgatttacacattaggcctctctgtgatgaattgtttaaggcccacaaaaatattttaaaactaacatataatatacatttttttttctctttgtaggtggatctcgagccagaggggaaagtatttgtggtaataacccttaccgggagtttcactgaaggtaagaatgagttttgggtagtttccagaatacatgtaatcttggtttacactcagtaggaatttctatcatggacattataaaaaagagcatgttgtaagagatgcttaaaaaatcactttcataagttgggctggctagtattttgttgcccagtggtctattggttcaggttgccaaattaaatatatttgctaaatctggcaatctcacgtttcatttaacacactcaatgagtttttgtttttagccagtgtcatcgtagctgaatggtttttgcgtctttttggttcatgactgtggaactctacgtctttggttttgtgccatcttttagtttgcctgtgaatgtctatgaaagaaatttagggatccagttatcttctttataatctctatctcatttgtgacctgtaagggattctgttcttcatctgtggctaccgtactccctactcccccatccaatattttttttacttgaggtaaaatttatatgggggtgaaatgatagatcagaagtgaacaatttgaattttgacaaatgcatacaactgcataaccagcaccccaatccaagatacaggacatttccattattgtgaacatttccctgtaccctttttcaatcccctgctcccagaggcaataagtaaagtgctttatttcaccacaggttagttttacctaccctagaagttcatatacatggaattatacagtatattctcttttatgtctggtttctttcactcagcatagtttttagaagattcatatcattgtgtatatcagtatttttttcattttatttctgagtagtagtatcccattatataaatgtagcatccatttgtttacccattctcctcttggtggacttttggggtttttcctattgttgtctattatgaataatgcttttattaaccttcttacacataaatttttctggacataacactttcatttatcttggataattatataggagtggaattgctgggtaataaagtaggtgtgtgtgtaacttcagaagaaacttccagatggtttccaaagtggttttattatactcccaccagcaatgcatgagagttccaattacttcatatcctcattaacactttctatggccattgcttttcatcgtagacattctagtgggtatgaaattatatcctgtgggtaaatttgcatttccctgatggtgagtactttctcacatgcttattggtcatttgtttgtttatttgataatttccagttccagtcttttgtcctgttttctaaaattggatttgtctttctattattgatttagaggagttctttgttttctggatatgagtcctttgtgagaaataggtattgtgattactttttcccagtctgtggcttgccttttcattttcttaatggtgtctttgagcaaaagttttaaatttctatgaagttcaatttgttaatctcatcttttgtagttcatatgttttatgtcttcagagatctctctgtcataggatcactaagatattctcctgtttctttttttgttttttttttttaagaagcaaatagttttaggttttatgtttaggtctgtatgccttcttaaattgatatttgtgtgtgatgttacagaggagttgaaacattttttttcaatacacgaatgcagttgttctagcaccatttattaaaagtctcccctggccccttgaatcaccctggaacctttgttgaaaatcaattgaccatataatgtgggtctgtttctggattatctgttctgtcctgttgatctgtttgtccatctgatctctctttcttttctctacattatgccagtattacactgtctcattactgttgctttatagtgagtcttatggttacatagtatgagccctccaactccgttcttttttgtatgtttaaggttattttagctattctcagtattttgcaatttgatatcagttttagagtcagcttatatatttccagacaaaatcctgctgtattttgaattgaaattgtgttggatctatagatcagtttgaggggaattaacatcttaacaatcttgagtatctttaaacccatctgtagtcaaattagtcaattctgtagtccgtggacatggtctttgctcgtaaggcatagccagtgtgaggtttcagtagaaatcccaaggtgttttaagcccattaattttatgtcactcaagcttctaactctttctcctatgggtgggaaacagctgaaatctcagttcctatctttcagcatcctagctcttgctcctgtctggacctcttagagtttcccttgcacatgcacagtttaggaagatgtgagggcttgaagagtttacatatgtggaggttcttctttctgtggccccatctttccaggttttctcccctcaatatccagtcatctggtaggcttgaattttgtcaattctgccttcaagccaataaaactgtggttccatattgagttctatttacccaatcctgcacaacctggggaataatctggagaaaagccctacaaatgtgggtctcacctaatgcggtttccctccttcacgtgtcagattctctctagtttgtatgtgtttttggttgttctctcacatcatcaactagttgtttaaaatatattttccaggtattttaatcttttggtgggagggttggtccatatcaagctacttcaccattactaaaacctcatgaagatttttaagcatgtggcttaattgtttgtatttttggtattggcattttgcaaaattggttacactttctttgagaaatagttttctccactcctttcagccaaccattcccattcatatgggtgaattgttttaatgttaaagtttttcaatatatcgtctgcattattaaatcttgtctttttgcacaaacctggatttagcagaaacctagaatacttgacataaaaaaaaaaactgttcaggttacaatttgggggggtgttctgcctgctccaaggtctttttgctttgcttggtatcttttatgtacagagaaaaatgagtctgttcctagcctagtcaaataaaatcaatgtagtattatggaacattgttgataaaacattctcatcatgcacgtagaacatggatcagctatggtagaaagaaacacaacagtgagaaagaggtcaggaggaggagtgggtaagattctctctcattcgagctgaatcaactctctgcattaagttacaagggactggcgaagtaaagcaatgcatgttagaccaggtctgattgtgccataatcattacatgacttttttagagccatgccaactctctaggactaaatgctcaccaaatacatctgattgttctcattgtatttatttcttagtttcagtgataataagaatgaaatggtaagtcatactagaggtgagttcttactaggtcattgcagttgtgtctttcagagctgaccctgggtaaaattgtgagatgagttgagtttatctttggtaattccatctttgctttaagctagtcctttgtctctgcctacagttgtcccttactgcagcaagaagcccagtggtccctgtccagaaagagttgctgataaggaaaacagttaattcataggctaattcacactacagtgatagagattgatgtcatagtactctattcctcttaggtgtgtttgcatattttaaaagatgctggaagagctgctttatccatgagaaatagacttttaatgctaaaattttaatattgaaatctacgggtggggtatattttaggaaccccatatctgttctctgtgtctctgtgcgtgcattgctttttcattttggctcctagactggggctcagcttgagcttgcacgttgctgctgcctttaaaacaccgctcccttgtcacatgcagaggacgtgatggctgcctgtctgtgttaagtaagaaggaaatggagcccccccccgcatttgcctgccacagctgtggcagcaacctggacctggcactgagagcatgtccctagcttgacctcgctcctggaagccaccttagattatgtccagccataatatgacaggttggctggtgcaacatttggagctctagttcccatcttggatactgaaagccttcatggaaaagcagtgtaaggtcaggcctgcccagtgtgttttggactgtgaaaagggcattgtcctaggatcctggaggcactgtcaaagctcaggaaatgttggctgatcctcagtctgtctcacatggttgtcttgaaggtcagatgatataatatatggggaagtgctttgcaaactataaagtactatatgaaggtatgttagtgggattttcatttccatgttcctattgtcacagcaaggagatcccagtcatttcccctacccctgccctgggaccatcttgtatactcagcaggttcgttttatcttaacattgactttatggccaggcgtggtgtctcacacctgtaatcccagcactttgggaggctgaggcaggcagattgcttgagctcaggagtttgagaccggcctgggcaacatggtgaaacaccatctctacaaaaaatacaaaaattaaccaggtgtggtggtgcacacttgtagtctcagctacttgggaggctgaggtgggaggattgcctgagcctgggaagtggaggttgcagtgagctgagatagtgccactgcactccagcttgggtgacagagtgaaaccttgtttcagaaaaaaaaaaaaaaaaagaaaagaaaagactttattttatacaagaagcctcaagaatttcatggacagtggctagcataatgttggcttatctccatgcctgttttcatgatctcctatgcgggttctgccataagctcagattctataatctcaaagcactcctttaaaaaaaattacttaaattggacggtggtctgtgatatacaaggctggtattggggctactgactgctacttacctcattttttaatttttcattaattatactgaattagctcaggcaaaactattttgttaaatgtaagacatgattgagaagtgacataagaaaaacctgctgggtgcagacctgtaatcacatcatagatgctggagagataaagatgaacgagacatagacactctcacaggagctcataggagggaaggcagatacatattatgtatgcaatgcagggagccaggtcccatggcaggaataagcccagtgcatagtgttggcacatgggactacataatcaatttggccaggagggtttagagaaagcttttctggggaggtgatgtttaaaacaagtctgaatgataaataggactgtgcctagaagggaacagagttcaagagagggagacagtttgtacaagaaacgaaaaggagtgtggaggtgctaaaggtagggggtgtggaggtgctgaagattggggagtgggatggggggatgtggccagagatttcggagggcttatgtgtgggcttgcccaggacaggctcagtttgttggttacaccagaataattatacaacagcgccactgttcactttcaaaagggtgccaggtcagacaataaattgcatgttcacaccacttgtaggctaatagaaatgataagataccagtgaagggttttaagcagagatctgatttggtggcagtaagttcaagggtggggaaggggtgttagttgataagactagatctaaggtgtggagaaccattatagagacttggaaggttgtctcagggcaagattattagggcctgaattaggttggaatatgtaggggtggagaggagggggacagctttgagagatgtctgtgtagtaaaatcagtaggaattagcaatccactggatgtggaggatgaagaaagaggagtctcagatgatgctcagatggtgcctcagagtcatttaccagggtagaaactgggagaagatgatgaatccagctttggacaagtggagtttgaggtgcttgtgggaaatctaagttgcaatgtctgggagaaattggaaataagattccggagtttggcaagatgcctgggcctgagatgtagctccaggtgccaggtggaagacaggcacatggataaagaggcccattgagaagatttagcaagaaaaccagcaaggctgaccagcagcagaactctgtggagcatcaacatttaagtactttggctcatgaattatagtttatcaaaccaaccaaactatgctgaaggtttacttaatgaacacccattttgctaagatattacttgtgaaatagtatctgagtgcttgctgtatgccagggactgtttcaccagattgtttaccgtcttccaaattggcaccaaaatgtttgataatgaagttagaagaaagaacagaacacaaaaggctttgaaaagtaatgtttgcattggtggtaacagtggtttcttcaaagtttgatgatacaatgtgctgtgtgaaggtttatgcctaatgcgggggtaaaaagaacagatgaacctactcaaaacctgcagtgaggggtcttcactgaacttagatagagcaagaaaaactcttttacattcattgctttgtggaagtctctcacagagctcaaggcgtataaaattatcaactggatcagaaacccctcaccactgttcatcttgttaaaggtgtcactctgcatctgtgcagaattcccctaggcactgaggcagaagtagaagtgatttattattttgaaaaagctgcctaatgtcaatctttattctaactaagccttcctgaagctaagaactggatctgaagtctgatcaaattgaaatttattatagtgatgaaacagccctggatttttaatgcagccttcagattccatcattgttgccatgtgtgtgattgtcactatgttggactaatttttgtctggaagagtggagtagcaaaaaaaagaatagattgaaacaatggaaactgaggaaaatgcattaaactaaattcataactgctttaattggaagagaaacaacagaaagaaattaaagtatgacatcatcttatgtgaggacaaaaagatgtagctggattattatgctactaagaaatatggtgtaagattttacgatttgaagagaacatagtttgcagtaaatgaagtttgcttggactcagggaaccacaaacttaaatggttggcccacaaataaaaaaccagacatgatgtgtctcctgatggaagcccacacaacatcgtgatcttgccaaaaagtagaggtagttttgcccaaaactcaagccttagaccagtcaggcttccagatccaaccaccagttaagaggaaatataggggacagaggagcattttaagttacaccatgggatgtaatcagcaaaatccagactgtggaaaaattttacaggaaaagagacttggtttcttctaccaaacattggaagaaaaaagtaaaggaaagagaaccaaagtaacaagagagaggcatattaatcatttgcaatatatgggccacattttatcccaattcaaacacaaattataaaagaaacattaactcccaggaggcaagtgaagaaatggaaaccgtgcctggatctgtgaggatattacagaattgttgatgttatttaggtgtgattgtggtattgtggttacttaaaacaaaaagaacatccattagaaatacacttaaaaatatttactgatgatatgatatgacatctgggctttacttcagaataatgcagaggtgggcagaggagatgggatagaattgaaacccgattagccatgagttgtttactgaagctgggtgatgattatatgttgcatgtggtttattatagtattctacttttgcatgtatttgaaattttcattaataagttaaaaagtaaaataaaatgacaaatttcaagaatatctgcttcttaaacaaaaaccagaatctgggttatgacatcaaaatgatgcttgaacttgaacattttacctctttccacttacaaattaaagctggagggttttttaatgtatatgttttatccatgattctcagtttttatgtatgatgaaaaagtaagttaaaaattttaaatgactaaagtactgtgcttcagaaagacttttttaaattgctaaataaataataagctgtgagtcaaaaactgcaggtaggaacaggtgagtaagataattccttttgttccgtcataaagttctcactcacagtgaatgacaagtagattatctcctactaataattacataacattttgcagttgcgaagtttaattttaaggtagtttcctaaaagaataaagtaaatcagaaggattaatggtagaagtatctttataaagatagtaagaaaaaggttcttagtgtacttgtttcttccccagagttcccaaggcaaacataaaggtattctattttgtacaagtttttggggaaggaaaacttcctcaaaaacaaaaccctgacaaagaacctgttatttgtgaatttgaagcttgtttagaaaaaaaaggccttttacttctgctaaaaccttgaattgttccttatttgagacatttaatatgtaacttggaaaagatatacatttgtcctggggagacaatggaaaggcacttgaattttggcatctgctttttctctctactaaggcagtgcacaatggtgcagaataagagtctgatctttttctttttgtcccattgcctcagtttttagctcacatttcttgtctcaagcccactggtttacaaataattacgttctctgctaagtcatgtggcacatggaccatcaaggcagatgaagcatgtgttactgctttgaagctgcagcccacagttaccccctgtatcaacacttcagatgcatgtcatttttaaagagaaaaagtgatttctggtggtagttgatttatagcattcctttctcagatttcaagcctggtgacaagttgttgatttaatttttttaaaatgtagctttaaaaaaatttattcttttggcatattagcttgaagaatgagtgaccactttagtttttgtgtttgttttttgctggtctaagcaattgtggctatcaggttgaagacagggtaggagagaaagaaaggaattgagggaatgggagaataggaactggaaacgggcgaatgatgtttttaaaggattgagactaattgtcccttgtcatagatgctctctcgtcttctccataatatctagctcatttgttgaatgccttctgaggaccagacactggagttggcttgtaatttagcaaatagcaatgggagccctcattttattttctggtagcaggataaactcttacctagtaactgagtacctctacgtgttcataccatgctatatattattccattttctctctataacaaatttctgaggctgttgtaattctcagtatgcaaatggtgaaccagactcagagacgctaatttactatggtctttcctggatagtaagtgccagagcccagacacaagctcagattgcaatgctgaggtccaagatctttctacaccatccagctatctgaggagttgggggtgggggggcagcattttagtttttttctttattccatcttagaggaaaactgtcctcaggatagcataatcccaccctccagagagtcttgtcttttgggatgatgtctttttgcaaggcttcccttgagttcctcctccttaaactggaggaccaacattcacccaggaaaggtgcagcattctcagacatcaggcatggatgggccagaaagctctaggcagattgagtttaagatttgctcaggttttgttgtcagtaggttctcttaatgtacatcttaagctagaactcagaagatgaaaatacaatcagtgagttcagcataggtatgatagctctatttgcctttttataccccagtcatcattggcttcactgtacctacttctcttattttgactgactgtaagtgaaaaaactaggtggtggctttgttggaaattttaaaattcattctcaaagtgtgatcctgcagacttctgagagttccagagacattttcaggaagtctgcagttccaaactgttttccttataatacgaagattttattcatccttttttccccactgtgttgacatttgccccaatggtgcaaaagagaaatggtgggtaaaagcatggcaccaaactataaagtcatcattgtattcttgatggccacgtagttgcaggaggaagaaatctagtttcacttaagaatgtctttgatggaacagtaaacattattcatgttattaaaggtcaatccttgactatatacctttgtaacattctgtgtgacaaaatgggaaatatgctaaaagcattcctgcttcatactgaaatactgttgtgtctcaaggaaaagcacttgtgtgattgagttgttagctgagctagccactttttgcatggaacaccatttttactttgaaagaatgacagacaaaccatactgtggaactggcagatttttcagacattgtctaaaaaacgaatgaactgcgcctgttacttcagggaaaacaactgtaagtatttggtgccagtgataaaattagagccttcaaaacataattcgaattttggaaagtttatatccaccattgtgagcttgacaacttcccagtacttattcttttctcatgagtttgttgttattaacgattgtaatttttaaaaattgtgttatgagatatgtcaacatttagaagatgacttccaatgattcagtgaacacgtattttcacaatggccagtacgagatgttataaaatcatttatgggtcaaggatctcttgaaagcgtaaggtagactcatgtatattaatttaaagtatgaaaagttcattgatacagttttatattgcaaccaacttttgagaaactacgccttgtttacttttgtgtggtattaaagaagaatatctgcaattatctgaaaaatctattaaaattatatttttaaattactctgtgtgaggctggactgtattcatgtacttcaactagaacaacattacagtggcttgaatacagaagcagatatgagaatctagctgtcaggctgggcgcagtggctcacgcctgtaatcccagcactttgggaggccgaggcgggcagatcacgaggtcaggagatcaagaccatcctggccaacatggtgaaaccccgtctctactaaaaatacaaaaaaaaattagctgggtgtggtggtgcgtgcctgtaatcccagctactcgggaggctgaggcaggagaatcacttgaaccagggagtcagaggttgcagtgagccaatattgtgccactgcactccagcctggtgacagagcgaaactctgtctcaaaaaaaaagaaaaaaagaaaaaagaaagaatctagctgtctttttttttaattaattaattaatttatttattttatttttatttattattattagactttaagttttagggtacatgtgcacaatgtgcaggttagttacatatatatacatgtgccatgctggtgcgctgcacccactaactcatcctctagcattaggtatatctcccaatgctatccctcccgcctccccactagctgtcttcttttaagtcagacattaaagagatttgcaaattgtaaaataatgccactctctctatctttggggggatgtttgaaaatgtagttatattttattaaaatgtgtatactaacatgtaatggaattgttattgtttttaataaatgataaatatttttaaatgtctccatttaaatttctaatttgacaaatatcagtagaatccattcaaaggggtacttggaccaaaaaattttacaatttctaggttatttttttcttacattctttcaaaagcccagtgctttaaattttaatgaccacagggagaaggaactgacacatatttgtgtatgttataatcagaaaaaaatatgtacagttaggtgatacaggtgacagaattgtcatttttttgaaactttctttttgtttctgattatttctgctgtgcagtgtactttttcagccagtttttgttataagcctgttctcataaaaataaggtcaggaagtgacaccaaaacaactcagaagcctgtggtggtttctaactttagagctgcctgttacagatagcttcatgctaaacctttgcttgatttgagcagaacaaggcagtcacgatacttctgaacaagtgatcagtgctgtgagcactaaaagctgaacctcaaaaacagctcaagatccatggacagagcctcaggagacacatttctatggcactcgcttactgactagcattctccttttctaatcaaggttcttgaaaaacagaggctgactcgtttgttaatttttttcaagctttattgttttttccttgaaattatagtgatgtggtattctctctatggaactgaggtttgggtaaaacaagaatgatttaattttttgatagaaaagttaattgctccagtgtctgttttcattatacttccattttatttccagcaaccccttatctctctgctctctttgtttcaaatgaacaagacagtagagtttgttttccaggccacttgtgttggtaacccttttcctaagctttccctaataacaccctgtgtcagtggacaggtagtaggtaggaagacctgcttcttcccttctaccgtgaaactcgtcttcagcatcattctttcatcctgatggctgagagttgtgttctggtctcaagtcagcagtggataacccactgcatgaagttgatggggagtgtgggcatggacaacagtggcctgaggttgcagatacattctttgtatatgtaagagaccaccttatattttgtaagtggaaacttagttctcataggattttggagaaaatcagttgcctcctctaggaattttcatttgtttacaaaatgtcctgggtcaagcaatacttttatgttatccccacttaggtttagtggatccatccatccatccatccacccacccacccacccacagagtatttatgtagaaaactatgtaatggatgtatatattcatgcatgtgtgtatgcatgtacttagtaatgacactggtttgttctcacagaactcaaaatttggtgtgtatgtggagacataaacaattagaaaggttaacataatatgtacctccacaggtggtacatgctatggagaaaataaaacagagtaagaggacagagatgggtcctatgtgtatgctgttttgttcaaatcagatggtcagggaaggcccctctgatgaggtatcatttgagccagaggtctgaagaaagggagggagtggaccttgagtctgtctattgggatggggaacaggaagtgcaaatactgtaagggttgcagcagggagaggagtgtagctgggccttgaggtcaggggaggtgcccacatggttgttggcacaactttggtgccctgctaatgtcactttcctcttcaagaatacccttgtcacttaagtgatgttcacttatgcttgctgctggcttaccatttggctcactgagcacgtcttttcccctttggttaggggcttgaagagcacagcatcacatctatttatgacttgatgtattttgctaatgcggaaaccattccaaattcatgataacaactttctccagttctgtgaattccctcatggtttctttttgttctaagccaaattaggagccaatccccagcttaataagcattaaaagttcaaattgactgtctggaaatctataacaagtccatgcactcctaaatataattagctgtaattcagttctagttatggattattaagaaattactcttatttgagcacctcactcatcaaaaataaagtcagaaaatttaggcgcagctggaatcttctgctcttttttttttttttgagacggagtctcactcttgtcgcccaggctggagtgcagtggcgcaatctcagctcactgcaacctccacctcccgggttcaagcgattctgctgcctcagcctcctgagtagctgggattacaggcgcgcagcaccacgcccagctaatttttgtatttttagtagagatggggcttcaccatgttggccaggctggtctcgaactcctgatctcaggtgatcggcaccccttggcctcccagagtgctgggattataggtgagcgccaccatgcctggccaaatcttctattcttgaacttgtggtgaactatcatttgttgaggagttttaataagtgttagtgatagatctctactaaataactggagaggtaagtaggttggagctcagtcttggtaccttatagggacttagtatatagcttttggaaagttaattcttactgaattttgatgatacttcttgtttcatgtaaatgtggatgcttccgttatgtgagtcctaagatttgggatttaccaagtactgagaataggaccttcaaaaaatatgaaatgccaagaggatctgttttaaagcaatggaattatttgagaattttgaaaaatacagattctcaggacccagtctgaatgagaatctctggggaagaggccaaggaaacagaattcaggtaagcaccttggctgcttccagtggttggccaatttggatatccctgttgtgtcctaaattatacctaatttgattaaagttttggtggctgggaggtttgctagttgaaaaacacatacaggaaaaaaaaaatgtacaggggagtgtattgctttggtgtagtcgtttaagagttgacaaaaaccccaaatgtattcttttaagaaccttttaaaatgctgcgacaagggtcaggttacagtttttgcgttgttaggggggcacatgagactcagcagctacaggccttgttaatgtctgcaaacactcagtgctaatgtggagactcaagccaggcttgaaagtgataaaatcaggatgggaatgttggctttgctgcccatcaactgttagactggagacaagttacaggcatttccttttttgtggggtaactgagaccaggaaaagacaattgaaagtggttccagttaaaatgggagccacagttttttcgtagtatatatctttaaaaaggtttgattaatactgttcttaaaatgacaacaacaattgtgaaaggaaatttcattcatcttatatttatcagtgtttgggttccagtggcacctgtgtgctaattcttagaaccaagaatggatcacataactcagtaggtatttctctgactgatttgaaagcatgataacagcttccacttcacgctgactttctcagcattgtgccgagcagagttatttttgcaaaaaggtttgaagatttcatcagtttttccagtagacaggcatggctccaccagtgttggtctcctctttgttggtgatgaactcgacatccgagatttactctgtcaggggtttgctgtgattggagtagtgtattagtcaatttcatgacttcccgcatccactacaagatctcactttttgatccggggctgatttttgtggcacagtttgtattatgggatgtatctgctactcagaaagggagaacaacagccatttacatggtgggcaggaatagggtagttttaagcaaggaggggtgttagagtagggactgatttaaaagtggtcattctgttcatcagagactattctcatgctctgaccatttagtttatctaaatcttaggattatagggattttaataattaatactcagatgatgagttcaggtgtctctgtaaaatgaataatgcatttattattaagtctaaataccctaccattctgaaggcgggactgcatgtctaataccaccatcttatctaatggttccttgggatccacccaggcacaggagaacataacaatgcttggaggggttctaacctaggacttcagaaagaattcatcgacaaagactgaagcttaactctaggagggaactgtattgatttccttaaacatactaaggaatggcaattcagtaggactctgctgtccccttccagcccctcctcagtgaggacctggtggggacactcagccagagtgtgaaaggaacagcttcagggccctgctcaaatgtgtctgggagctgtcactttttccatgcctctttctcgggtgttggacgtcctcatttgagacttttaattcctacattcttggtctttgcctctctgaatgcttgaaggtcacacttaggtacagcctttatagaaccttttgtctgatatgcagaatattgactgcatgctggctgtgtctgtctgtctgtgcctctgtctttctctagccagggattacagactgcccatgggctgaaatcagcctgcagaccagttttgctttgtatgcagcatggaataatgcttttgaggttttccaacttgagctcttcagacagggcagggttctccagtgtcccacatcccctgttgtctgaatttcctctgaattcacacctctatgcctccttctctggcctcagtttgcaatcctgaatctgagcatttgtcccatgtgtttactgggcagtgtgcagtggccttgggggagactttgaaacatgttttagtgagaaggatcacttctttactgaagtcaaaactgaaaatactttcccttcgtggaataccatacaggcgtctctcttgcactgttcagcatcccatcctactcagtggcattcccactctaggttttgggtagtacagagtctcactgctttggggagcttttgggggcatggtggagagagaaatctcttcattttttcaatttgtttggatcagaagattagcctgctttcaggtaataggtctacttttagtgatgcctacagttccctgaatgccccccaaaagttaatttctggtgtcactgttaatccttacagtcaaaatttcctgggaattgctattggggatctgtagctgtgctggagataggggcatgggtaggggaggaccatcagttttggatcagatggacttggttctgctgcctgtccttccttgctgcgtgaccttaagcaatggttgccttatgtgtaaaacaaggggctaatgatacctaaacccagggttgctgcaaaggttacatgagcttatgcacacaagcacacacccacaaagtgtagcattaggatctgatgcagactatgttcccacccacttgggaaggaaatccgtgccccatttacttccatgtacttggtggtgaatcatctaaaagatactggaaaaatgtgattacagatgccccctttctcggccattgcttcaaatcctagacagctattgaacgtcaccggatagacgtcatattctaggagggtgtcaagtacatacaggtctgtgtttctatgtgctttttgtaggagctatcaactataaagctgtgggtatgagaatttcagggcaaggtcgggaaggtgtaggagggattcactaactctggggaaagtgtgtgctgctttgtcagtttcctgttcgctaggccacagggaatatgttggctctttctgaatctgcccaccagagccaatgtcataccttttcccaagccactgcttgagggtccagctaattgatgccaccgcattgcctctcctggtgaggaccgactgtgccatgggggtggtggctgtgggcgtagacagccctgttcatgggcatgcacactgccatgggtgctccatgggaatgctggtagatagcagaacatggatcaggagttctactctccaggatagcatgacccagccatgggctcaaggaattgctctttgggatatgtttgaaactcatcccctactctggccgattctttcagtacagatacagaaatgcaatgagaaccttctccctgtagttctgttaagataaatgagtggtagtggctcatacctgtaatcctaatactctgggaggctgaagcaggaggattgcttgagcccaggagttcaagaccagctgggcaacatagtgagatgccaggcatctccaccaaaaaaagaaaaaaaaatccaggcatggtggtgtgcacctgtattcccagttacttgggaggcaagaagattgcctgaacccagaggtttgaggctgcagtgagccatgattgtgccactgtgctccaacctgagtaacatgagtgacacagtgagaccctgtctcaaaaaaaaaaaaaaaaaaaaaaaaagagttaatgtttataaggtgtttctaggtcccaggaaaaagaaatgttttaaaagtagattgtatatgctacttgttattaatttcttatctctagagattgaatggtaagagccagggccagcattgtacattgtcaggcagcattgcccctgtcgtctgccttttcctcctgttactaggagcttgttaggtttggtcaccagcctgatgacctgatcaaatgttgcctgtcaacttggagtgactgtggttgtttattttgttatttattcaccaataaattgagttggttcactctgtgtatttttacagcatttggccttttcccaaatatttgccttagtttattaaattagcttctcagttataagttaaagtgtgtgttgacttttatgattttaattttacaggcttggttggctttgaatgaccagatggcatctcttgagtctgtgagcaggttttgtttcacttaggacttcacccccaccccgttcttaaaaatggtgatatgttaaatccactttaaatctagtatttgattattaattaaaatatctcttatgcattttgaaggtaaaattacaattttgttccatgtgaaatgggagcatgtgttgacaaaccgttgattaacttgagtggatttgggttaatctttttactctgctccatgctgcctgcctgtagggtaatataaatccgttgggctgttgctaggctcagctgcttctgagtagtttgacaggtttcatcctgttaaaggctctttttctctaggccctagattctaggggtattggggtgatgctggtgaatggagtctaactgcgtatttgcttcttgcttccagcaccaattgtggccaatggagtgaggcaaagagcactggtgtggctaaattactccttctgcagtccccagcatattattggatgctctttttccctctcccagagctttccttatcttctaatttcaaagataagcgttacctgtaggcaacgcacccgacctctatccctgttgtggtagctacacataaacatagccatcatggccaggtcccttgggtggtcacatttcctactgttctgatcaccttccactatcaacactgaccagtgtgcctggctaattccaaaccgtgcgaatggctgtgttgcctgggctcatgaagcctgtcaggaagagctgtggacagatgatttttgaaaatgagggtgattgcaaagggacagaaagtatgagacatcgtggatgctgtcttttccttaggccttcagtcatttgaagtcaggacttccaagcctggatatccagtgggcttctggggaaagtggatcagagctcagcaaggattgagccccagcgacttccaacaaaccatcccatccaacagaggctgtcttcactatgcagacctttgagccacctcagaagacaccagccttcatgctcatcctttacacgtctctttggttcatgtaccagtcccttgtcctcctcggtgaccaagataggaatggtgtcaacggatgattatggcatgacatagagtaactctttgcataaaagagtggacagggcaggcacttaacacttgaggacccctgttccagtcagccacagatgtatttattaggccttaaactgatgggatggttcttggatttttcagtttaaaacctatagggggactttacttttggccaaatgctgaaacaagtattggatttatcttcccatgtgaaaaacaaaatatggacaaaataaatgaaacaatgatttgtaagacactggatacatcagacaacaaaggccaatgattcctgagagataggaaacaaatgaggtgagacctctgagttttttcaaactgccttaaaagagtttccaagctatagcacaggaaaagggaaccatgtggagcccagcagactccctgagttgaggattggatctgagagtccagagagactaaggccactagagatcatgggatacagtactagagaagagacagctgcaccaagacataactctggaggtgtacaaagttctgagaactgatcagtgtaaagaagctgcctgagtctggggaaagcaccattcaaaaggagcaaagataactgtttctggtgctcacacggggccagaaatagtgcttctgccaccaaccagactggaaaacttcaagagtcatggagcattgggtagagtagagtacatagaagggccttgcttgcttagtggggaataactaacccaactgagcatggctttaaatctaaaaagcaagatctgatagggccgaactatttctgagtaacttagctgtgtcccagatcaaagctgattttatagaaatacaaaactatcactcaataggcaaaaaccagtgtctggcatccaaccaaaaattaccagatgtacaaagaagcaagaaagtacaacccataatgggagcaaatcaaccaatcaaaactgacccagaattaacgcagatgttacaattagcagataaggacattaaaatggttattataactatattccatatgttaagcagaaacatacttgtctttaaaaagacaagtagaaaagtgaaaatggagaaaataaacaaaaagaccccaattggatttgaaacatgggttgcttttctatgactccatccttatgttacttcaaccgaacccatatgacctgaacctggcccctgctaatttatctgaaccataagctcctacttatcttctcagtgctctctctagccaggactgtggggtcatccctgcagtgctaactcagtgatgcccaggggtcacttgaccctttaatcttccttcatgcctgctgtgccaatgcctgacctgagcaatcatctcacagatgattggatgttgctggctggacccatggcatataaatttttggcattaagcagatacttagcaaaaacggaagcattcttcttgtgttggtttctcagcaattctaaaacttttacacctgaaagccccttcccactttttttcccactcatattctctttctcttactctgctgaaaaaatcctgcaagatctgccatctttatgtgcctgctgtccctcagtgtggccatctcttttcttcctttctgctggctgccagggaacctctcttcctacagaagctacaccttttcctgggtggatccatcctctctggcctcttaacacattctcacatgttcatttacctggactgaccacactttgtttagtcccttgctctcctttggctgcttctcctgtggtgatttaaacagaaaaaaaaaattcttcacctgatcatagtatcctcagctaccatcctatttctttcccccctttgcagccaactatcttgacaaacgttttgtatctgcgtctcaccaccaactttctactcagctcctgcttcgctcttgcccagacactttctaattacaaagtgtacctctcctttctctgcaatctttcgtgtgaccgtgatgctgcatttggttctgtttcatgttctccctttgggcacctcaaacgactgcaaacccttggcctctattctgagtggtggtccccagcaccccagctccttttctcccattcccttcagtgatgacaaccttcatcatttctttttaagcgccccccccccgccccgcccatgtaccctgtgcctatattctaagcaagtggcttagatcctacttaatctggaaaattgcatcaggtgtgagtgacttccctcaactacactgactttatctgcattcccacccatcctgagtccttagcctctgttccagaggatagttgtcattgcttttgctaaagacctgtgcttcctcacgaactttgcttccctttctttaacttctccatttccttctctcattttctttctctgatctgtaaacatggccaggcctcctcctcctaaaaatctccttgggtactttctaatttgtctcctttttttcatccggatatgttgagagtacagcctacatactaattcttcacttcattgccttctattttctcttccagccgctacttaagctctctggcttccctcaccactattctgctcaagtagcgcttgataaggtcactgagggcatctatattgccaaatccagtaagcagtttccaggccccatcttattggacatctctgttgtgtttggcagtgctcatcactcttccacctcagagcccacactttttgacttctgcaactctgaagtctggatcatcccattcttcccttctcttcctttctcgtatctttgggcttctctaccaccctctgcagtttgtatccttgggggatccatcttcagcccgccgctgtccccattcacatctctggtcatctgtttcagtctgggatttcactctgcctgttgctctccactcctccgtctatatctgcagcccaggtctctcccctgagttccagcttcctgtgtccagtcgtgtgctgggcactctcaatgggcttcatttaatcttttttttttttttttgaaatggagtctcactctgtcacccaggctggagtgtagtggtgtgaccttggctcactacatcctccgcctcccaggttcaagctactcttctgtctcagcctccctggtagctgggattacaggtgcccaccctcatgcccagctaatttttgtatttttgatagagtcgaggtttcaccagattggtcaggctggtcttaaactcctgaccccaagtgatctgcctgcctcagtctcccaaagtgctaggattacaggcatgagccactgtgcccggcatgggcttcatttattcttttttttttttttttgagatggagtctcactctgttgcccaggctgcactggctaagttttttgtatatttagtagagacggggtttcatcatgctggctgggctggtcttgaactcctaacctcgtgatccgcctgcctcagcctcccaaagtgctgggattacaggcatgagccactgtgcctggcccatttaatctttcagttagcaaacatgcatcttctgtccccacactcttgaatatgaaatgttgaatataatgaataaaagcattccccctctgccaagcaccatactatcctgattctgtttctatccctttgtccttcctctgtttccttcctgggctcttgtgttcttcactatcttagaagtgggcgcccattctcatagggcctttcatctgcagggacactctcagtggttaccttcaggccccatttttcctgtgagccctggttctgtgctgtctttcaaactcctctggctcagaccccagttgtcattttcctcccatatcagcactgtcttcactccatttctgtcattgccttcttctgaacactgaagcttgaacacacacattttccccacctacacattttgtctttcctactaacttaaaagcaatttgaagtgtgtgttctattgtgtacctgtgcacctctccctccccaacatggtgatatgtgagggtataaagtgaggcaaagaaaaggcaaaaagatgaagttcctgtcatttcccattttaacaagagttgcagagggtccccctaccccccatctcccacagcaactttgacattaagtgatcacttcaggggtggtatttgtggaagaggtttcacccacacttccatttccttaggagagctgaggaagggggttagccattgaaggatgaagatatgtaatcaatttaatgaggactgtcatttggggattttacaggaatttttgacagcatttactttaggctacactatgtggaatcttcctttccctttgggtagtggatcccttaatgccatatttgtctggttccatatctttcctgtcaccttcagttttttaaaaaaattgtgataaaatgcacataaaaatctaccttctgaaccatttgtaagtgtatagtccagtggtattaggtacactcacattattgtaaaaccatcaccaccatccatctccagaattcttttcatattgcaaaactgaaattctatacccattgaatactaattctccattccctctccctccagcccttagcaaacaccattctgctttctgtctctatagatttgactactctaagtacctcctataagtggaatcatacagtctttatccttttgtgattggcttgttttgctttgcataatgtcttcagggttcacccgtgtggtagcatgtgtcaagattcccctcccttgcctcttttttcttttcttttcttttctttttttttttttttttttttgagacggggtgtcactgtcaccctggttggtgcagtggcatgatcttggctcactgcaacctctgccccgcccccgggctcaagccatcctcccacccagcttcctgagtagctgggactacaggtgtgcaccaccaagcccagctaatttttgtattttttgtagagacaggattttgctatttgcccaggctagtcttgaactcctgggctcaagtgatccactggcctctgcctcccaaagtgctggcattacaggtgtaagccaccatgcccagtcaatttcctccctttttaaggctgaataatatcccattgttagtatagatcacatgttgtttgtttattcttccatcagtgggtgcttgggttattcactttcagttttaaaacaatctcttgttagtatttaatattggattttgtttatgttgaaaactttggtctcaaactcagttgagatctccttggcatatatctcccagcttggctcagctgctgggcgtgaagaagatgatgaggccttgtcctgagatacaacaccccctaacctcttcccagctctccctcctctctctttcctctccccacccctgcttctctctcctgtccctttccccctcccccaagagtgatagtaagtaaactcacattgtggcaacacccgttggagtctcctgcccttagctttctgttggggagagaatagtctgccacctgaaacactgcatgccctctaaggccaacacccctttcctttctcagactcattctgactttgaggaagtagtccagagtagtggaagggcttagcggtcctgtctccaggaagcccttatgggaggaggctctcagaacttaaattgtggggtactttgtgcctttgtcctcaggtgaaattctgggacaacaggaaaattgccacccaacattgttttaacacttaaaaattagaggggacctagactgatatgatatttataagggctgtacataggagccctgaaattctgtcttctctctccatccctttttcagtatccttcatacttgaagaggaggggttggggtccagtatagaatgggattttaaagtccctttattaatcattatttccagaggcgagactgctccttaaggatagacgtctttgaaagggcttccttcctgttgtctggacccaattgctttaccacatagaaccgtcattactttccctctttttggcggtcttttttgagctctcattgttggtctaactgaaagcacctgatttctagggctttaactgaaagcacctgatttctagggctgtcagtgcagcacagcagagactgctcttcaaatggtctggcttagtggtttctaacccttttgattaagaagaccactgctaaatttcccagagcctcacctaagtgttgtactttgtgtctcttttgactaatcatatacttaatgacaaaaatttggtaaattagtgaagcctttaattgggcatatttttaatttatgaaagtatatcggcacttgtgcatatgttaggcttatttttcattcggagacagtgcttggtgcattgtagatttatggttccttataaggagtcctccttctgtctttgaagtcttagacacacagcttgggaatggtcctaatagactgtttcctttaaaaaaagaaagaaagaggagcctgtagtgtgattgaatctctatctgacaaggcttaacagtctaaatgaaaacatctaggttgaaagtgtgtttgtgtttgcagtacatttgtgtatgagggtttttgtggatgttttcaaggactgatgaggaagccacacatgggttatttctctactgaaagggtagaggccaggtcatctgacctactgattaaacttgaaaagggagagtgtgtcttttgccatctcaaaggccagctgtttattgaatttctccaccctgcaattgtcttacatacggaatagttcctggagaaagatctaacatctgcgcaggtctatcctgttctgtggctgtgtttactaaagtgagttctgcgcttacattcacacactgcaaactgcacgtacgatgtaagtgtacttgtcatgtagagttttaccaaaactatattagattatactctgaagcatgttttgcatctgacaggtcgagctcattcattcagtattaagtccctcatgggccaggctctagcctgtgtcctggtgataaggaggtgaatgtgacagaattcctattttcaataaactcactgtctggagaggaaggtgatcatcaaaataaattttagcacgatgtgtaatgattaatgcacagaggatctttggaatctccaggaagaaggcctgacaacctctggatgaaggatgggatggaagataaagtggacttagagagatgtatcgtgtggctctgtctttatccctggaaaggttagcctaagcatggggtaggtgctggtttcttttgctgagaaatgtctcagagaacctcagagtagcaggaggcctttgtgatagattggccagcagtttttatttccctgacctttcagcatcaaaaagtgccagttggaccctgggttttgccttggaattagtaaatagatagttcaacagcaatggttgaaaagcctcttggagtctgtcccatgagagtaaggatgttaattctgaagcctgggccattttccatcctgggaattatactctgccccttcctaaattcccattgtggtttcaaatgaagaggccattgttcactttccttcctaaaagaagcaatatatttaacttctggctctttgcctgactgatggcgagttgatctctctgaagccaacacccgtggcttcctatcaagagaaacactctgcctccatctgatttccttcttgggttgaagttatttagatcctacactggctcagtaggaggcttgcctgccgttatgtcctactaggtggtgacagggcccttgattccctccctgtgtttaatagaaataaagacagagtcttagcgctttagggcagctagttgttctcccaaagacctattataggaatttaaaagcaaatgtctgatgtgaaaatctatgctattttagggactttgaagcacaacacaaaagagtatcactttgttgaatagtttgggtccaggcaggtgtcctagagcagaagttttcatttatttttaagcaacaaaattctttctttcccaaatgaaatctcctacagaatccaaatactgaagggtttctcaaccccagcatgcttggtattttgggccagataattcttgttgtagaagctgttgtgtgtgttggaagatgcttagcagcattcctggcttctaccctccagatgacataagtggcacccacattctctagttgtgacaacaaaaatgtctccagacattgcaaaatgtccactggggagcaagatcacctccagttgagaatcaatgcaatataatctagaaaacagacttttaattaagctcctcctttagaactctgcccagggtccctgactgttagtgtttgagacctggtggggcgttctgggctacacagatgcactatcctagagggttaagttgtcattttaaaaacctgggacatagagaacttgttataaacaaagcaaaagagctaaaattagacaaatccacaagtactttgaacccacatgtacactaaatatttctgtctatgtattatgtatacattgtgtacttggatgtgtagcataagggaagagtcgaagggtggtgtctgccttactccttatgtgttgaggtttggctaccacaatttgccctgttttgccagagatgccagttgaaggcctgtgactgacagcccagtgatagagtcaccctcactgcacaaaatactcagcttctgtgggattcagtggccctggccctgctcatgggcattccgtggtgagtgggccagcacctgcagcctctttcaaccagactggttggttggagcttggaccatggttattccaaggtggatttttatccttctgccctttgtactaaatgggtcatgtgtgcctctgtacgtgtgtgtgtgcgtgtatgtgtgtgactacacgtgtctgtgtctgctcttctcctttcagaagcccagagccactctgggcctggccactctgagcattggttgtgtgggggatgctgggagcttggcacatgctactcctcctttttcctcccttagaatgatgaaagtgttgttggagcctgtcccacagacagaaactgtacctcatttatgtgggcatcagtataaacaagaacaataccactatgtgagtcaccctcacctgcggggagacgcataggctcagggagggaatttgctgccagagggtctcagcttcagtctgtctccccggcagactcatcctaacttcattccacagctcaagtgcagtgtgaatcagcaggcagcctgtgcctagctaaaggactctctctgtgttttgtttgtttggttgcttgtgaagatctctgggcacatacagcagtgttttattttcccaaaagatcgcatgaccactacagttagccttgggaacagattgagtaagcacaattcatttgatctatctgcagatctccagcccttctaagaaactcacttccaaaaatgtttcaggagtcctgtagaagtttgcttagagttccttaaagaggctaagcgtcagttgcaatatctctctatcaaccccatttcccccagtgccactgccatgggctggaggagtgggtaacttgcttaggaacttgggtaagggacctgaagctccccacccactctggccctagataggctaaagatttgaaattagtttgatttatgtaaatctctggtgtgaattattgctatcagataaatacacagaccattgaactgaaaacagagcctcaacacaggttgccattgctaatgttagtttatagtagccattatctagtagtgcctttatcagtgaccccaggtgtataattggtttgttgtgaaagaggagtggagttcccaggatgctttttgtcccccatggttcccttataagtgactgtatttcctgagctctctgcacttttgtcaccttttgtcatcaatatatacaatcagtttcaggcaatattgatagggatgtgaaaactaaacactataagattgaatggacttaatagctaggagttgcagaaaatattcctacatgtatacataacttttataatgtacaaattgttcttatgtgcatactcttgcataatcatcacaagtcagccttgtgacttaggctctctcttggccttatcttgagagaatttatgaaatctgataatattgcagccccgtaggaaaacttttcagtgccttgctatgatctctgaaggcctatactcctccttcccttcctaggctggtattgacctgctttttaaatctcatctcctaccagaccttcatattcattgtagttctagcagtagtgtactacttgtaggtacctgaatgtggcaagctcttttctacttcttactaatttatggaaacaccaatctacccattcattctttcactgctacttgtatgctaggcattggtgatatcccctaaccccctggtccttggtctaagcaggcataggtggtgctgtgtggtaagagctttggtcttggtgctaggggagctgtaaggagggcaccaagccttgacttgaagggattagggaggcttctccagtaaggcatctccaaagtaagtcattttagtgtgaggtggatgggagagttaggagaggagaggaagaaagagattagggcaggtgtggaccccaggctagacagggatggatgagtgataaggtcttgatagtgggtagtgccagatgcaggtgtatagttttgaggactttgccctaaggcctgaaggcagccattcaatgtttttgttttttgtttttttgagacagggtcttactctgtcacccaggctggagtacagtggcgcaacaatggatcactgcaacctcgaactcctgggctcaagtgatcttcccacctcagcctcatgagtagctggggctataggcatgtactaccatgcccagctaaatattttgtttttctgtagagacagggtctctctatgttgcccaggctggcctcaaactcctggcctcaagcgatcctcccctcctgccatggccttacaaagtgctgggattataggcgtgagccacagtgcctggccaattaaatgctttttaagtaggagcatagcagggtgcagattgctgcaaagcacctttctagaatatatcctgttcccctcattctccctctagtactttctagtatataccccgttcccctcatcctccctctagtactctgctgcttaggctttaggttcaattcaggcatcactgtctctgtatgtgctccagattccccgggcaccatcgggggtccctctgccccacagcaccctggacatgcatactggagataaagcagcaattgcttttgtattttaaccgtctagttgtgtgtccttcctcctagaccactggttttcaggatttaaaagtgtagattcttgttgcccaccccagatattcttacttactgtgggatagagtctaggcatccccattttttttaaaagaagcagaaacattgcagtaggctaatcttattgagggcctggtttatacattatgtgtgtgcacacacgtatgcacacacccccacatacttgatctcattcatgcttatatctgtatttcttttatttttattttctttgatcctgtcattcaaatatccatatttcttaagaatgtccggtataaatttgctatgctacaaatgtttgattgaatgaatgaatgaagttgcccaaatttacgtgtgaagatgtgttggagcctaagttaaaattcataggtgattccgaggcaaggccctttcacagcatcactcttacaccacagttgctacactgagatggcctttgaaaagcaggcagtcccactgaaccacagtatcctagagactaagaaacggggacaagagatctttaacttgcattttataattttcagtggcacatcaataatctgcagggatacactaataagatgggtattggacactcattacgacagaccctggaggatccaaaactgtaaaatctagctctgatctcctacaaatttttggtctacttgagggtaaaaggcagaaatacacagacagttgaatgactgtgccagatcgtgacagttacctggagtaccgtgcacagaagggcaatagaatgatgcagtgactgagtaagaaagagcatgccattagctggagtggtctgcagatacctttggatgaggaagcacttttatgaggtttggctttagaaaagtgagaagccattccaagtgggaggagtgacatgagtggaatcctggcaggagatgggctatgaatggtgagggcatcagtttgacaggaacataggtttgtttgtgtaggggagtgatggttgacacctaaagggagtgctggttcaggattgggagggccttaaatgataggtggggctataatacagttggggatgtgtggcacattcagcaatgtaaaagtctgttgtcctcgaccccagatccattcaccttattaatgaaggtcatgaatttttaaatataataactgatatggataggttttgtgtcctcacccaaatctcatcttgaatcataatccccaggtgttgagggagagacctggtgggaggtgattggatcatgggagcagtttgctctttgctgttcttgtgatagtgagggaattctcacgagaactgatggttttataaggggctcttcccccttcacttctcccacatactctctttctcacctgctgtcatgtaagacatatctgcttccccttatgccatgattataagtttcctgaggcctccctagccatgtggaactatgagtcaattaaacctcttttctttataaattacccagtttcagtatgtctttatagcagtgtgagaatggactaatatagtaaattggtactgatagagtggggtactgctataaagatacccaaaaatatggaagcaactttggagctggataacaggcagaggttggaacagtttggagggctcagaagaatataggaagatgtggaaaagtttggaacttcctagagacttattgaatggctttgaccaaaatgctgatagcgacatggacaatggagtccagggagaagtagcttcagatggagatgaggaacttcttgggaattggagtaaaggtgactcttgctatgctttagcaaagagactgacagcattttgcccacaccctagagatctgtggaactttgaacttgagagagatgatctgaaattggaacttatttaaaagggaagcagagtatagaagtttggaaaatttgcagtctgacaatgcagtagaaaagaaaaacccattttctggggagaaattaaagctggctgcagaaatttgcgtaagtaacaaggagccaaatgttaatcaccaagacaatggggaaaatgttcctagggcatgtgaaggacttttgcagcagcccctcccattacaggccccgaggcctagaagggaaaagtggtttcatggactgggcccaggaccctgctgctctgtgcagcctaggacttagtaccctgcttcccagccactccagtcatggctaaaatgggcaaatttttaaaaagtcagctcaggctgtttgcttcagagggtgcaagccccaatccttggtggcttccatgtggtgttgggcctgcaggtatacaaaagtcaagaattgaggtttgggagcctcagctgagatttcagaggatgtatggaaatacctggatgtccagtcagaagtctgctgcaggggcaaagccctcatagagaacctctgctagggcagtgcaaagggaaagtgaggggttggagcccccacacagagaccccaccgtggcactgcttagttcagctgtgagaaaagggccaccatcctccagaccccagcagatggtaaatccatctgcttgcactgggcacctgaaaaagccacaagcactcaacaccagcctatgaaagcagccaggagggggatataccctgcagagccacagtggtagagctgcccaaggctatgggagcccaccccttgtatccacatgacctagatgtgagacatggagtcaaaggagatcattttggagctttaagatttaataactgccccactggatttttgacttgcatcaacctgtagcccctttgttttggccaatttatcccatttggaatgggtgttcttatccagtgcctgtaccaccattgtatcttggaaggaactaacttgattttgattttacaggcttataggcagaagggacttgccttgtctcagatgagactttggactgtggacttttgagttaatgctgaaatgagttaagactttggtgaactgttgggaagccatgattggttttgaaatgtgaaaagatatgagatttgggaagggccagggctggaatgatgtggttaggctttgtgtccccacctaaacctcatcttgaattctaatccccaagtattgactagagacctggtgggaggtgattagatcatggggggtggtttcgtccatgctgttcttgtgatattgagtgagttctcatgagatctgttggttttataaggggctcttctcccttcacttctcccacacactctctgtctcacctgctgccatgtaagacatgcctgcttccccttctgccatgattgtaagtttcttgaggcctttccagccatgtgtaactgtgagtcaattaaacttcttttctttataaattacccagtctcaggtatgtctttacagcagtgtgagaacagactaatacaataaccatgttctcttctttctggagatctccagccacatttgacttccaggtctgtgggaagcagtccaaggtgcaacctggaacactttcatttggcttcttcatgtagaggaacatttacatgtcgctgcttgttccttctacccatggcctacacacactgccaagctgtcaccttccctgttgtgcaatgtgtttgccatcaccttcaatgaaaacaatttttttaatgtcagaattttcttagttattaatcccaaacacagacaccagaaacatgatccagaataaagttttcagttcacactgagcttgtcattgctgaagtaagactcttagctctttcacaagtatggacaaaattcagtaggaatgttttcatcacaagtcttacttcttaataatgctttgatctagggtaatttctctttagtcttggatggtaattttgcctgaggaaagtccaagaggtcttatgtgaagatttctgttttgtttagagtttgccacaaatactggaaggagaaagttttctgtaatttatacagctttacattagaaggctatagcttattttaaaatggtttctgttcaaaaaattttcacctacaattatagtataaagtgccttgtccttgtattcacagaggaattttctcatacaactacaagaaaatgtggaaagtttcgtctgagaaaattcaactttttcatctctcataatttactgcttcaggaatgcaatttaccaaagtggattagaaactgtttgtaatggggaaatacgtgcactctttgaaggcagttgtcgacaaagagtcaaactctaaaatatttgaagaggtttattctgagccaaatatgagtgaccacagcccaaggcacagtctcaagagatcctgagaacatgtgcccagggtggttgggttacagcttgattttatacatttcagagggacataagacatcaatcagtacatgtgaggtatacattggtttggtctggaaaggcaggacaacttgaagcaaggggtggggagttgtatgggggagggtgcttataggttacaggtggattcaaagatctgcttattggcagttagttgaaaggataaattagttattatctaaggacttagaatcaatagaaaggagtgtctgggttaagctaaggggttgtggaggctgagattcttattatgtagatgaagtctcataggtgtcagcccttagagacaatagatggcaaatgtttcctatatagacctaggaaaagtgctagactcaacagttaatctctttaggattgggaggacctggaagaggaaagatctagttatgttaaagagattctttacggatgcaaattttcctccacaaaaagatgctttgcagggtcatttcaaaatatggcagagaaacatattttgggataaaatattttgattttcttctttggttgttttgtttgtttgtttttgagacagggtctcactctgtctcccaggctggagtgcagtggcgtgacaatggctcattgcagcttcaaccttctgggcttaagtaatccttctgcctcagctgcccaagtagctgggactacaggcatgcaccaccatgcccagctaatttttgtatttttgtagagacagggtttcatcatgttacccaggccggtctcaaactcctgggctcaagtgatccacctgcctcagcctcctggagtgctgcaattacaggcatgagccacttcacccagctgttacctttatctatcatgtgatgctagctgagtgtggtggctcacacctataatcctagcactttgggagactgaggcaagtggatcgtttaagaccaggaatttgagaccaacctgggcaacatggtgaaacctcatctccacaaatatatatatatagatagatagatagatagatagatagatagatacacacacacacacacacacatatatatatacacacatatatatatatatatatatgtatctcacacgatgctataccagagtcaggttgagttggtatttttgtagagacagggtttcaccatgttacccagactggtctcaaactcctgggatcaagcagtctacctgcctcaccctccgaaagtgctgggattataggtgctctgcactctagcctttgtaacaataagggtctattctgtcggttttaggtctctattttagtgttaatgctggtcagttgagtctaaactccaaaagggagaggatataatgaggcatgtctgactccctctttgcgtcatggctttcactagtttttcaggggttttttttaatccccttggttgagaaggggtccattcagtcagtagggggagcttaaaattttatttttggtttacaaagtgaagagctttcctcttttaagtcctcaccatataaccagtctctaccagatgctgagaatagcttaaactttcttactgtcttatttgagcctggggtggtttgttgtaggaccttatcaacatagattttttgataattgatctactttacttcgatgtctgagtaaagctttaacctggcccttaaacaccaaaaatgctttagtgggagctcttgttttgggaaaatgaaaaatttctgtgtctatcaatcacggaaagtattccccactggtttgattctgaaattcaatcattgcctatgaaagttaaaaacatttttttttccctgtagctagcttttactctgtctctttaaaatacctttttttggaggagaggtggagcaagatatgtgtaactatagttttttctttttttgcttagatggtttaaagaattctgcatgtcatagttgacattccatcattatcctgtgttccacagtcaaggccaaaggttaaaaataagttcttaaaggaaacaaaattaaagcaagagggaattacctctgaattgttttagggactcctagcattttgcatgagtttctgttggtctggagaatagaaggaagcatgaaaggtttcattccttgcaaatcaagtgaaactggctcctaccctcttcttcaatacaaacatgaaacagaaaaagtagactggaagaccagaaagggcacagatttttataccattttcatcaggattactatgttcatgttatggaaccaatttgtaagttttgggtaacagcttaaatagaaacctatagaactgaggcaaccttctgtttctcaaagacagatggtgaagcaacatttataaatgctttacagttagagagcatatgctctcgtccactgttttttgtctttgtgatcaaagaaggatttgaggaatttcttttaaaaatcagtctgtacaataactgagtacattactttcagataatggagaatagtcacacccattgttttcagggcctcagggaatcctagaatgtgtgtcttgtggactgtgtcatagttggctagttacagtggcagttactaaaatcaaatctgtttcaattaataaagaacttgacaatgaaactaacaagacccattctaaagacgccaggaaaataaaataaaaacccatatgtactaggaattgtaaatagagaggaagcagaaacaatgtaatttgaattatcttattaaaattttaaaatattaaaatttaactagtttctcttattcagctagagacggtataaaaacttggcagaagtgtgatttttgtctatctgctggccagaataatactatatagatgggattttgtaggttttagtctctctaccccgctgtcttccaatatgtatgcagaaaaagtaaacatgatccctaacctttctgaaaccttctttaccttcagtctacacatacatagtcttgggcaaagagttatcaggtaaattccatggaatcaagagtagaggcatatgttgcttttcttaataggaaaaacagtgactgtgtccccctaaataaagtcatgattcaatgaaaagacaaacagcccaattttaaaaaaatgagcaaaagatttgaacagacattttctcaaaagaaatatgaatgggcaatacacacatagaaacatgctcagcaattttaggctttagggatatgcaaattaagaccacaatgagataccactagaaaggctaaaatgaaaaagaccaacaacactaaatgttggtgagactgtggagcactagaacttttcatatttttagtgggagttcaaaatggtacaaccgctttgaaaaatggtctggcagtttcttacagaactaaacagaccactaccttgttacccagcagttcttaggtatttacccaagacaaatgaagcatatctctgtcaatagaaaagcagatgccagccatggtatgattttgaacagccagtggaataaaagaatagggactatatctgaccttgctgttagagtagttaggcagatatgagcggggcaggagaggcccccctcccccacaggaatgtcaggcaaccatcaggtgatggtcaggtggttgttaaactgtctcactaacatactagttggtcacagcttgcaccagggaaagcagactcccagtagatagaaaacaccttaagctcttaatcagcagcttcctttttttttttttgagatggagtcttgctctgttgcccaggctagaatgcggtgtcgtgatctcagctcactgcaatcgctgcctcccgggttcaagcgattctcctgcctcagcctcccgagtagctgggactacaggcacgtgccaccacgcctggctaattttttatatttttagtagagatggggtttcgccatgttggccaggatggtctggatctcctgacctcgcgatccgcccgcctcggcctcccaaaatgctgggattacaggcgtgagccgcggcacccggccaatcagtagcttcctcataggatctcaggcgttggatgagtgggctcaaacttgcatgctaagagacaaaatggtggagtttagctggtgtatgaccttcctctaggaacactcaattggtaagggaaaaatgcctcaaatgaacatgtgcacagcttcagtaaacacactgtacatgcggcccttcccaagtgctggcaggccactgcacatgcggacagcccaccccaaggaaaaaccaagggaggagagacacaaacctcagcaccatgccattgtgtaaaaatcccaagtcaagcgtcggacagggtcctcggatctctcaaattgcccacttggccctcttccacgtgtactttgcttcctttcattcctgttctcaaactttttaatatactttaactcctgctctaaaacttgccttggtctcattctaccttatcctctctggccaaattctttcctccaaggaagcaagaatcgagttgctgcagacccatatggattcgctgctgctaatgttgccatttggatttttttttctttttagagtgttctagaatgcatgcttagagaagggaatgtaatcctaggacaccactcagctctgcaacagtatagctctgcagtaatgagtaaatgctgtttgttggtttactttaaagctctgctactgaatatatacaaatatactgttatattttcctggtaaaaccttttattatacaatcacttctttttatttctagcaattctttcttttacagtgtattttatctgacgttaatgtggctgcattgcatgtcttttggctagtatttgccctgctttgcatcttctttaattcatttactttctactttttctacctatgtcttaggtttgtgctttataaacaacaggtggttagatttcctatttctagaagtttattgagattctccctctaccactgtctctaccaattccattttttcccacctctattggtttggaagatagaatctctctctctttttttttttttttaagtgattatacttggaattttaacatgtctgtgtaactaagtctaaagttagctaccactttaccctcctactgagcaatctaaggatgttagaatgtttttaactccagtcactttcctcctggcttatgtgcatttccttgatatttttgatatctttttatttttcttttgaagctccattaactagatgttattagttattccatccttctttgtttctatttacttacatgtttataattttttaacataccactttcttgtatagctcaaaccttccctcgaacatttccctccttcttcaagtagattctcttcaagtacattctttatttagcgaaggtatttggtagtgaacaatctcagttttctgaaatatctttattttgccctcattctggaaagctagtttcttactttatttttttaatagacagagggtcttgctttgttgcccaggctggtcttaaacttctggcttcaagcagtcctcctgccttggcctctcaaagtgctgggattacaggcacgagccactgcgcccagcagtaacgctagtttcactgggatcatggactcttaagagctagaaggaacttcactgattatttgactcagccttttccatttccagaaaagcctgccaccaggcacagaaagaatacatgacttccagagtccctcgctatattgtccagactggttttgtactcctggcctcaagtgatcctcccacttcagcctcccaaagtcctgagataataggcgtgagccaccgtgatcccctttacctttttctttttttttttcctttatttcttcttaataaaaaaaaagtgggggggatacatgtgcagagcgtacaggtttgttacataagtatacgtgtaccatggtggtttgctgcacctattgacctgtcctctaagttccctcccctcaccccccaacctcttcaaaaaaaaaaaaaaaaaactatcaaaaaatggtggccgaggttcaaagctctcaccttggttttgtgataaaggtggttaatctttggtgttggatttcaaattagtctgtttacagtgagcaacagtacagcagttttaaaaatcatgttgaatcagaaacatgaagaaggcagcagagctttctctccaccatgcacttggagaaggaaatgactcggcagcatactcctcatggctaatatcctttaagatttttccaaaatcatgaaaccagaacttgagagcttaaaagggactttagaagtctaccagtggataagagagaaaaaaaaatcaaaagggaaatggaataagccaaactaaagggcaggattcttttagttctcagcaggaaacatatgtttatctggaaaagattttggttggacaggttgtttgtgtaagaatcttttttgtgaggaaggaagatcaacctgggcttgaaggctggggtgggggtagagagaacagtccctgagcttcaagtaaatgagaaaaatacacagattttaaacagaggagccctgctttcacggggatcatatgatcgtgctatcagcttacttttaagttgtgataatgtatacatactttatgaaatatgattaaatggtaactttagtattagtggctacaagaacagaaacagcaacttttaaaaagatatgaaaagatgttttgggtgaaagtagttggctgcgcaacacatagagtataacatacatcattaatttaagactgtagatgtacagtatatatttggcatgtacaccaggattttcagtgattattgatgtaataagatttatgatttttaaaaagaaactcttcatgatagttttctgtaccacttacattttccatagtgatcatcatattgtctttataaacaatgacaacaataaatcaaaaagagagatcttacatggtgcctcttctctgacagctgagaccacatcatagctacgttgttcccttacattgcatttacattacatttaaaatgttatcaggaggacagaggctcatgaatgagacatgttctctccagttaaatttagtaaagaagaatcagagaaaaatctccagataactggaaaatgtttacattttcaagtatataaaaccaggatacattatcttgtttaagcttggagttgacaataataccattttgagatgtttttcagatagaatgacagtgagagtcatagtggggttgcacctccacatgatgcaacccaaatgtgatggaacagaaacatttttcttcatcatcctgaaaccgagcagtgatgatccgctgaggaatgtttaattttcatgtattaaaaaatgaagaatgtctgacctactgttaatgagaaaaaaaaacaccaaaaaggaagaaagaagaagtggcagctaaaagcctttttatggatgacgtcaatagaggaaaatgaaatattcatagaatcacagcaagagaataggaattctgaacatttttgtagaaggaaactgtaggattcttgcaattgatagtaggacaggagggaatttccatccttatgtgtgcagaaaggagtagacacagtgaaatttgaagactattgtaaacattttctacttcacttcaccttgaagaagtctacagaaagcatatatggcatagctgggcagagtggctcatgcctgtaatctagcactttgcgagaccaaagagagaggatcacctgagcccaggagtttgagaccagccagggcaacacagtgagaccccaactctactttttaaaagattttttaaaagcatatatggcagttaaatttcagtgagaaatcaggaccagggtaaatgtaaatacattactatagcagataaataaatatggatgccccacccatatttcctttcatcccacaacagaaagctggaaatgctgaaaaattaatacctcccacccctgaagcagccatcagccagtgaggaatgggagccagaggataaataacccaacttcctcacccgctgagggtgttcaaccaggtccttgaaattcccgacaggaatcgagcctcagttgcccaccctggaaacctgctcagtaatacgcttatcgttggtttccttccctttcctgtctcacttctgtaatcccctggtgcatctgggggttccttcccgaataaactacttgcaacttaagtccctatcttgaactctgctcctgggggaatccaaacaagaacaggtggagacagagtagaacaaggataagcaaagcaagagaggagatctgaagacgtctctaaggttgtttgagtgactccaaggatagtggtacaattagctaggagaaagagagggtggaggaggccgagaagagggttcagcccaacaaatgccaagttttaggtagcttggggataccttgaagagatgctgacaagctacttagaaataagtttattagctagaagccggagctggccaggcacagtggtatgcacctgtagtcccagctactctggaggctcaggtgggaggatggcttgagtccagaagctgtttgaggtcagcctgggcaatgtaatgagacctcatctcaatatcaacaaaccttatctcaatataaatgaatgaatgaatgaatgaatgaatgaatgaatgaaaccagagctatagctgtatatttgggaatcctcagtgtacaggcagttgatgaatgaacatccagaaagactagaagcatggtatgcagggaaccttggagcatacacatatttaaaaattgggtggaggagaaaagccagtgaaggagactaagaaagacgattatagagagaagaaccagagctgttattggagccaaggcctctttcttcaaggactgagaaggggagagtttgtactttggagtttgcacagatcacagacatgaaaaaggaaagatgatgatgagtggaaaatgggaggtcaggactctcctcccatcctgatgtggcaagaggcttttctcatggttctggatggaactttggccctgttgcagatgctcacatgcaacgttctgttctaatcactgttctgctggcagaggaggctggagtgatgagtgagcatgggctcagcttgcgtggatgctatgagccgtaggtcctactcaagagagtcagtctagtaacaaattattttcctctccttcttttgccatcccatttagtttgcaggatggttggtgtttgtgtgggctgagattcctcagagggaaccaaagccctgagaaacatgtgtagcagctgttgatttgggtctccacagtgagatccgggtctaatacagtgagtccaaccactttatctgagtttggaaataactatgagtacatagttaagctgttttcaaaaaacacagaggattctgtactgctagtgccattgagggggcttttgctgccatttattttcaacttatttttttgaggtggagtctcactctgtcgcccaggttggagtataatggcgtgatctcagctcacagcaacctctgcctcccaggttcaagcaatcctcctgcctcagcctcctgagtagctgggattacaggtgcccgccaccaggcctggctaatttttgtatttttaatagagatggggtttcaccatgttggccagacggtcttgaactcctgacctcaggtcatctgcccgcctcagccttccaaagtgctgggattacaggcatgagccgccacacccggccttgctgccatttttaaataccaaaaccttttgttgcagtctttgtcacaggtgctggcacaaaattcctggtaccttctccctgctctaattcaccaagttctccttcctcttttccaaagactactaacatggaagtcttccttaattagttacaggactatatctgcaactcctgtgatttattcgctcagtgcccgtgtcactgtcacccactggtggggtgtgcttgttgtaaatacccatttaaatgtttacattttcaagtatataaaaccaggattgtaaaataccgttgtatttccagttgtaaatagccgtttagttaagttaggcatttgtttatcacgcgtcctaatctctgtttgtgtcgttactgtctcagagatcatcatcatctgtgtttacatttttatgcatcattctttatgcaagtagttcttattcagtgtttttgatgatgttaagcaaaattctgttgctaccttacctcattaccttcccgggatatattttgcagatataaaccaataatattttctggttctttcttgactagtagcttttggttaactctaaggtttttctgtttgtttttctcacagttgttttctcccacgtgtacaaatgataaaacaaattatctcaggaagaagaaaaaagacatttgatagtatatccagtagttcaacaatagtcaacggagtctggtgtcctcacttctgtcattggctgcttgacctcacttaaccttcctgttagtttctgtttcctcactagaaaatttattactttctagggataccaggagacctggtgttaataaagggcacagtgcagggtgtgtggaagattttagtgtcagttctagcacaagctagctaaatgtgtctcggggtacattaacttctctaggccccaatttcctaggtattcattcttcttctagacaatagacagttgaattaaaaaatcctttctatcgaccaggtgcaatggctcacacctgtaatcccagcagtttgggaggccgaggcaggaggatcacttgagcccgtgagtttgagaccagcctagcaacacagcaagaccctgtctcttaaaaaaaaaaatcctttctattcctagaactctagggtagtgtgaagtaagggttttcacagttacactaggtaagttactacctgtcgggtacttctctaattatgctgtgcttattaacttatcaagtcctcaaatggccctatgaggaacatatcctttatgttctatagatgaggaaactgaagcattggatgttaaacaacttgcccagggccaccgagcttataagggaagaagccgtctgcacaccccaggctccagattccacagcctcaaccaccaaactctcttgtctgtcgtcatatagaaggctgttctgttttctcagtgtagcccccttaaagataagccacagtaaaccacagtgcttttgatattaggcaaattaaacttgagttcaatcgtatgttacactgaatcaaagttatattcgctgtgcattttacgccagtaattctggaaactaaaaagtgccatgccagaaattttctctgatttaatttgcttacaatcattttaaaaatgaggagctgtgatccacgcttttgccccaggttggaatattttagaagtactttcaaatatatatttctgctgctgggatataaaaccataaattcgagcagatagaacaaaagaccaaagaggatgatgtatttactgtttttgagttaaagttacaacagtttacagaatcacagcaaccgagaataggagttctcagagacatactcctcatccacagaagcctcacatgaccaacacaagtttcagtccagtgcaactttttgcaaatgaaaacttaccctggggttgtttggtgactcctagtcacatgtgctttctaaagttctcaaaacaagcatggggtgacagtccagttttatgaaatataattttagttcagaagagatgggattttagaatagttaatcttcattatatttgacataattactctgcaccctgtggatggggtggcttttcaaaacccacttctggtgaggcagaccagggctccaggccagcacccctctggagattggaatgtgaatttccgtgctgggacacagagccagcttcctatttatttagagccattgggcacctaaggagccaaacagaagttgtgatgcaagttttggctgcagagcatgttagggttgcctgacgtgtctaactaaaacatgatctgagagatttctcaaagccctggttgatttaagcaccatagtattcaatagggtttttttttagtccttttaactcagtcctaagtaaacaggaggcggtgcaaacaatgaggaagttccctctgcattccgatggtgaagtggggttggagtctgtaggcaagtgaagagcgtgtgggagagctgtttccttttgctcatggcagcagtctagaacatggtgacagtgaaagtcattggaagccatgggggcccattttctttatgtgaccaaatgtcttgcaaagtcccaggtgtgtgtgtaggtgcatgagtgtgtatgtttgttttctaaacgaagcacacgtgcaaaataatgtaaaagggcagagtgaagtttgtccatgtccctgtatgaaagtgcatgggaagtgcctggggcagaagtgaaagagacacggccccaggtcgtgagagaagacattgaggtgcactcccggcctgctgtgggaacagtgggttagcatgtcaccggtgcactcccaggctgctgtggcaacagtgggttagcatgtcacccggctttaggatttgggggagtttgctcaggctctgaggcaggtaggttaaggctaatttaactcttaatggttggaaggaaagagggaagggccgtttaggaaggtgaaaaggcaggagtgaaggtggcaagaaatgattggcatgcagttttttcctaaatcctcctctggttataaggaatcaactggaaaattgcagtggcaatagctgttaagaaaaaaaataggattcagttgatgaaatattaaacatgcaagtgggctggtcttttaaccaatctttgtagtattaagggattaaaaagttaattcttggtaattagatccccagggagaacttaatttgcatctatacatgataagtgtttactattaataattcaagacaagttttgctttggccggtattgagctgggtctcaggctggtgataacagaggctggatagagagtgataccattagcctaattttgtcatctgcaagcaaaggaatgttaaaatctgttcacttcgtggtttctaaatgacttctagaagtatcatgagtggaagagggcagtgtagtgtagtaacttttgttcttccgcagtccttagaacctgtcaggattattggttatgacactgttcccacagggtggacaacaggggcatttttatcttcttgagacatatgggaaacttaagaaggaaagtaactaggctgtttgccaaagattacacctacctccaaacaaaaactgaggcaggtataattttaactgtgctggaatctctgaagatgttggtgtcttggccaaattcatttggactctttctgcatttcactctttgagatctattgtgtagactctaatttctttgacaggtattgtcacattggtctccacaaaaattattattgaaagccaggcatggtggctcacgcctgtaatcccagcactttgggaggctgaggcgggtggatcacaaggtcaagagatcaagaccatcctggccaacatggtgaaaccctgtctctactaaaaatacgaaaattagctgggcttggtggtgtgcacctgtagtcccagctgcttgggaggctgaggcaggagaatagcttgaacctgggaggtggaggttgcaatgagctgagaacacgccactgcactccagcctggtgacagagttaaactctatccaaaaataaaaataaaaaataaaaaattattattgaaataactacattttttttcttttttttttggagagaaagtcttgctctgttgcccagctgaagtgcagaggtgcaatcatggctcattatagcctcaacctcctgggctcaagtgatcctccctagtagctgagaccacaggtgcacacttggctttttttaaaattttttttggtagagaaggagtttcattatgttgccagactggtctccaattcctaggctcaagtgatctcccacctcagcctcccaaatttctagaattaaagatgtgagccactgcacttgccctaaataactacatttttttgaatgctgcgatgtgcctagctttgtgctaagctctttgaatgtgttacctgattcagtccttgggaaaaccctaggaagaaggggccacctgatttctagatgggaaccctgaggcttagcaagaaaaagagagccggtgtggtagggtcaggactggagcccggtttatactcctactgacaggatggggatgcctgtttcacctcacccttgttaaaaaggacactttagcaatccttttaagtatttgccagcttaagaggtaaaaatgtgatttagcttctggttcttatgcgtccgtcttgggtagcattggacatcttggcatggttattggctgtttgcacttacagttttaggaattgcctcttcacatcctctgccccatttttactggattgttcatacttttaaaaattgatttctgtgtattataaatagtaaccctttgtcatgtgttacaagtcctcttctccctcagtttctttctttcaattttctgctttgtatttttttttttttttttgccaaatagaactttaaatttcttaaattgcaaatctgtgaactttggatgcctttagagtttattatccctttaaaaaaatttttttaagagatggggcctcagtatattgtccaggtggtcttgaactcctggactcaagcagtcctcctgcctcagcctcccaaagtgttggtattacagacatgagctactgtacccggccaagttttattatccttatcttatcctaggagtataatatttttctgtgttttcttattgttctataatttcctttgtaacaggtatctgagattatctttgaaatcttctgtctcttccagggtttaaaattttttagcaaattattatttcatggtttcttaaatttcctttgtttcaatgattaaagcattattgaggaaataagctatattttattaatcacaagtctctgcatacactagaaaaattctagtataattatttggaagacataatgatgtagttttcagagtcctcagattagaagccactgttttaaaagcgtgaggttagaaaaggaattttgcacctattccaggttaatttctacctattccaggttaacagaggtgatcctgtaccaatgggttttggacagagctctcatagtctgtgctgtgggcgattccctcatttagtttgcgaggataccagaattaaaggaaaataatgagaaatgcttatagctcatagatagacgcgaggtcacagacagccagactggagctaggagaccatgctgatgtcacatactgccctatcagaaccctgggaaacccttggtctgtgctacaagagattggcccatgatagccagttataaccaggcagtgggcatctcaggggtttgcataggtctaaccttaaaaagccacatgactgggtgcggtgacacacacttgtaatcccagcactttgggaggccaagacacaaggatcacctgaacctgggagttggagaccagctctggcatcacagtgagacctccatctctattaaaaaaaaattatttttaattagctgggtatggtggtgcatgcctgtagtcccagcaccttgggttgctgaggtaggagcatcacttgggcctgagagttcaaggctgcagtaagccatgattgagccactgcacttcagcttgggtgacagagtgaggtcctgtctcaaagtaaagagtcctgttaggaagccataatgattttaggggggatggtttagatcttgaagaaagaaaaaataatttgaggagtgagcacttgaactatcaaactttctcatctattaggtgcgttaggttccttacatcttattctttttttccttccttttaatatatagctactctccagagagaccggatcttcaaacattttaccaggaagcgccaaagggctatgcgaaggcgagtccaccagatcaatggacacaagttcatggccacgtatctgaggcagcccacctactgctctcactgcagggagtttatctggtaaggggttcccttacttctgtcctcctcagagcttccatctaataggcttcctctggttatgtatgacttcagcagaatgcatgattatttaagaattctttcaggatctgatttttgcctcttactctagtatgttgacccagtaatttaaatctccattgcaaaaacatctaaataatttacagatccaagttttagataccatttctttttaaaatcatcttggtaaagatgctaatgaatcctaaactggtcaacaagcataaatcagagaaaaaggctaataagtcaataaacaatcagtaaattggataatcagcccctaaggaccaaagaataatcaacagtattgctttaagaaggcatgaatcgcataatgacttatggaaattaatggttgcgagaaaactaaacacaaagtagtcttcggcctcttggtatgtaacagaagataatagccttcagtgatcatatactgtaatctaatccctaggaattagtaggaactaagataattcaacattgagaaattctagagatttggggcaatatcttactagacatacaactgaagcttaagtctcagtctcagtggcaaatgtaaaataaatttaagcagtagttatctttagtgataaattaagcatacttatttggaaagggaagaaagaaagatgccctcacacacccatctcagaaggagaaaacacagtttggtagcgtgaaaggagatctatatttttgttgtcaactttaattattttgtttagtgaaggcagaagcccttggatcagagcagtttctgaatgttgatcaattactttgtattttgttttctgtgattattttggattttatatcttcaacagtcagaacctagggctagttagtatttctgacatttttaatcaagaaacaacgattttgagatgctaaaccagctgtagatatgaagccaacaaatgtgtcataacatttattgtatttagggaaaaaattgtattacttttttttgggaaaaaattagcagccctggcgtctttgagttcacgtttcctctttgcatgaggctgcactcgacttagccacagccccacctctctgtggtttgctcacttgtgacctaagggtgcttgcctcttgcagtgtatttcatgtcacacttttctgtttcttttacatgacctgccaggcccctgtaggcattagtggtgatggcccctgacctgaactgacattcataatggaaacttatttgatcatttcactgacttttttccaccagagaaacattaactgtacccaaccagcctttaacgctccccccctccacacccatacactgtcaccctcatactctctctctcacacacacttaaaatattggtgtatatattaatatatatggctaagagtatggactctgacatccagtctcatcaccaactgggtgtgtgacttagtcaagttgcgtagcctgtcaatgtctcttcatttgcaaaatagacacaacaatcttattttacttgtataataaactttcatatagtacttaaagggccaggcactattgtgagcattttatattacaacttttaatcttcattagagccctgtgcagtaggaacggttatcattagtcccttttatggatgaggaaactgtggctcaaagcatcaggtcatctggcttcagagtctgtgctcttaaccatgttattttgtgtgctgcctcccgtggctttttgtgaggattaaatgaaatggtatatatcagctgcttggttcagtgcctggcacatcctatgggcttagttactgtggtctttgttaatgagaatgagaatactcctaatgttaccatcattatcatcacccatagaatatatttgggagaggcaaagatggaagtggtgggcctgaagggcatattgtggcagcaactctgcccacctgtggactccaggggtgatatggacacagggacaagggcaggtcccctgggacaggcagctgcggtagactcatctgtgcacttccacagtgtatctgtgtccgtttacttcagcatctgaacatctttatgtgagagagaataaggtgggaactcttcaggccaaggcttaatcacacgtacagatgaggatttattgccactgaggacttaggaaattgccatggaggtagatggaatgggaatggtttttacccacccatttgtatcatacagcacattctaatccagcacatggttttttctggtgtctcatagtaacaaacaatggctcagaaagcacatgatctttgcttcttccctgaaattgtgtttttcataaaggaggagaggatgaaatttgttttccttaaggactataagagggttattgctgaaatacttgactgatggtagttttcttctcttcaacaggggagtgtttgggaaacagggttatcagtgccaaggtaaggaaacatttttaaaaccatgtttcattttgttcctatgttaaaagaaatgattataccaagagaaaacagggtatcttcccttaatattgtgataaataactctctgtaggtcaaaggaaacccctgtgtagatacaactctttagtttggtgagatcttggccatattttagacaatgtaaaggggacgtttttatttctaaagccaggatacctaataaattttcattgtttaaagtcttgtctctgcagtaacatgagagtactaaaaggtaatgtgattttgtgagcatactcttaaattttgaagataaacttttgttttttacaatcctattgataatagatagggatgaaaagtagcacactgctgttttctctttttccccgtccagggaacataagctattatccaagttgttttttgaaatgttatgatttcaaaaaaaaaaaaaaaaagtgagaaatgttcaaagttaagctgtcagtgatcttgtaagttactacatgttatatttagttttcacaatctaagatgaaaccaatttactagtgtttctagcataattggaaagaaatacaatggcaggaatggaagaagagccctcagtcaggtggtttagccaggcccatcaggcttgcctgtcatttgggttcccccttaacctttgacatgagtatcatcacatagtttatacacatggtacctgtttcactatgtggatgattgataaaatagcaccacatatcctagagcagtagcctatgtgtggataagaaaatctcaccttctcttctggaagatgtgaggtaaaacattacttcccttggatggactgaataagacatactcttggatctaattttgactttactatgtatgaacaattccattgaactttcaaagttaggaaaaaacaaatatataatcaatatgacagcaataattgacctgtatgctgttaatctcagtcccaagtgagaagacagttcacaagccagaatcgctgtcactttgtggcatgggcctgtgagcacaggaatatgccctgcagtccatggtagcccatcttatgcacaccaagataagttgagaagctctggataaacaagattatggttttgagtttaaaacatgggatttaagatacatctctattgttattttatttctttttctctttgtcctatagtgcctggatatttgatggcctgattttcagtgggtcacctgctatgtaaagagcagggaagactattagttaggagacatgcagacaccactttggtgatgtctccctaaggcatataaaaccaaatgcctggttggagagaggtatgccattctaacactgatcaaaagcaaactggcataggtatttcagacagagcagacttcagaaaaaggaaaattatcaggaataaagaggggacaacaataaaggggtcagttttccaagaagacttaacatttttatttgttttgttttatttaaagaccagtgtagtagtacataacaatttttaacatgtatgtatgtacctagcaacaggaatcaaaatacatgggacaaactgatagaatcacaaggaaaaatgaacaaatccacttctatagttggagacttcaatatctcagtaattgatagatccagcaggcagggaatcagtagggatataggtgatctaaacagcattatcacaactaggtgaaattgacgtttatagaatacttcatccaacaacagcagttttcacattcttctcgggctcacaggggacatttaccaacatagaccacattctgggccataaaacataccttaccaaatttaaaagaagagaaaccataaacggtatcttcttagaccacaatggaattaaactagaaatcaattactgtaagatagctggaaaatccccaaatattggaaggttaaatgtcacattctaagtaacacatgggtcaaagaagaagactcaagagaacataaaaaatatttagagtcaagtgaaaatgaaaatataacttataaaaatatgtgtgatccagcaaaagcagtgctcagatgggaatgtatatatcattaaatgcatacagtaggaaagtagaaagatctaaaaccaagattcgaaatttccaccttaggaaactagagaaggaagataaatttaagcctcaagcgagcataagaaaagaaataatacaattagaacagaaatcagtgaagttgaaaataggaaaacaacagagaaaatccatgaaatcaaatgctgattctttgaaaggattaattgataagcctttaccaagctaaccaggaaaaaaccaaatacctcaaaaaataaagtatttctgtgtgaaggatggttttgagatcccctcatataaaaagaccagttctctgggcactttcaatttggttctcctgagaattgaatctgatgaaagctagatttgttttaaggtatgatgctatttactgacatgtcacctctctttatgtagttaatcctaaaaccttccacatgtcttgaaagatcttaagatgatatacatttttatactgcttcattgcatgtgtttatcctttgatgacaagctcaactatctgcagtgtatcacttatctagatgagaatgaaaaaaatgttattccgaaagttctaaatatttcaacagttgattaagccattcagcaaacatttattgaatgcctcctctgttcaaggcatcatgcaaggaattctgagggcattacaaggctgggtggaaggtttgaaatgaaggggcaggctaagggttgtgggagatcagaggagggcaggtggtttcagtctagaagtggggatggggtagagtattttcatggaagagacattttctgagttacatcttgtcctaaacttaagatttggttagttgataggcaaaaaggatatcccagggagagaaaagggcatcgatagtttgttggaagggtccaggaagagcaacccatgtagtttttactggaacaagtagatcccatagaagaaaggtgacaggtagcttggagcagcctctggagggcctggaacctgggtgggaaatttgaactttgttgatcggcagtgaattaccatggaatgttttcgattatgggggcaggactagagtgttagaagagtcctctggtggtgggtgcaggatggaataaagtcaggaaggaagaaataggcccaggacttgataagggatagtttgagcctgagcaaaggtctgtgttaggatggtggcgaaggcaataggaaggatgggcgcaccagctgctgtcaagggggccagacgagtccagtcttgttggcacggtgcagccctggttgactctgctgtaactggctggactgtgagcttctgataaatgtataattgctggatttaatttcctagtgtgcacctgtgtcgtccataaacgctgccatcatctaattgttacagcctgtacttgccaaaacaatattaacaaagtggattcaaaggtaagaggatagcagtttgctgattaaatgtgcgtgtgtattgtgtatgctgtgtaccgccgtctctctccctccctccctcctttcctccccctcttttccttctccccgtccccaaacctctgctttcctccccctgccacctcccttccacattctttgaagccaagggttgtattagaatagaaatgtctctctccctttttttaaattatggcatttatatttctgtatttatgtggcatcatccctcctttgtgaggaccccattagtggttggctgggtataagctatatggattggttctacttatttggagagacttttggcagagtgaaaggagccctgaacttggcatctgacagcctggatttgaatgctgaatccagcctctgttagccatcttctctatgagctgcggcaaggcctacaatctctcttttcctcagtcttaaaacaggatcaatgtttccctcacacagtttttgtaagttaaacaacatagaattgatgtgatacatatgttaataactgtaaattatgtttcctaagtaaaaagattgctggctttctccagcctcttaagaaatttcagggaagatgtctctctctctctctctctctctctctctctctctctctctctctgtgtgtgtgtgtgtgtgtgtgtatgtgtataagcttcaacatcattcttgccactcatattgcattcatctgcaataggcatacattttaaattctagaggtaaaagcagatggagtgttgctgacatttagcagtagatttgcagaggcattggaagaatgactctggaacacaatggttctttatagtacacatataggattgctaaagagtatacctagaggtataaaccacagcttttccaagaaagaggccataaaagtttcaagaggagtaatgattgccctactccttgtcatgcatggatctgttgttatagcatcaaattgtggtatggactgcagagtacatgcctagtggaattatttgctggaaactgagatttaactcagattgtcagattgcaaatgccaggcaaagaaaggctggaagagctgaataagtagttactttaatgtcactttggaataaattccttctgtggttccatggcctctgagtctcttctttttatttttcttcccgtgacacaatgtctggaagaacttacagtgatagcaagtatatatagtgtataaaagacccatttaatcctgaagttaaaaggttctgggaaatagatgggggtgttaggggattggcaaggagagaaatatggcctgaatatgaaagatgaagtgaaaatcttaatttttatttctcaaaatggcaaatgatctaatgtgtttcccacatttctgtcttgtcctgttcattagaaaatgtgtttagtctggttcgtaagacctgagtaattaatcagggctgagtacagtaaaataatatacctagctcaggtgtcatagtgacactttgcatttgatgggctcctattacagtttttacaaaggacattggtatgacattttagctcttgtccctttatttccttttttacagattgcagaacagaggttcgggatcaacatcccacacaagttcagcatccacaactacaaagtgccaacattctgcgatcactgtggctcactgctctggggaataatgcgacaaggacttcagtgtaaaagtgagatgctgaggtgctgggtacccacctcttcatgggaacactatgccctaagctttcagaattctgtggactcagaatctgtcctagaactgatggttttagatatgttgtaaatcaacatcttagtcattttaaacttacatgtttcttgtcaggcatgtaaagagaacttcatctgatgccaacattttctaatcataggacattaagtcaaatggtatattcagtgatctagctcgctagctgacaaatacagcctagacactgtattttaataggtgtttggaagagaaaaagatgggatcttagtcagaaatggaagatggttgagtcaggtgagacactaaaaagaaaaaaataaataaaaatttcaaagaaatggaagttaggaggaggtgaggaggtgagatggccaaatgagaaggttgggttaagagtaagaaatggcagaatagatctgatgatctcaccagaaatcagcaggaatggagttgtcacagcataaaaagagctgccctgggtcttgtgaaagagattggagacaggggtagaatgaaggaagataaagccttgattgtaagcttgcatctcaccagctgtgcccagtggagtgagagtttggagctttggccctagcaaaggctctgagtgggtgagagctgatccctgtcctgttaggagttagggagctgttggccttgtgccatcttgtatggaaatgtaatgatctgactgccgtggggtgcacctgaagcctttcttatcagacacaccccaagtcgccagttgaggagaacaatggtgaggtagaattggcatgagtatagccagacaacttccattgactgcttggacttacagagcctgcttctgtcaacaaaaaggggccagtcacttgtctttaagaagggcacattcttctatctctgtagaacactaataatttttttctcataaaaccaaaacagtagccagctcatggataacttgtagggcgttggtccaggtgcagcttgatcttagcgtgacggtctcacctgggtatgggttcccagtgggaaatccctttctgccttgcattgttgctgatgcgcagagccatgcatggggctcatctgcattgtcctcttccctagtggcctgagggtagcacacctgcagcaatccggctcttgtgatttttgcctttatggtcacttggtggttttgaaaggcttctgtaggctcgtgtgtcttacacctgtcttcctgagaggggtgggtttcccatgaagcttaagtctcagggctcctctctctcaagggcaccttccaaagccctctacttgatttggtgttctttttcttaaagaaggcctcctaaattatgtaaattcaggccccacaaaacctggatctgtgtgtgcttccaagatggactgactccataaaacaggaatgtgttgcttgtcgcttcagtttcacctcccatcagcagggcccatgtcaaaaaactgtctcagaatttattccagctgataacgcctcagatccttcattgtccccaggcagcttccggtgcctcaggagcttagctttctttgctcgcctcttcaactgccatttgtactctgaccttcagaaagttttaaaagttgcctttccccactatgaagcagttagaaccacaggctgcaaatgctgagaaccacaggctcacaggatgcccatctctgtgctgtgaggcctgcccaaccacaacaatactcagaaagaaagctgcagatagaggtttttcttgtagaaacaccatttccatcctgtttgaacagtgatctacatgtggcatttaaactgctaccttttatttcactgttgagagacagaaaaaaatacagttgacatgattctttgttatttaattgcctgtgaattgccgctacgataaaggttttaatcttagatcatactaaggcagcaatgcctgttacatgtgatttagatgaatgggtttcatcaaatcatggtggaaaaaatgtatttgaaatatattattctttagtatgcttgcctttctgcttctgcagaaaacagaaatagataaaatgtcaggaactattactagtgtgagcttaattttatgagaaaatgatactgttcagccggtataattcctctgttataatcttttaggctattaaagttctctgttgcagcacatgttgaattggttcctttctgaacatggattctgttttccttttccctctagtatgtaaaatgaatgtgcatattcgatgtcaagcgaacgtggcccctaactgtggggtaaatgcggtggaacttgccaagaccctggcagggatgggtctccaacccggaaatatttctccaacctcggtgagactttgctttttttccatgtctcgtaatttagaagttgctcagatgtgatgagcccaaatgagagcatgtggcctcatcaaagttcctaatcttagcaaatacaataaacagacttattgcctttctttctttctttctctttctttctttcttttttcttttctttctttctctttctttctttcttcctttctttctttctctctttctcccttttttttctctctctctcctctcctttcctctcctttcctttttccttccttcctcccttccccttccccttccccttccctgtcttcattcctttttgagatggggtcttcctctgtcacccaggctggagtgcagtggcacaattatggttctctgcagactcgactgcctaggctcaagtgatcctcctacctcagtctcccaagtaggtgggactgcaggtgtgcaccactatgtcagggtaattttttatttttttttttgtagagatggagtctcactttgttgcgcaggctggtctcaaactcctgggctcaagcgatcctctcgctttggcctcccaaagtgttgggattgcacaggtgtgagccactgtgtctggctgaaatagcatttttaatagcaatttgtttcacggataagattgtatatacagttatatgacaagaaataatgagcatgagcaacaagtaataaacagaaagcaaaagaaggacttttttcctttctttccttttttttttcttttttcttttttctatttgttttttgagacagagtctcgctttgtcacccagcctggagtgcagtgatattcgctcactgcaacctccacctcccaggttcaagcaattctcctgcctcagcctcccgagcagctggaattacaggtgcccactaccgcgcctggctgatttttgtatttttagtaagacggagtttctccatgttggccaggctggtctcaaacttctgatctcaagtgatctgcccaccttggcttcccaaagtgctggaattacaggcatgagctgccacgcccagcctttcttttctgttttaaaatcagcttcctgtcactgtggtctggtgaaagcctaaaacccaggatcctgggttatgcttttgtctggggaccaggcaggacaggtgaccagtaactatgggcgtcagcgtcctcacctctaaagcggttcaacttgaagatctcagaggctctgcacagccctggagtccagcagttctgaagttttggtttatggattgtgaatttatcattcacattcagcaggagacaggagtctctccctctggactctcaggagtgagtggagttgtgtcagttgcagtgcacatgtttttgtcagcactctccctgaatgacctccacctgctgtcatccagttgagccttggctgcttcccaagcccatgtcttactgttgccttcctggtcagcgtctagagatgggaaatagccatgtaagatctgaacggtgtagcttggtgtccagttcaggaaaattatcgactcaactaattaatctctgggtgctgaggaagggaagtgcaattactgtgagattcttgataatcctgaaaatgtcagcaccaaccacctcatttcctttttactgaaggactcctgcctagtagatcagggactttcattgacaatttttttttttttttgagacggagtctggctctgtcgcccaggctggagtgcagtggcacaatctcagctcactgcaagctccgcctccctggttcacgccattctcctgcctcagccttccgagtagctgggactataggcacccgccaccacgcccagctaattttttgtattttttttttttttagtagagatggggggtttcaacgtgttacccaggatggtctcgatctcctgaccttgtcatcctcccgtctcggcctcccaacgtgctgggattacaggcttgagccaccgcgcctggcctattgacaatttattgaattgccactacgataaatgttttaatccttatattagatcatactaaatcagcaatgactgttacatgtgatttagatgaatgggtttcatcaaatcatggtgaaaaaatgtatttgaaacctattatgtaaaaaaatgtatttgaaatccggtctgtctgtcttgtgggtaggcgggcaggatgccaatattgtgcggggattgctaatgcatgggacagttatccctgaagagcagagattaaagatatcagcctgaactagggcttctgagatacaatgggaataagataagaataggaataaagatcatgcagcacgatctttaggaatggacagtgcacttgtcatttgaatcaagtatccttaatccatgacatccggtgcctggctggatgttagacttttgatctgttgtctagtggtagcttatcttataaatgtctcaaggtgggccagctgcaaaagtcaccttgcctttaggtagcaacatcctcaggtactcagtaggatggaactggaaagccaactgaggcaggcacacttaccttccattcattgtgttgaaactagaactctcatcatgctggtgagagtgtagattggtcagtcttattgtagacggtaagttggctgtgtatcagaagtcttcaaaattagcactttggcccaaggaattccatttgcaggaagttatcttaagaaactgaataatgataatgacaatacagcttaagtttattgaatgtgccaggcaccaatctaagtgctttacatgcatttgttcatttaggcctcctaatgactcatgtggcagatgctttaaccttctctttgtcagaagaggaaactgaggtagggagaggctgggtaggtaacttgctcagggtcttaggttagcttgcagagctgttattgaatccaggcagcttgcttgagagctagacccttaattactctgttttgaagatttgcatgaagtgtattcactccagtgttattcactgtggtgaaaaaggggagatgcctcatccttctaatggcaggggaattaataccttgtgagatatccatgaaatggatattgaatagccgttagaactcatattcttgaaagaaatttaaaggcatgaaaaatacccaggacaaatttttgaatacaaatgtatgttatgaaaccataatttgattatgtttttaaaaattaaccaagtataaaaacgtgtgcgtgtgtgttatttatacatggatatagatatctttggcagagggctggtgagattttaggtatttagatttttattcttcatgcttttgatcattgttctaatattcacattggacttttatttctcctatataatttaaaatattgattaaaaaacgttgcttcattcgtgtcctggtgctgaatgatgcttgaatctctgagtagacatgagaactgctctctgtaaaaagtggacactaggtggcgctcgtggaatgggaccttcccgtggaaagccaccgcagaaggcacccaagggaccacacaaggcattggtgtttccatgcacttccacttgagcgctaactgtaactccatggcttagacgtatttttaattgaccttttacacaaagcagtaagcacagattcagaagctgatactgagggagtttcgagtggcagaaccgatcatctgtcaaactgagttgatctttcccccacgttatactgggggtgagactgctcccagccaataaggtcttcttcgtgcatgggtgctccatgcttctgctgcaatttctgacttaatgtgttcttactctttcagaaactcgtttccagatcgaccctaagacgacagggaaaggagagcagcaaagaaggaaatgggattggggttaattcttccaaccgacttggtatcgacaactttgagttcatccgagtgttggggaaggggagttttgggaaggtgagtcttggctttaactgtttgggttgaagtaagtgtgctctgtgtatggggggtgtgtgtgtgtgtgcacgcatgcgcacatactcacatttctcatgtgccattctttcttcctgttgtgtgcacacaccctaagacccccaagaggactccctcatgctccctccttttgctttgccataggtgatgcttgcaagagtaaaagaaacaggagacctctatgctgtgaaggtgctgaagaaggacgtgattctgcaggatgatgatgtggaatgcaccatgaccgagaaaaggatcctgtctctggcccgcaatcaccccttcctcactcagttgttctgctgctttcagacccccgtaagtatgaatcacattcactgcaccaacagcctcttttcttacagagctgagacagtaagatactggagatttcataaagttgagtatcagaaattttgggggatgggctcccaaggcagggtcatatggaggtattggtgacttctgccaacctctggaggaaaaatggaagcttatgaattcaccccttccccttgtgctgtcctggggaaggagcaccgtgagggttgtgtgtcccaggattgaaaaggtcatcatacataaatcttctgtaggtgaagtgaaggtgaatgaaagttacagcagtctaagaacagagaaaatgccatgggctcattgtcttgatgaatttggctgtgactctgctcctaaatgctgggctggttctgacctgggcacaggagtttagaagaggggtctgagaggacccagagaggtaccttgatttggaacatcccagggcattgcttctggccttagcaacgaccctttgcctgaaaccatggactggtcttaagaattgaatctgtctgccctgtaatggcgtgcgtttaggaatgcttctggctgcagttaatggaacacttgaccagcggtggattaaacaataaatagaaaggatgagtttggttcattagtacaaactttttacttgttgtttcacataatgagaagtctggtggtaacagtgctacggttggatttgttgctcagtgacattggacatgtctttcccttggggtcccaaggtatttgctgcagccctagatgccacaccttggcatgatagcatccaaagcagaaagcataagggcaggggctgaagggcttcatggccagtccccttttctcagggagggaagatctttcctagacttgggtcaactgccctgtatgtctgttctcacattgctacaaagaactacctgagacggggtaatttatgaagaaaaaatgtttaattgactcacagttccacaggccgtacaggaggcatggctggggaggcctcaagaaacttacagtcatagcggaagggtgaaggagaagcaagcagggtttcacgtgacagcaggagagagagagagtgaagggggaaaagctacacactttcaaacagccagatctcatgagagctcactatcatgagaagatcaaggggggaaatctgcctcatgatccaatcacctcccaccaggcccttccccaacattagagattccaattcaacatgagatctgggtggggacacacagccaaaccatatcatgcccttagcaagggaggctggaagagcaaatatcaggccaagataagctggcagaccatgattggttcacaccaaccttgattcagcccctggagcagggcattctgcttttatttagaatcaggctcaaaattgggcttttggtatcaatgaagagggaaaatggccctggagaaggcaccaagagggagggtctgccacagatgtgtcagaatcttgctgtcaaaaggcattctgggagagtgaattctgggcatgttcctggcctgtgccaccatcaaggaagtaggggattccacgagagcgggataggggcatctgactggtcagggaggctggcaatacacctctagggaaggtaaagccatgctgggaccaaacgagtgaattagaattagttaggcagagaatgaaggtgaatatgtcatacagggtcaacagcacactatgggtctgctggtgagacagagcatcaggtgtgaaggaggctcagcacacacagcatatcgaggttgaacaggggccttgagaactgaggcagccgaggtgggccagggccaggccatgaagagccttgtaggctgtgttaaggggtttgggtttagtcctgagagcaatggaaagtcatggaagaagtggaagcagaggaatgacgtatcaggttgtatgttttaattatgaaaatctaatttcttgcgataggtaatataagtatcctccaaatattcatatcctttctccgaaagaaacaagtattgctcgttttatttatagcctttgagagaattttctgtacataaaagcatatatatacagcacatatatgcatacatgtttatcttttaaaaacacaaataatagtatactttgcccatgattctgtatttttaaaatttaattaatctattttttgagacagggtctcactttgtcaccaggctggagtgcagtgacggttatggctcactgcagcctcaagctcccaggctaaagctatcctcccacctcagccccctgagaaactgggacttacaggcacatgccaccacacctggctaatttttgttatttttttgtagagatggggttttgccatgtttcccaggctggtctcaaactcctgggctaaagcaatccacccacctcagtcactcaaagttctgggattacaggcgtgagccactgtacctggccactttatttttttaagacataatattaatagtatatattggaaattgttttgtatttctatataccaagctgcctcatttttaatggctgcatagtactccattttagaacatgacataattaatttaacttttcctcctctgttgctatgtattgtgttcctagtcttttatttcagtcattgttgcagtgagtccccttgtacttttgtctttgtgtgcttatgctggtgtttctgtatgacacattattagtagtagtattgcttggtcaaagggtatatgcatttcacattttgattgagttcaattgccccctcccccattgtggttaaagatagtgaacgttttattgtccatgtaccacacattgttctaagtgctttatgtctgttatttaatccttatagtaaccctctgaaataagttctgttattatcaccccatttcacagaggagaaaagttaggtacaaagaagcttagttcctaagtggcagagagcgtttgaagccaggtggtctgacggcagagtccaggcaggctcttcctatttgctgggctgcgtctctaaattcacactcccaaagcttgagtgagaaggtgcatttccccgccttcccatcatggcatgctctctgtcatttggatcatctcagagttagaaaaatggtatatttgaagttccaacttgcattcctctaactgtgagtgaagctgggcgttttcatacatttcagggtcactagtattcaaatctgtgttgggagggccacatgcagcctggagaatgggtggagcagagaagtctgggagcttggtgacaggacgcactgaaggagatacatggcttggactcccacgccaccccagcgttatcaagagaaaaaaaaatggggaggcagctaatggcttcgtgggcctcggctcccctgcgcgcctctcccttcccctctgctcctcattggtcctcagtggctcttgatggccctggagcccatgctgctcctgcccccatcctctgctttccctctgctggattggtccttggttcccctggagctccagttctccctgccccacactgctccctggagtagccttgaaacgacttccttggctgggcactttgccaacgtaaagcccctcccctgccctcacccccttgttgggctcttttcttggaatagaggagtggagttacagcttgaggcttgagagggatagctggtagctgatactggttgcccgccggggtttcaagcgccagcctcctgaacaccaccatgaacaccatgagtcaagccgcagagccaggtgacctctcagatcttcttcctagggcctgagccaaacatcacatggtttcctatgacatgaggttagatcatcttcaccaggtggtaacctttgagtcaagcagtcaactgatatttagtgagcttacctggtcttgcagcagcaatggttccaagttactactgctgaagcaaagaaagaagtatctcatacctaacaggggaatttgatctgtaaaaggaaattctggtgattataagcaaagatctcatcaacagatcatgttatggtagagtaaaatgaggaagtaacctggaacagattgggaacccaatcaatatagcatatgcaatcaaaatgttccaggaaaatgtataaattctacagtataccaaaattttagcggccacatgagattcccagtgtttagtgggtgaagcctttactagcattgaagtctatttttcctagtggaagttttatgtttgaccacaaggtggcagtcattaccgcaaagttacttttatttctccaccagagaaaccaaaggcatggaactgccattgcggtttaagatgtgtgtgttgtagtagatgtctccaaagcaaaggataaagggaatgtacccctgctttaggctaaatgataaagaagtagtgggaacccacttcaaagaagcaagtgaggctgggcgcaggcagcactttgggaggccgaggtggggcaatcacttgagcctaagtgtttgagaccagcctggccaacgtggtgaaaccccgtctactaaaaatacaaaaagtagcttggtgtggtggtgcatgcctgcaattccacctactccagaggctgagacaggaggatcgctggaacccgggaggcagaggttgcagtgagccaagatcgtgccattgcactccaacctgggtgacagagcacgactttttctcaaaaaagaaaagaaaaaaaagcagcaaaggagattttctaatgctgagatagaggtatacaattttagttttgctgtcgttgttgccttctttgaggtttgcaaggtatcggactccacagtacacatagcatttgctcgctgtgcattcgtctgttggaagtccttatttactgttgtaaaactatccccatttactgttggaaaactaactataaagaacagaaagtgttacttgctatgagaagttacagcagaaagatgcttactttttagctgcccagtgttgcaggccctggcttctcaagtaagatgctaatcagtgtgtaatgctgaactgtgacagtctcccctggagaatttaggagtgagagggggtgttggagccactctacctgcaaagcatttcattgtgagggcctttgtaaaaacagcactctcctcatgcagccctgtggaatcagtctctctgaagcccagagcagggcagtaactagccgaggatcccttagattgtaagtggcagagacaaagttcaagtttaggtcaggctgactctgactccatatgttgtcttattccgcatttagttggttgattcagcctcggcttaagcacctcctatctgtcttggctcccctccaacctgacaatatggaaatggcattgcccttgggaacagaaaacctgaactgtgttttagctttgttttccaccatctaaatggcttgagtctgtcctaaaattcctttgacccttaaagttcttatcattaaaatgaaaacaggatcgctgtgagggtcaaatgagagaatgcagaatattttgtacagtgcgaagtgctgttcaaaagtgagtcagttcaactgtggtgatgaccccctccatcctcacaccaaaggaaaaatgtcccagggcttcccaatggccagcccagacacccacatggaggggacagcaaacattgagaaggtaagtattttataggtccttttgttcttggcaaaaaggaaatagtaagcaaatttcaaatatttgataatttatcaagattgctacaaaggtttatgaacccatagattatttcccctttttttttataatcatatacactgcttacaagtatataaatgggcatccttatctgtttctgatagcactgcaaatcctaatagtttgtgactaatttgataacctgtactaaaactcacaaaatgtatactcctggatctgtttttctgataatctggactacaaaaataatataaagaataaaatgttattcataaagatgtttaattttcagtgctttgtttatatatatttttttggtcaacatctctctaatcctccagcctctggtaaccactattctattctgtttctatgagtttggctttatttgattacacatatcagtgagattaagctgcatttgtctttctgtgactggcttatttcaaataatacaatgtcctccaggttgatccatgttgcaaatgacaggatgtctttctttttaaaagctgaacagtattctattgtgtatatattccgttgtttctttgtccattcatccactggtgaacacttaggttgattccatatcttggctattgtgagtaatgctgcagtgaacatgagagtgcaggcatcttttcgacatgctgatttcattttctttggatgtatatccagtattggaattgctggagcatatggtagttctattttaattttttgaggagcctccataccgttttccaaatgagtatactaatttacattcccaccaacagtgtacaagggttcccttttctccacatcctcttcaacacctgttatttttcatcttttcaataatagctgttctgacaggtatgacataatatctcattgtggttttaatctgcatatccccaatgattagtgatattgagcattttttctatacctgttggccatttgtgtgtgtggttttgttttgtttttttttttacttttcatttatttttactttaagttctgggatacatgtgctgaacttgcaggtttgttacataggtgtacatgtgccatggtggtctgctgcacctatcaactggtcatccaggttttaagccccgaatgcattaggtatttgtcctaatgctctccttgcccttgccctcccacccaacaggctctggcatgtgatgttcccctccctgtgttctcattgttcaacttatgagtgagaacatgtggtgtttgattttctgttcctgtgttagtttgctgagaatgatggtttccagcttcatccatgtccctgcaaaggacatgagctcattcttttttatggctgcatagtattccatggtgtatatgtgctacattttctttatccagtctgtcattgatgggcatttgtgttggttccaagtctttggtattgtaaatagtgctgcaataaacatacatgtgcatgtgtctttatagtagaatgatttattaatcctttgggtatatacccagtaatgggattgctgggtcaaatggtatttctggttctagatccttgaggagtcgccacatggttttccacaatggttgaactaatttacattcccaccacctgttggccatttgtatgtcttcttttgagaaatgtctattcaggtccattaaccattttaaaattgggttgtttcttactattaagttgtttgagtttcctctgtatttggatattaactccttatccagatatgtgttttacaaatattttctcccattccacaggttgtctcttcactctgttgattgcagaaactttgcagaagctttttagtttgatatagttccatttgtctatttttgcttttgttgcctgtgcttttacggtcatattttaaaaagccattgcctatgcctgtgtcacagatttcttcccctaagtcatcatttggtaattttacagttttaggtcttacatttaagtctttagtccatttttcagtgatttttttatgtgacgtgagatgagggtctgtttttattcttctgcatgtagatatccagttttttcaacaccatttattgaagggacagtcctttctttgttgtgtgtccttgggatctttgttgataattaattgattgtaaaggtgtggatttatttctgagctctgtattctgtcccattggtctatatatctgtttttatgccagtaccataatgttttgattactgtagctttgtagtagattttgaaatcaggtagtataatgcctccagctttgttctttttggtcaagattgctttgatgtcgtgcattatttatagtaggaaaatattagaaacaacttcagcatttagcaatgggggtacacttcaataatatactatttgatgagaattttcagccagtcaagagataattttatgttacgtagttaaattgtcaggtaccgtcgtaagcacctaacatgtattgtttattgcacgtgattcctataacagccttataagataggtgcaattattatcctcattatgtcaaatggaaaagtgagacactgagcagttaagtcatttgcctaaaatctatcacagaaaatggtaaaaataggaggttagaatccaggaaataatacagaggttatgatgatgaacagtctgtatccaagtcaggttctgcccaagatagtgaattggcagacccgttcccctccccagcctcaaaaaagactgccaggaaattatgccagtaagctatcagggactggattaaggtagtggaattatgaaggatttttttcctatttaccaaatttggtaataggattacatttcttcaacaatgggggtaggaggaataagccattattaagtcagggaccagacccctggtctctcagaacctgggatacggcctagtacatgctgtctccctgactcatttatggcgaaattcacatcacactccttttatctgaatcagtgagggttgtgtcagcagctgagtccctggcatggatgtgctggaatccaggcctcccatcccccatccccggctcgcaggggcctccccttcggttctcctcctggagagagaggaacaaagactagggggtgagggatggaggggggctatcacaggaagggggagcagcaaagtaaatattggtctgaggctttgttcggagacccagtttatggaagcaaaggtttccatttggaaaacagaagacacttgtggccagtgcccgaaacagcctctcactagcaggccctgggactgggtgagagggctgagcgaagtactcctcattgttttgggaatgccttaagtttgagtttaggatccaccgctttcaggtgggccacaggacgctccgatgccggtcgcttttgcctcctcccgctcctctgcctgctggggcgtctttacgatgtcagcctgcaaggatggagttcctggcaggaccatagctttccgtaagaaaccacttctcaaatggccaacaaagttgaaatcctggtttttgaaggtcagaatatcttggaatcttgtgaaataaatgccatcgctgcatacatgctggcacaaaatgatctcacgtgtgctcagtgtacctgcagcttgagtgcaaaggaacattctttcctttgtattactttctccattgttgttgtattaaatattagcgaagaagtgggagaggcagagagcagccaggcagcaaggtagtcatgtggccctggaattcatctttcagaattttcccaggcagggaactgcactgtgaccttcagcacaagagctctgagttctaattctggcttagctggcccacttgtctttaagaagttcccctgccttttattttgagataagcctctccacctaaatgtgtgttccttacttctggacctgttggccaacgtacctttagggagtgcccctccagctggcttcaacatgtggggtcgtagcggggctgcagcctgccctgtccagctctgatgcttcccagcgcctccagctcccctttcccttcctgaggcctcactgagcatttggctgagcccctgccagccgctggatgtggggaggagaaggcatgctcagaccctacagtggcattactgcttgtgctctgtgttgctgtgacacccagcgcaaggggaagaggccctgtgacagagggttagacaaggagaaggggaagtatagccgaaaggctgggagactttcccctttacaggcatgggaattctgaagaagcctctgttcatgccttggggtagttggttgattcctggggactgaatggtgcccactttgcaggaggggatgagcgaagaaggaaagggcagttcatgagaccctagcatatgtcctaggtgctcatattcattaccaatgtctatgaaactaaactgcacattggcattccgtaaatatccattgaacaaaatatctcatttaatacccaaagcatccagggaagagtatcatcctcattttaaaggcctagaaactgagatccagagaaattaaacaacttgccccagatcacacagtaagccagagtcagtgcatggattcctgacctgactgtcctgccaaataatatacaagccatttccattatatcacaaatagaagttttgagtctctaatatgtacaactgagaatactgtcattagacgggaatagaggcagttttccacaataggtggtttttggccttttgggaaatacctaaggatatttcctctgatctgtttggaaccaggtttccccctttccctgagcagtggctgctacaaatacaatctggtttgctgcgggtcatttgttgcagtttgcctttggctcagatcaaaatagaaaatgagccagaacatggtgtttcctgtctctgcatgttcctaccttattcatagtgttccatcttttttttaggttattaattgtggatttatttccatagtaagacaggatctgactttggggccaacatatgttggacccgcctccttctctgctgaagattctctgaagacaaaatgtgcataggccttctccaggatctggatttttgggggattatttgggacctttgcttctgtcctctccggctaccaggctttctgaccttctgtagctaaatagggccacaaaaatgaataggaataagagaacctgaagttcaagctgtgtctttggctctgtctctttggacgcgactgccaagatatttggtgtgacaaaaggatttgaaatagttggcctgtttttttcagtttgaggttgttctgttgtaactggtcttgtttttggtagccatcattatcactgacaacctagagactgagtagaccgccacctccatgtctgctaagatagtataatttaaatctttgatgtaaccagaacacaacccaggtcacactttgcccctgtgtctcatgatgactgaaagcttttggggtgatgattgcttggttatggttttcctggacccaacttggaacccttaaagcctgccaagttatagatactctggcttcagtagggccctgtattgaaacaccaagtgccaggactgctcaaaaggtgaaaatgagatgggtgttctgccaggtggtttagtgaaaaatcagtcaatccaggatcccactgactgaatgctaggcaaaagaaacagttcttttatttgttttcattttttgcagagttggaggtcttgctatgttgcccacactggtcttgaactcctgacctcaagcaatcctactgccttggcctcccaaagtattaggattacaggcatgagccaccgtgcctggctagaaacagttttttaaaaactcattctaattaggaagagaagaccaatacacatggaagaaaagtgtacagtagatagcatgtagtaaatatagtccttatgctacaaaaggaaaggtagttgaaaatgaacattgggttctaggggaaactcttaagtatgtgccagtctgtgctcagaagtacaacctgattggctgtgagactaaagccaactgattgctttaagcagcccctcgggtgtgggctgcagatggttccctaggaagctgggttgagtcctgctgtgatgagctgggactgccaggtaggacctgaagcggctgccaaggggctgccaccccaccctgaagacaaaatcatacagtctaaaaacctgactgctttggatcaaaatcataccctgtaatatgttctagtttttaaataacttgggttttccttaattacttaatctctgctgagaacccagctgcatccatctcttctaggtccggaattatccacagcatctcatgagcagaaacagccatgtcaacataaagttagcagactcgtcgtgtagagagttgtgcactggcaggttaggggggaaggtgttcattcattcagcagatatgcactgagtgcttgcaaggcatagggctcgccttcaagccttgaggacgcagcagtgagcaaaacagaaaagagtccctgccctcatgaaactgacattctttgggaagcttataagcctgaagctcatgaacagattgttcatcttatagtctcagctggtgaccctccatggcagctgctccctgtggcaattcctggattttcctttcagacaggctcagagccgtcatctgcttgaagagtctggggggcttgtctgaagctgcatttgcatatcaagtgctccgttatattttttgtaggatgcagtgagattactggggggaggcgtagctcgagtccttggtccttggtactgtctctggttagtggtgggttctgggtcactattataggggttgggaggtttaaagcaagaggcagaatggcaagagtagcagccccagtaggctgcatttgctcccgttgccacttgcacgatctttctcatcccgctggcaagactagtctgttcactggcagcccctgcatcaggctgtgaggacgccctgtctacctcccgtctccatccctgtattaacccatgtgctatcaagagcgactgactctttctttacaaggttctttttccttccttccccgtaagctaatagtttggctcaggctcgccagcagaccctccccttttttgctggagggctttggcatgccctgtcttttctttggggccacccagggagttcctgtttcctttctgtgggaggcttccaattcttagttatagcaaaagagcctgtattttttagctcactcctgcccacttctggtcttgaatgacttatggcttaggtgttacaaatgggagtcctggaactcttcccagaatctcttaattccattcttgtggtatatgacgttctaaacattaaaatgatgtaatatataactcccaaccaaaacaaaagaggagatccctgctagccaaattcttccctcctctccatacacgtttttccgtcgctgtgcagtgaatcctgggatgtgtttgtcagtcagcttccttgttcttctggctcctcactccccagggaccaccgagccacagactccacggttttctctgagggcatgcgaagtggaaactaacctatccctgcagccagcccagaccttctacaatcatatctaccagtggtgaaaggcagttcaagatgagttggacacaatcaagaaaaatagggaacaaatatgtcatagctcctctctgtctgctgtctatagaaggaggctaatagcagcagatctggtgagggccagtggcccatggacctgcctgccccaaggcagcaatcatgggagtggggtcaaggaaacactaaggaggtacacctgataggactttttaaagaggagtggccagggttctggccggtttgaagcctggagagaatggaatggcatgagttcagttttggggacattcagtggtaagactggtttctgttttctcttctggaagctcatagatacaggatctgctcattcacttgatttgtgcctcttatttgggcttcaggacacatctctggccaatcgcaattaaaacaccatgcccagttagccatcatcgccactcagagctgtctgctttaccgggctaaaaaaaatgatctttatcaccagttgtaagtgacttaaaaaaaaaaagtacccttccacattgctcagaactttgccgtcaccttcttgaccctcaccaacaggtcaggttgttttaataatctagtggctggtaagctttcatcctttacaattaaaaaaaaaatcactgatttgcataatgcagtgccatttgcctactttgttgggggtgggggctgtcctgttcattgtggatgtttagcagcatcccaaaataccagcagcacctctccagttataacaaccaaacatatcgccagacattggttcccaggggggaagaatctcccctggctcccttacatgactgtcaggtgattgtctttggtatgaaaagtcaaatgggttagacgatcacttttctttttatagaagccaaagccaaatgtgtcagaccttctttatgaaaatataagcgttattttttttctgagtttgtagaaaggcaaagttcctgttgggggctcattacagctgttggtgcctgcactgacagtggcattgttagggatggagcccctgagctcgggggagacagcggaagcgtgcagcgtctgtttaatgtgagtgagggctggcatgctgctggcagctctcaacagtgaagcctgctgctcgataaggcattattatcagagcctgggggcatccagggagcaaaagattagctgactgagcatatatctaaaatgggttatttttaaaaagcaagcagtacaaatactgcagcttgtcttgttttagcatttaataattacactttcactttaccagcaaggcattgagtcagtggcattttatgaaaagcatcctcccaaacctgaactttgtgagtcagattcccatcctgtgtgtggtacatgtggttggattgtacaaacagataatcagagttttgcaaaatgtttcccaaccagcatgggaaaacgtgctgatagcaatatgattgggctttgagggagagccacttgctggctttttttcttttgtttcccatacatggaaatgccatttcaacttgaaatgtggataccttaccagaggattgcttgagcccgggaggttgaggctgcattagcgaactgggactgcaccactgcattccagcctggatgacaaagtgagactcctgtctcaattttttaaaaacccacacacaaaaaaaacaacaaaacaaaaagtagaaccttaaatgctatcttaaggctgaatagtctctaaatattgaaagtagaccctagccaaaagagacattacctgtttctgtaatataatgaatggtattagtgtacttatcttgcattttaaattcaattctgtaaatgtttatggagcatgcattatgtgccagggatgaagacacaagaacaaaatgtggacctgccttttaattgcttacagtcaaaggtcatgataacaccatgtgatggagagaagaaagtcatgattgatcctcgtggaggttggaaggacttcccagaggaggggctgtgtgagctgtgttttgaagatgaatagggatcttatagtcacaagaggagggcatagactcccagacagaggtaacagcagtgcaaaggcacagaggcttaaaattgcaggatgtgcccaggaaaccccaaatgactagatgaggcagatttgtaagaagggaaatggtggtggttggcggcgggggtaggggggtggtgatgaagaagcaaagtcataatgggtctgatgtcctttgctgaggagcttagactaaactgtttaggtaaaaggagccagcaaaatctttaagtgagggagtaacataagatttgcatgttagaaggctctctctggctgctatgtacagagggaggctaatggcagcagatctggtgaggatgctgggcccgtgatctgggaacttgcctgccccaaggcagcaatcatgggagtggagtcaaggaaacactaaagaagtagacatgataggactttttaagtgggaatggccagggctctggccatttggaagcctaaagagaatggaatagcatgagttcggtttgggggaaattcagtggtaagatgcttgtttgtcagaaacacacttgagatgggagatcagtttggtgtcatccatgtcctcttggtaagtggaaactataatataaaatctttcaggccaggtgcagtggctcacacctgtaatcccagcactttgggaggccaaggtgagtggatcacctgaggtcaggagttcgagaccagcctggccaacatggcaaaaccctgtctctactaaaaatacaaaaattagccgggcatggtggcacgcacctgtaatcccagctactcaggaggttgaggcagggagaatcgcttgcacccgggaggcaaaggttgcagtgaaccaagatcacgccattgcactccagcctgggcaacagagcgagactctgtcttaaaaaaaaaaaaaatcaaaaatcttttagtagatgtttatagagagagaagagaggagacttgaagaaggaattctaagtaagggttaaggttgagtggaaaaaagaagaagaatcagaaggaagtggtttcatagtaggataaatcaagtgctgagatgaagtcagttcactaacagactcagagttctattggatacggcatgaggttcttggtgtcaccatcttaggatctgctcatttttggggttttaagaacctgtctgaactccacttagccaactgaagcttgccttcaaagttaacacaatgtgctttctcccatataaaccttttaagctgtttctgatgactgttccccttcctgttagagctccacctcttttaatttagcctccatacctttagagtaaggtctgcaactttcttccttaattgacagtggagatcaatatgtaacccagattgcaaaaatggtttgggaacactgcatgttctcactcataggtgggagttgaacacatggacacagggtgggaaacatcacacactggggcctggcaggggatggggggctgggggagggatagcattaggagaaatacctaatgtaaatgacgagttgatgggtacagcaaaccaacatggcacatatatacctatgtaacaaacctgcacgttgtgcacatgtaccctagaacttaaagtataattttaaaaaaattttttaatagtttgggaagaaattgtgggcatgtcatttgcttgaacagattttgttccccagccagaggaccagagaagagtttgtcatggctacagtggaggaatcaaactcagaatagcatgtgaaaggcacattccacacagaaacttcggcccgtgcatcagcactgcagacagggggagaggaaatgaattctcagccagtagattcccaggcatcaccttgaggcagatatggcatattcttggccatagtctctacttctctaactgggcaaagtgtctaatcaactataacccaaaatatcttcccacatggcataagtgtcgaattcatacatagatcagagggagaaatgaaattgtggttgtcttaaaagtttacacagtttagggatctccatcatgaaaaatgatctaaataaatgaaatggtatttttactctttatcctacaagccctatacaaactaagtccataaatatcctatttgatgcttaaaccaaaagctttataaagagaatttcactatgtgaaataatgacttgaagaaatcctattgtggatgcttttgttaagttgctaaaccttttttaaaaagtagataatcatccaagatatcttctttgtgactcttaagttttagtgtatttcaaatgtggatagtttttgactaggaggtttgttcaaacgttcttctcgaccactagggggtgctctaaaggttagtgatgtctaaatgattgaccaatcaattaaaacaccgtgcccagttagcaatcatctccactgagagatgcctgctttaccaggctaaaaaaatgatctttatcatggcatagagactataaaagctgtgtccttttattttcattaacctaattagaagtcaagctaattgtaggacttcatagaactggcatcgggaatagcatgcaactgttaaaaaaatcatggtcttgatgactaattatatcaggaaataatatgcaatataaatgaaaagagaagtgtatgttttttactttttcctttctgtttttaaaacatgctataaaatgttaagtataattaggacacaaaggaaaaattaaatctagttaacattaccttgaaaacttcttatttgccctgaaatctccagttctttggaagctaaaagcttgagacttctatatctggttgtcaggattagggtgattttatttgaattttctttattttcttctcaattttctatctatttactttgtaattacatttgaactatggatatgtaattagttttataaatagaaaaatcaaagctttataaaggaaaatatagcatcagcagacctgattgtcctacttaactcttccacaaactgttttaactatgggcaaggtacttcacttctttgccctttgcttctgtaaaatggttgggtgaaacgaatcttggcagtttgttccagctcttctaaagttccattttaaattttaccaggagacaaaaatggttcctattatgttcactcttgaagcatttattaaccctcacaattggccaggcactgtgcttggtgctattaaagatatctcacttagtatctgggctctgccttcaagggtttccggtcccccatggaaaagaagaccaagtgcacagatccatcccagccctacacaatgatactggaaagctgtatgtggaccagaaatgccaaaggaggttccatcaggaagaggggacttgtgctctgactctgctgtacccctgatcatatgttaccacttatttatgctttaaagaacatcctggcctggatgtttcacagtgtgttaaactgcaaggtagatttcctctttgtttccctggtctactgtatatatgccagtaagccttgtcaggtttcattatgagagatggctataatgcatccagattactaggaaaacacttggtctttgaaaagagctgtgtgtccctctaggtttgaaatgcaaagtcctaaggctttgttatattcaggacatatttcaccttcccaaagactagtctcagctcagacaggatgtatcttgcctgtgggcttgacacaggggttgctgggtgattgaattaacctctgacatcttctgggctgtgcaaaatgataagttcaaaaaaaaaatgcagccattagactccttctcattgtttcttccttgaagcctttgtaatctttcttaatgtggttaaattcaagttatttccagttcagacatggtgcaatcagatttcctcatgcgggtgcttttccactgtgacctctttgacgtcagtaactgtttcctgtttatttgaactccctgctcaccctgtagatgactttgtctgagaaaaataataaagcaacggtacttaggagaagttcaacactgctatctgttacggagatttccttctcctttcccccagccgtcaatagcactctgcagcttttcatacagcatgagcttgttattcatgtagaaatactccaaggcagttcttagaacttgggtaagtaagaatagatgtggctcccagcttaacattgccttaaagcaatagctacatttttcataacttttacgtgttatgtctatctttgaattatttccaaaaggtaatctgcatcctcactataattctgagtatggtggctatttcctactgccttggtttctggaatgatacatcttcaaatgcagtctttaaatcatagagacaacagattttttctttaaatggagacaaatctttgcaatctggttctgagattgaatcaactttatagaaaggaagaataactgctataaaaagtctcgcttacagtaatatgtttttagtacataaggagggcatttgttttgcaataataattattataaagcccctaaaatagaaaatatgaattaccagtcagtgttagaaaacttatcagaactgaaacctttgttagtatgttttggttatcaaatctagttttgtaaccccttgcttagcaagcatttcccagaaagaaaagtccttacccggtcaaggccattaccatatagcatcgggaaacatccctgtgtcccaacagctgggctaggactccttccacctccttcgaccctctatacccttgtcccacactgagggttgggggagctgctgcagttgctgtttcggctgctgtttcattcctgtccacttgtgagtgtgtgtgtacctccgccagtcttggaggtctgtgaaggaggcctcgagacccagtgcatgcagctcactgccacgtgtgccacagccacagccaaggggccttcctatgcctcatgcatcaggccctttggagccctgggagcagacggccatggcggctgaagctgcagtggatgcactcatgatgatgaggataataatagttgctaacatttcttgagcatttcacttatggtatgccagacactattcaaagcccttagcttaaatcatttaatcctcacaaacctgtgagttgggttgtcttattatccccattttgcagaagtgagttttgtgagagagaagctaaatacagcacagcaggagttgctcttggacctcaagcatcctggcccagagcccaggtgtcgccactgccctgggcttcctcttagtcataccagggacttgggcactgggcacaaaatctcctctttatataatgtagtggtaccaatagcttctattgattgagattcttttctgggcttggcactgtatgaggcacttggcttctggtttaatctttacatgatcactgtagttatagatgttattatcccagatttataaataaataaggaaacttcttaccccttaaaaatgggtgtgtgtgccatgcatggttgctcacgcctgtaatcccagcactttgggaggccgaggtaggattgcttgagcctaggagttcaagaccagcctgtgcaacacaaagatacccagtctatacaaaaaattagccagatgtggtggcacaaacctgtggtcccagccgcacaggaggctgaggttggaaggatcacttaagcccagaagttcagcgctgcagtgagccatgatcctgccactgccctccagcctgggtgacagagcaagaccctgtctcaaaaagaaaaacaaaaattgtgtgtattttagctgaaattctcctggtagcagaaaatttacttcaggtagtaagaaaactttcttaaggctatgcaaaaaaaagaactaaaaataaagattcagaggtacaacggatgtctcatgcaacccaagggcaggagttggccagctctctcggctgatctgaaaccagaaagacatgaggaaccctggcagttttgctcttggctcactcaccctccctgatctcttgtctctgcctcactctatgtttctgcttcattcttctccttcacccacccacctgtccatccacccacccagtctttctccactctcttatacccaggcatttcccacgtttacactgcaaaagcagtttccgtttcctaactcatgtttcctcagttcctgcacacagcctagactaaattaaaagctttttacctcagtttcagttttctggaaaagagactctgagcaggtgcagcttgatctaactggctgtgcacagatgctgagcgtttacccatgcggccaggctggagcatgggtaaatgctgaggaagggatcaccatgagctgagcagatgcctccaaagatgtttgccccagtgaccttacaggatcttgccctgcctggtccatgctcgctctccagtcactttccttagttagtatcatcttgtcactggtaccatcctggcatagcactttcatccacccggatgttatgtctcttgttcatacaaattgcccatcagctttaactcctatcgaacagcccttaatgagggggccttagggaatgcaccttacttatactgacagccattattcgggggatatttttagccccttgggcctggggaaggaatagttctgaactgatagccagggcagagagtggacccagactgcagcaggtcagtggcatcagagcaagtgacgacaggaattctattatcaccaggcagcagctcctctgcctcccacacctgtaactcacaccaggtgtgggacaaagggatttctgagttgctttcactcccaccggtgttcatcaccccatgttaatgacttgtacttgtggttggctgaatcagggacaaaagagaggagcagggacaaagggcttagccacttggctttagaagtgatgttaaaccggtctcctggccttgagatttcctaccacacaggtcagggcagacttcacctgacagaagccaaaagcctcaggtaaagctgtacagatgtgcaggctcagtttctaggaaaatggactttagaaaaaccaaaatggttctatgcacaggtttaaatacagaaacagtcatctttgccatctctgtctagagtgggatttgggaaacccctctctgccataggagtgactcactacaaccataatccatcttccagtacttccctaaatgcaggatttccaaaaaatgcttcacctagttgcttcacaattgaatttgtgaagcatgatttggtgtttgttgagtcatcagtgatactaattcttaaatagcacagactgagagtagagctgtaggtgagaggttatcttttgcctccttttagagcttcaaatacaggtctttgctttgtaaagggcattcactaaatatgagaagttttactcctttggaattaattttgctggagtgatttgcttttgtagctgatgttgttttattctatgtggcaagttccaacattactggagtctttttcaagccaagcaccatagctgcacctgttttaccccaggcactgggcttataattctagtagagactggtagtgagtgatcatgtttattaatggcagcagagaccctgcacttctcatttgtgggtgacctgtgaaagcacccctaagtagctttttgctttttctgcatttcattttgaaaacagcagtacagttacagcgaagcctcacactcacccactccagcgcttgacaacctgcctgccttcgcagtccctcccgtctgcctgacatcttacacttcaactgcacagtcttcctgacacctcccacctcagtccccactccagcctgacttgcataccctcatccttctaggctggggaattgactcctctcagaagcttccccccaaaccccacctgccaaattccacctccacctccaggctgctcagatgccctgctcggtgtccccataacaccttctgtacctctccactgcacttaacacactgtggcgatgtgctgtgtctgcatgtccatgagcttactgagagcagtgtggagtcatattagttttaggagactgggtccttacccaggccctggcgtaccacgtgtgtgtttagtaaacatttgtctttgttcagaaccttaaaggaaccaagaagatctctgcaagctgtagtagatgtcgtaaagcctgcgcaccaggctccaagtggagctgctgggacctgaaccagagccagccgattttcactgtggatgccattccaacaagcctggttacctcaggcagcagaaaggccattatgggacatgggtggttactcgtgtcccttaataatgggcaacaaggatgcaacaatttctttttgtagctgctttctgactcccattgcctaaacaagggctctctcaaacagcctcacaactgtgtctttcccatgtcttatcttccatctttcagatgaaaataagaaaaacatggaggaagcacatgtgactttagtttgcttctaattgcaagagtaatacacactcatcatagaaactttgaaagatactgaaaggtagaaaaaagaaatgtcaccccgatcccacaacaaaaaactgacttctgtcactctatagccatcttttttatcctttctatgcatctgtctgcatttttggctataactaaaatcatcctgcacattcacgtttgtgatctttttttaaattgaaaatacctacatgagagcacaagcattggcagcttcagcagcagctatcacttactgcacacttgcccgaagggacctgaggacatacttaatacaattttacttctgatgatgactcctcaccccaccacccaccacctgatgatgtgtgggtcttctttccttttcctttttttttttttttttttttttgagacagagtccccctctgtctcccaggctggagtgcatggcgcgatcttggctcactgcaacctctgcatcccgggttcaagtgattctcctgcctcagcctcccaagtagctggaattagaggtgcatgccaccatgcccagctaattttcttgtacttttagtagagacggggtttcaccacgttgcccaggctggttttgaacttctgacctcgagtgatctgcccgcctcagcctcccaaagtgctgggatgacaggcatgagccaccacgcctggcctggatcttcttttctaaacactagagattttttgtcgtttatctccttctcttcaaaagtaatcttggagaaattgctgccaaatctttgcctctctgcagcaaacattttaaaatggggtgaacagaagtgcaggtcaacagagggtttcctcacagcaaaaacattttgcttgttgataaacatgtctttgttttttatacctggtgacgttatttgaggtctttgataggatggaccagtactctgcattaagtcgtcgtcgtgtctcagctggcctgtgtctcctgcctgcttcaagagttgctcataacctgagggctgtgaattacactctgtgttccaggtggtgccagacaggaggttagaaatgagactctgaatgaaaagaaacaggtacagcagaacccatctttctggaattctaaagcttatggtccctcactgtgtagcagaggtgaatctgccagagtctggcattatctgagaatctgcctccagggctgtagatggggctgggctaaagcaagactagagggcaggattttctccccccagatctggaatttagcccacagtctggcttttagattttaggctttcgatgcctactgccttaaaactcttgccaagtgcgccacttatagcagcctaaggaatggccacttccccactgacccagttccagtagccaggtgttcagagcaattggaattcatgtgactgccagtcagatccacgaggaagatgaacaggctggttaacgaaaacatgtaagactgacctccttgcccagagatgattcagggtggctttttgtcttagtcttcctcaggccatcagtggccatccctccaaatggacagatacagcattggcataaaaccttactatgcagatgcagctttttgggatgtttccggtgtgtgtatatcctccgcccaacctgttgctaacctgctaattctaccttaatccttcccatttagaaaatacaggacagccattgctcatcaaagcttgtcccacccaattctgcctctccccttgtcagtcaccctcaaatgaaggccaggagcttaggcagatggcttgctgtatttacatagtttgcctgttggcttacattggccaacccgaagagttgttttggtggtggtggtttttgttttgtgaatcttgccattccttcttcactattaaattcttgcttcgcttttagcagaaagaagtgtttaataaattcaggggatttttttttcttctaattaaggcgttagttaaaatagggcataggaggtcataagccgtgcttccttctgataggggtctgcgtggttacaccaggcttgcaatgggagctgagcaggagcacgcaccctgctctgcccattgttcagctgtgaatgtgtggaaacaccctgtgcaaagccggtggcacttacaaccacaaataaagataggttcaaggctgggtgtggtagctcatgcctgtaatcccagcactttgggaggttgaggtgggagtattgcttgagctcaggactcgagaccagcctgggcaatataatgagaccccatctctactaaaaatcaaagccgggtgtggtggcgcacgcctgtagtcccaactactccagaggctgaggtaggaggattgcttgagccctggaggtcaaggctgcagtgagccaagatcgtgccactgcacttcagcttgggtgacagaatgagaccctgtctcacccaaaaataatgataggttctgtgtatctgcatccgttggtaaaataccactttcctcgcaaaataatctgcaatcccacaaaatggtatcacggggtcccaagtcgatggcactcatcctgtgggccttagctcatgtttcccttgctcagagacgtcgcctgacccccaggcaggtgaccagatatcacgcttcctctgcttttccttcacaggatttaccagaatttgtcaatctgcttgtgtcacttttttttttttttttttttttgagtaatgtgtttctcacaccaaactctgtatggggagaggctgtgtctgctctactctctatgggatcccggctccgaactcagcaccagctaatcaggaatttcataaatgtcacaggaaggagtgaggaaacccatttatcttagaggtgcttgaagcaaaacgttttacacttagataaatcttggatcactttttaaatgagacctacacgtttctttcatgaagcagtcatgatttccatagcactttattcacactacttgcatagtatttagtacactgcatagtgacttttaagagtccacttttacctgctaggttgagagtcacttaagggggagatggcatctcgctcatttctacattccgactcttgactcaatcttttgaaggactgagtggtatttccaatgtggatgctactgtgaggctgtcatttggcttcctttttttttttttttttttggaagaaggagtcttactcctgtcgctcaggtgggagtgccgtggcacaatcacagctcattgcagcctttacttcccgggctcaggtgatcctcctgcctaattttttttttatttttttgtatagacaacctcttgctatattgcccaggctggtcttgaacccctgggctcaagggatccacccacataggcctcccaaattggtaggattacaggcatgagccactgcacccggcctccacttctgtttggctgacttgtctaaaggggtgttctttttctgtgattgttctctgcccatttgtgagaactagagcacctgctaggtgtcctttactttgggtaattaaccccacatgttccagattaaaggcatttacctttcgatttacattctctctccaggtacatgacctttaaggtacagagctggaactcgagtcaaaggtttctgatgccttctgtacttttgatttcatgtagcaattcaaggctgtgtgaaatgaactacaggagatccaggtgctgctctgcccaggggatctaatcccaccagaccggttgcactgcaccctgacccatggtcaggatgtttcctggaatacatccacttgacagtgtcctctctatgccacagccttaggcaatatgctgctgatggagctctaggttaattgctacaccacattgggccctctcttgtgtttgtatccaggatcgtctgttttttgtgatggagtttgtgaatgggggtgacttgatgttccacattcagaagtctcgtcgttttgatgaagcacgagctcgcttctatgctgcagaaatcatttcggctctcatgttcctccatgataaaggaatcatctataggtgagttttggttgctgccctgtcttctaattcactgcctcttccctctcctggtatgatccatccttccacttctcatgataatcagttgaaaccttttttggaattaaattcacagaagttttgttttggtttttgtttttgagacagggtctcactccatagcccgggctggagtgcagtggcgcaatcatggctcactgcagccggtccatctggacctcccaagtagatagctgggactacaggcacgcaccactacacatggctaatttttattttttattttttgtagagacaggggtcttgcaatgttgcccaggcttcacaaaggttccaaggatccattaggataaattaataacagtaataaacactgcctgcaatctaaaatttgcctcactttgtattcataaaataggcccgacagtctcagaagagactgtttattcatgaattggttcagccccagtttgctaaggacctgtcatagccaagacctgcagggtgctaaacacactgttgttctctttttttcattttaacatttgaagtgaatcccttaaccatgattctattccattttaagaatctacaccttaactaaagggtgtggctaacctgctctaagttacaagaattacagtcatgtggagcatggctcaccagtcaggagctaggtgagccacttgtgagcagtgtcctgcatgataatatcttccgtgtgtagccccctcccaaatatttgattctccattttgtgacacacaatcttttgatcataatataccatactttgaatggactccgaatctgcttgatgttgttaagtctcagaattcaacagatatcaaatgtaactttagtcagagagaaggttggagacagtgagaagtgtaatagtgaatgttagataatttttattctcacattttcctgtttttttttctgctgttagtgtcctcacctaattgcacatatgctcttttttcttttttattgttttatttcttttctttctttctttctttttttttttttaagacagtgtcttgctattttggctaggtcggtcttgaactcctggcctcaagcaatcctcccaccttggcctcctaaagtgctaggattacaggcatgagtcaccacacccagctcacataaactctttttctcttgagatgcaattgttgctttccttagagaaaaattttcgtatattaggggcatgaatgccaaagtaaaggatttcctgattgaaatttgctatttattaaccttgttaaatgcagttcctatcataaactcatgacagtattgacatcattattaaattataagagctttaaaaacagtgaatattcttaaataccgtgggagtcaaaataggaagagaacaagtagtaactctcttagagagagtgcagtaagactggtgggtggtgctggagataagtgggaacgcaagcactgcatagcaggtgtggcaggtaccacagagacacttctctaattcattctcagtgcagatcccctagacctcaactccatacagtgcatttatcacagcctcacggcactgtgcaggagggaagagggtgcagaactgggaaccagcctggataaggacagtgggagccacctgtttgaaagcagtctaggatctctgctcgttcttaggtcacggggctgcagcaggttgattaggcagcttgttttgagctttcttgaccaggctgtggggattagatcacagcatttttttcccactctccactttctttccagtgtatgctttgtggaggttgctggtatgatctctgatggtgaagggagttaagcgtcgtcctcatgctatcagactccaggcagtaaattccatttttgttctcctctccgcggctaatccagccatctccactccgcttgccccgaagagagacgtttccacatgtagttttaaaaactacatgtaagtaatgactcccctacttgacagggacttctgctgcagatcaaaataatattaacaacaagacctaactgaacacttggactgggtgtggtgactcacacctctaatcccagcacctcggaaggctgagcggggaggatcgcttgagcctggaagtttgaggccagccggggcaacataaggagacccctatctctacaaaaaaaaaaaaacatatacatatatgttaaaaaattagccagccgggcgcggtggctcacgcctgtaatcccagcactctgggaggccgaggcgggcggatcacgaggtcaggagatcgagaccatcctggctaacaccctgaaaccctgtctctactaaaaatacaaaaaattagccgggcaaggtggcgggtgcctgtagtcccagctactcgggaggctgaggcagaagaatagtgtgaaccgcagggggcggagcctgcagtgagccgagatcgcgccaccgcactccagcctgggcgacagcgagactccgtctcaaaaaaaaaaaaaagaaaaaaattcggcaggcatggtggcatgcacctgtggtcctagctacttgggaggctgaggtgggagaattgcttgagcccaggagattgaggctgcagtgagctgtaactgtgccactgtattccagcctgggtgacagagcaagaccctgagtgtcaatcaatcaataaatcaataaaacgagcacttgttacaggaccagcacttcccttgcattcgtctattgattcttctaacaatattattgtataacaataatagtgtccacactgttccgatgaataattaggtcttccaaagacttcatcaccagactgctaactggtagtgaagtcagaattcaaaccatggttctaaccactgggctacactgtcttctcaggagagacttgaggatttagagtaccattacagtgtcagcttcttagtcctttttggtgataggaccacttcaattcctgaaaataaggtagagtgggcaaaagcaattcagtcttatctcaagctttcttgaatcctcagaggctttgagttgggccgagcagcaagcttcctttccttcattggatattaccgcccctcagtctacttgtctcatttgtctcaaaatatggtgggtagacactgtaacttgatgtggtttctgatgaagcagtgccagcccccatcttgacaaattttatttcaattcatggtgtctgtggttcagttctgagaattgattttaatttactcttggacttgaatcccatgttcaggctctaactgatatggttgactttgaagggaacacagttaattaggatagattcaaatgctatttttatcccttggatttatttcacaggataatttaattccattcagtatacaggctgggaacagagtcttaaggataagactttgaaagccaagtccttggaattcacacacagtaaagggcacatttgggtcacagagggtgtggttttgatacaagagcccagtgagaaacttgggagtatcaggcagcctcttttatcatacatgtcccagaacgccctttatcagagctaaaataatcccccagaagatgcctctgacctatccaaacagagctgttgtttgtctgtttggattctttgagggaggggagggagagaggtgtttattttccagcaggttacaaagatgataccatatgcaagtcactgttaaagaaagcttcagaaggtagtaccttaggctcctctgacacaaatttcttctttagctgcctgtgcctgtgcaagaggacatgggccagttacgtttgcacgcattccgtcttgtgttctgaccctgattctcagatgtattcacttgtattttgtggaggaacagaagcccagttcctaggagactcagcaagggaagggcctgcctctctgcctttggttggagggtctggaacctgccatggcccagaaaccaagaagagtaggctgggaaggaggcagtcatcaagtcagttctcccaaggggaaaaaaagaagactattcattcttttgtcctgggcttcttggccgattggaaggccagacagtgctcatgaataatttactcatggtgttgacttttttccggagtcaagccctacagaaaagtaagggaaacaaaggggcatgcatcccattgaccagacatctttcagcatgtttcatcaactgtattaaagggaaactcagctgtcattgacatttcaaccccaaactcctgaagccagccagcacacatttgattggctgtttttgacaaagtgtggaatactgtatctgaaatatgttgggtgaggaatagtttatagaagggcacagtttaaatttcacttcctcctcaccatgttacccctgggcacacagcactttccaacacatgcttttcgactcatgagtctgactgctttgtgccttatgcagctgttggcatgctgggtgcacggtaattagtgtttaccctgaaagctccaaatgcttcccgtggtatttcgccatcccattttgcagatgtggcccacagaggaagcttttgccccacagaggctcactgccaactctgacatgccgccttttactcccatgattacgtggcacatgaacttttcaactttgagctgctgatttctcctcagattgagagaaaaatgtctacttaatttgactcttttaaaaattcagaatttgggaagagtagcaatctcactcgcaagattaagccctgttaagctagtctctgaacatagttgggggatctgtgtgaatataccgatcaccaacatcatctagctcttgtttctcaagaatcatgagggtccacaggtgcctcgctgactccagataactcagctgggcatagccttgcttggcaagtggtctcctctgtgagcaccacttcctggtctaagaattcacaagtgatccgtttccaaatgaatttgtgtgttggggccaggcacagtggcctatgcctgtaatcccagcattttgtgaggccaaggtgggcagatctgttgagtctaggggttcaagaccagcgtaggcaacataaggagaccctgtctctataaaaaatacaaaaattaggtgggcatggtgtagtgcacacctgtgtagtcccagctactcgggaggctgagatgggaggatcacttgagcacgggaggtgtaggttgcagtgagccaaaattgcaccactgtactccaacctgggtgacagagtgagaccctgtctcaaaaaaacaaaaacaaacaaaaaaaaatggtgtcttgggccagtgatggattttacatgcctgagttactgtgcactctctctctctccctgcagttcttcccctctggaaaactgtggcaatctctctctgattcccacctcctaggacctctcttactcctcagtatttcttatcagcagactttgagtccccagatgtctttcatttgagcctggagttttgggctcttactgtcacctcacctctattggaattcagttctgtatttatattcattctactcattctagtgaggaaaatctttttagataaagatgaaagtaaaatttaacagctctcttttccctttgtcatctgctggcattattccttctgctgcaagaagtaggtctcttctctcttgatttgcgtactgcagagactactacaaattgtcatttgttgtttgtatagtccttgtttattcagtacatgccagccatgggaatgctcagtatattagtaactttcacatcagactttggctgtgagccctcacctgggactgatactggctctttgagctttttagtcatgtgcttgtctcttctcttacttagcttgtcatgccttgctgtgccatggtggcctcattcagtgactgctcttcaactctcaccagaaagtgaccaccattcctgacttccaagatccttcttcaaggatatgatggagagctcagagctttccagcttcttagagtagctcagcatttccctcaaatggggtcttcccttttcccgtagtgaaactcatcagccactgttctgcacccttgcatggcctctggagatcttttaacaagtatttgttgagcgtcacccttctgccaaggatatggatgtaatggtatgagcaaaaacaaaaatactcgccagtggagggtatgatccagtgagggagaaagatgtcaatcaaatgattataccaataaaaagtagcaaccatgactagtgctatgaagaggagaaatacaatgcagtgaatgagaacctagaatagggtgattctatccagttagggaaagatggaagatttttataaggaagtgactcttgggctgaggtcacggtaaagagggaaggaaggaacatttgagacagaagaaacagcaaacgcagatagatgcccagtaacaggaaggagtgtggcaaggtcaggggtttttagagcaggccagcctggctggagtctaggaagcgtatcttacttcacttggcattttattatcctacagtgttcagtcagctgatgacttcaagattttattaaacactccttgtaaataatttatttgaaggttaggtaaggccggtcatgttgccaatccctggaggagccatctattcacagtgagttctctgtgtccaggtctgtgcatttatactcaacaatgggtttataaaatattagagccagaggagacctcaaacgttgctaagggccaagttatcttttacagatgagggacttcaggtgtgaaacgtccaaaaattgtttctcatagtggatattctcttcggatgactcatctgctgtttgctttccatctccaggaaaacaaaaatatggctagaaaattttgtttcagtcttcaacttacagctggcatgaagagcaaaccaagacattttgaggcattcaaccctgtttactccattgcagtgagaaaaatccagttgagatcagaacatatttcctgagctgccacctagtgccggatgttgcattaggaggtgtagatacaagatgagtagatgagatgtctgccctttgaggcgctttctgtggggtgagagagatagccattaataagtcatggcagctgggttccaaaattggagttttcccagggtatcttgggagcagacagaatggccacttgccctaagatggatgttcaggcaaacttcctggaggaggtgatgcctgagctgagtgtgaagagttaaaagctgaacaaagataaggagggtgtttaggtaggggagcaagtttgagcaaagcagagaagtgtggtgaatgtgtagttaaagtggaaaatgacaggaactttggtagcactggagcctgaagttggaggcatgggaagagggaaggctagaggaggctgcagaaatgaagtattaagcacttactgttcttgagatgtttgaattctgggtcacttaggactttgctccattgcctatcacaggaaacataaaaatgacagtggcttaagccagatggaaacatagtgctctctcacatgaaaagcctggaggtaggtagtccagccccgccatggaagctccgtggagtcatttgcaacccagatttctgtgctttctgttctgctgtagacagggtcacgtccttgtctaaatggttgctgaagatctaggaatcatctctctattccaattccatgtagtaagaagggctagagggcattcctccaaactgagtcagctccctttaaggggcctcctggaattccacacagtacttaccatggaattggccagaacttgatcatatggctgagtctagctccagtgaaagccaagaaatacagtattacaagtggccatgttccagctaaaaatcagcattccattattaagaagggaaagaatcattatttgatagaaaacttgcagtgtcagacacaaattccatgccagggagtctgggctttatggagcaggtaacctttgaagaattctcagcaggtcttatgacatgagtggatttatattttacttttacgtgcgggtggggggcatggcatgtgtggacatacccatggtaagcagcagccaggttgcaagggagaggttcattttgaggcagttgcagagttccaagtaacaagataatgaggacctgaactaagacagtgatggtagggctgatgagaaaggcataagagataatagcaagtaaagctgataggacttagtatttgggtggattcagggtaaaaaagaaaccggaaatcatttccaggtgtttagctagaaggttgagtggatggcagtgccattagctaggagagatcatgtgcctaggaagaagtctaggcaaaagaggaagaagttttagaaaggttgtatgacaggtgcctgaggtatactccagtggagatgctccatggataggggcataggagtctgaagctcagtaaagaggatgggctgaattaaatatttggaagtcatcaggacatagctattagttgagaccacgagactgaatgagatcacccaataggagtctcttaaatggaacagtgtgagtcaaggacagaaccctggggaaccagactccattagaaatctgcctaaatttggctccagggttatagaaacaattggtatgttcatcatttagagtaagtatccccaaagtgccagtgtattaaaaatataattccataaaagtatagaaaaagatcacttactttagagtatgtgtgtgacgctacatatattcttcctactgaaagaatgctggacatggttttcagaagccctgcatgctagacccagccctggtcctggggatgtgggcaggttgctgaatgcccctagccctttggcccatctgtacagtggaggtgccattgacacagcttcccagcagggtccttgtaaaactcaaatcagatggaagtggaaatgcgaatgctttttggaacatgccgtgtcaatataagaggttatctttgcatatgtgctgtcacctgatttgggttttcttggtatccataggcataggcagcaattattctcaagacactgcctgaataacaggtaattcttcatagaaattggagttttagcttgtaaaaatcaaccttctgaagaccagtctctatagtaaactctggtcatgcttttctttgaaaccaaatcattttctctgtattttcacaatattttggaattgcaagtgattgatatacttaccatgaacttaccataaacccttgagataattttcttaggaagtcctagggcatatgtgacaggttgtacaacctgaagactatactctggcattttgcttcaatttcaacagtttctaatgtttaggggaagcagttgacctcattttgagtttacgccttctggtattaaagcagatgtttgatggttaatttgagaggagattcaagaaccttttcagaccattagtggagtgaacatcctgagggtgtaatcccagtaatgcagtttctcaaaggacctaactttataacagatagacatttaagtcctgggacaccttgatcatttttctgtacttcatatattaaaccagaatgctgatcctggcatacctcctcagggtttggccttttcatcagtgaaggctgtgactatttggaactaattgataaatgtgttagtggctttcaccagctaatgaaaccaggccaccagttttgctcttcttcccaccaaattgaccaagcaaccaattgcttcattataattacagagaatcttggatttatttgctgaacaagaaaaatacagtcatttaatctttatgtattaaatgaacacaaccatttgtaaaaagtaattgaattgtacagttcaacaaatgtttatgaaaagtctacccaatgcaaacctttgtcaggctcttagggagtaaaagaagaataaagacaggtcctgccctcgagcttggggtgtttgttctttccgttaacaaataatttttttgttgttgggcactcactgtgtaccagacgctactgtgagctctggaaaaatacaggaaataaaacagacaaaaccccctcctctcagggagcttaacttctagcacaagtagtaggacaaaatatagaaagaacacaaaagtaggacaaaagacaaaaatatattgaatgttagggtgattcagtatatggataaaaaacttggtaggagcaatataaaattcagtaacaaagatttactgtttgacacagagatttttaaaagcttctctgataagggacatttgagcagatgaacaaagacctaaggatgggaggaggcagctccatgtgaatatctgggagaagagtgttctaggccaagtccttggagggagagtgcgcagtgggatcaaggagcagcagagggaccagtgggctggagcagatgaattcgggcgtcatgggcgtcgagggcccaagcctttttgttttctttctgcaatacagaatgctaaccacatgtgttgagcatttgtcctgtaaggataaactcctctgtttaattgtatcttctgtatgacagttgcacaaggtaagtggcattatccttattttgcagacaaaggtcagtgacattatcctatatttgaggctctgggaagtgaaaggacttgttcaaggtcacacagtatgtggtggaatctacaattccactccatgatatccttttgaatccatgcaggtgctgagttccctcacccatcaggcctttccacacgtttccccctgcttagaatgctcccccatctctttgccaagcttccagctaccaattcttgcagtctcatcttagtcatcacctcctctgataagcctttcctggactcccctaccctccagattccatctaggttaggtgccccctctgttcccatggcatcccgtgaaacccttcccttagtgctttccataggctgtgcccctgtgcatatgggttcatgaaggcagggactgtggctgtccaagcccagcccctaggacaatgacaggagagttaggtgttcttaggtgttcatggaattgaccaaggcctcaaattctacgctttttttattttaagatgacaggtcagggctgagaatatattatgattgctaccatttattgagcatctactacgagccaggctctattctgagctctctgcattaactcacctactcctcatgacagcgctatgatatgacactcagcttgggaagagctgcccattgattgtcttattctggcccaaacccatgattttctcataactcaaagcagtcttttttaaataaatgaaagccttctggaaagtttctctgattgaccgaaaaggatgtttgcacatctgtagtagtgatgcatttatatcctcatacatatttatttggatctgacttcgattctttccttagaacagattcctggaaaggcacacaaattaacgacttttagagctggcattgtggataagagctggggctcctgagtagaatggacctgggtgtttccagtcttggttctgccacttctctgttgtgggatcttgatcaggttactttacctctctaagcctcagtttcttcaatgataaaatggaagtcctggaaatactcacctgagggtggttgttagaattaaatttgtgatgtggaggtgcatgtaaagcctttagcccagagcctggtatgtagtacatgctcagtgatgttcacttttaaacattctgtttgctaccacttttgggaaaagcatcaaacacatgttccagtgacgggtattggtgccatttttctagttcccctcatagatcttaagtgcacaattggataaattttgacatatgtacacattgtgtaatcaatactccaaatactatatggaacatttctgtcatcctagaaagtttttagtgcccctttcagttagtccccaaacacccccataggcacccagtgattctgtgttgatattataggctgtggatatccacattgaaactattgagtgtcttcaaagtagaattgcttctcaggagtgtccttttcagtataagaggatgggctctttaaactgactacatgagtgtaatggcagttatgatcagaagagactacccaaagaaagacttcatcccatcagtcagttttactctctgtagagaaaagtaattacaggaggataaacaccagcacatcaacagttgttgtctgaggtaatataggtgatttttattttctttttgatggttttcaaatgttctgtattgaacaagtgttgtctttttatcattaaaaaaatgccatcctatttatttatttatttagagatggagtctcactctgtcacccaggctggagtgcagtggcttgatctcagctcactgcagcctctcctcccgggctcaagcgattctcctgcctcagcctcccaagtgcctgggattgcagacatgcgccaccacactcggctaatttttgtatttttagtagagacggggtttcaccatgttggccaggctagtctcaaattcctgacctcaagtgatcccctacctgggcttcacaaagtgctgggattacaggcatgagccaccgcacctgggcagaaatgctattttagaagtgatctcatgtgatactatgtttttcaacatgatgtcagaaattggtaacctgctgttttatcagttaagttctgtcaagccccagcctcacgccgtgaccactccttgtctgtgaaacccagttctacagaagtcacaaagccattgtcttagtctgctcagtactgcttagtctgctgccataataaataccacagactggattccttgaacagaaatgtatttctcacagctctggagactgggaattccaagatctgggtgctggccaatttggttcctcatgagggctctcttcctggctttaaggtggctgccatcttgctgtgttctcatgcggtgaggggatggagagagcacaggctttctggtgtctcttgttataaggtcacaaattccatcatgagacctcacctttgtggcctcacctagccccaattatctcccaaaggccctacctccaaatgctatcacattagagcttagggcttcaatatatgaattctggcaggacacaaaacattcagtccattacagccattcattcatacacgtgtttggggttttcagttacattaagcaacatgttttgcagctacttggtttgatagtgccaaatctacccggaaatgatttcagccctaaggaaaacagctcctgctacagtggaacacacagtagacaggcacgagagaataaccaaggattagaccgaggcgttgtcatgcgtttggctcattaagccatgcatgttaggcttggagctctattttgaggtgtgttgagaccaaatccttctcctagatcccagtacttaagcctggcaggaaaaaaagctgagtacactgtggttttagagtgtaccttttgataaatagtttgcagcatgtccctgaaaggggaattttttcctttgtcttgcaaatgtcaaattgtacttttctgtaaactttgtaagtagaaatgtgaagtggtacaagtgctctgttgctttttggtgaaaatgctcacacatgatgaatttctcagttcagttgcaaagagaagttagtgaaacctaacaggcaaactaccccacaccctggagaacagtgtcctgggggtgtctggtttgctaggtgtgtggctggtgcagcaatgggaaggtggcgctttgactgcctggcccctcacatcttgctcctcccttttcactgctcctctggcctccagagtagccatgtaagcctgtgctttcacgtacagaattgctgctctaccctgttcttggcatttgcgtcaaaatttactgtgttccgctgacaaaattctagaatctcaaagctggaatggagttcaaagttatatacccttcttctttcaaagcatgaatatccaacatctgccgagcagtcatttttttccgtacttaaacacctataagcaaagaggaacttatacttcctccactttcagggatgtacggcttttggaaatttcgcctttctgttgactcaaacattgtttcccagtagcttcagttcactggttctggaccacctataaggggtagacttaaaaaaaaaaatacagctctcttacaagaaagctgtggagatatgtgaaggcagtctgggtctcccaatctagtttacctgttaacaaaggaaatactattagcctgatagtcgctcgttctggctgtttcttcaggattactgatttctcagtaatccataaaccatccatgttattaggcattctagatacttggatcaatatccggttgacttgtcacgttcttctcttacgaaatcagaactatctgaactagcagttggctaactgaactgagttatgttattatagctcatgttacttcttttgggtaagacttggtctttttttttgagacacggtctccctctgttgcccaggctggagtgcagcggtgcagctcactgcagcctagagctcctgggctcaaaccatcctcccacctcagcctcccaagtatctgggactacaagtgtgtaccagcacacccagctaatttttgtaatatttttagagatggggtctcgctatgttgcccaggctggtctcaaactcctgggctcaagcaaccctcccactgtggcctcctaaagtgctggaattacagcttgaaccaccatgcccatccttggtctttaactggatattgttgatgctgactatagagtagcaagcacggtggaaagttaattggtgtggtgatctcaaaaaaggatatttaaattttcctgttgtaaggatctcaggaatttaattcctgcatccatttgagagtatagcttcagcctgtatgtgcacatgaaaatagagaaggtagtcataaatcccagaactgaggatctctgtgcacagcccactctgcaaaggtggatattttcctctcaaatcaatctgtgacttgctcaagggtgaattaccaaagatgaaacatgggctgagcacgggggtgggatgggggagacaagaaaatcacctttgggtatgtcaaaatagaggtacctatggaactccttcaaatggtccatctcaaagttggaaataccaggataatgtttaagactggccacagactcaggttgattgcatggaacagcatgaaaatgagacagtattggcttacagttaagaacgaggctttgaagtcaaacttagatttaaaacttacccccacaatgtactgtaattctgtgatattgtaccaactctttaattctctaagcctccgtttcttaatctacatgaggataacagtactatccattccatggagttacagtgaaaattaattcatgtggcttgcttattccagtgtctgacatcagcaaatcctccatatacattatcagttgttaagaagaaaagtgatccagggaaggaaattaaacaatgaatttacttgaaagacagattccataaggaaattgttgaataaattatggttatacccgtactgtggaatattatgcaacaattaaaagaaagaatacattagatctacatatattgacctggatggtttgtccctgatagacaaataaatgaaaaaaagagagatgtgtgctcattttaatcccattaaaaaaaaaagcagtagcgaaagctacaccaagagtctcgtacgtttcctcatttgtcatggctacataagggcttgcatcttgagctcttttttgttcatttcatttgttatccctcaatttctggcacagggcatggcaatatttcttttttcttgtcttcatttctgttttatttctagcaactgagccaacatttgtctgcaggaattcatggtggggagtaagtgatgagaagatgggtggaaacacagtatcatttattgactaaagagcagtgtcactttaatttaattttaaaatgtaaattaatgcatatacataaaaaggacacttttagctgttctaaaatgattacagtgaatgctaaatcctcttcatacccttgtccccagtctctcaattcctcttcctcaagacatgtccttatatgtccttccagaaatggtctatgcatatgcaagctctgcatttgaatgtctcctgttgaaaaacaaatggtggtatattatctacctgaagaacagagattttttcctaagtctttagagagatgaaatctaaatccttaaagaaaggtagtaggtaggcaatcttttcttttcttttcttttcttttctttttttttttttttttccgagatggagtctcactctcactcaggcaggagtgcaatggcatggtcttcactcactgcaacctccacctcccaggttcaagtgattctcctacctcagcctcttgagtagctgggactatagcacatgccaccacacccggctaatttttgtatttttagtagagacgggtgtcactatgttggccaggctggtcgcaaactcctgacctcgtgatccgcacaccccagccttccaaagtgctgggattacagacatgagccaccatgcccattcaatcttttcttttatcagaagggtctatgggtgacagttcaagtcctggaaataattctgctatctcttgttggagaaagtgctggttttttcagatcaggcaacaggcttataaacgtttattgcagttacaagctacaaagaaagatttctttccagcactactgctccaggtagagcagttgcaccagtcattatttataactggattaaagagtagcagcacatacttctaccgtggttatagagtgccttctgttgtacagagtggactgcttattcaccagggagttctcaaacacctttctctatgggcgctgtcccaaataatgtcaagagagaaaaaattaaaaatgagctcctgccctctaagaacagatgggagcagccccaaatcttgcaaatgaagcaagagggggtattcagtctttaatccaagcagctagaagcttgcctttcccaagttcaccgagtgaggattttaacactcctttgacaaagaaatggggccgagcagcagaggaaggcaggtgacactgagtcatggaattcaccctttcgagcccttcctgggggatgtgtggctcttgggttggttcttgaaggaaaggaatgaatgtaagagaggaagggaagcaggctttttttttttttttttttttgactcctacacagaaggtggaattgagaaaaatatactgtggcggtgaaatcaacttacaaaactgaggaggaaaattttgacaaaagcaaacccaaaatctgattactgtggggctgtccattttattgctgcaccaaggagcagggtagatactattttggcctaaagaacactgaaattttgttttctcatttgcaaatagacaggttcaaacccgtcagaggccgtaactgagtttccctgtgactgatttgtatgtgtgttagtggttttttttttttttttcctgtaagaatctggttgagtaattcagaaggttaaaaaacaaccaaacagaaataagtgagaaaagttaactgaggtctgccacatatgccgggaaggtgcccacagactggcagaatctgtgcagtctttgtctgtttctgcctatgcaaatactaagccacgctcaacagagcttgagcgttgtatctgttcaactgccatttaagaaataggactctgttctcaacagcttattccttggggtttcagaatgtaaaatatgaagtgtgtataatcacaggccaggttcccagcatttctcggcatttcagctttggcaggaggaatgggaaaaactgaagtttttatgtccaggaaggctgagtgtaatctttgttctgtggcactgggaaaggaagtgaatctgttacaaagcgctttacctctgaagcatgtctcaggggcagctgtgctttgtgccatgtattctgttttcataaaaagaaagaggtagagtcgagggcttaccatgcagagtattttcacagtatctcacttgatatatcatccagggaaagtgacctgtgttatactttgtgttttaagatataactctagaatcaaaaacttaccagagaagctcaagatactttactttgcaagaattaattctcaagataaaaactcatcagagttcaagataagaagggttcaattaacaacacattttaaatggaagaattatttaaaaaattgttttaactttgaatgagcttagattaacttacctgttgcagaggtaggtcagaccccatgtcatcatttgcccagaaaagtcccagtttgctcccataatcccccttcatgacccattttactctcagaggcccattttgtttattgggtttttttttcttgagagagtctcgctctgttgcccagactggagtgcagtggtgcgatctcggctcactgcaacctccacctcctgggttcaagccattttcctgcttcagcctcctgagtagctgggattacaggtgctcaccaccacccccggctaatttttgttatttttagtagagatggggtctcactatattggccaggcaggtcttgaactcctgaatttaagtcatctactcacctcggcctcccaaagtgctgggattacaggcatgagccaccgcacccagccgtctgaggcccattttgggcggtacactgcatggtcatcatacaaagaggtgtctgcatttctacttttttttctttaagatggtagaaccaaacaaaaaagggtgtttttacaaattgagaggggtccctctgtaggaggggaatttctccagcattttcctttgatggagtattctcctctcgttcagaaataggaaatttagtaactaaagcattaagaacagatttattttttaacatcagtcactaccttagtttcagagacacactgggggaaattgcctttcccttacgcctcttgttttatgtcctttatatgagatgttaatatatttacatgaggtataaatttgtctgtaactttataggtttgtattcatttattaatccatccatccattcatttactcattcaacaaatgttaattgagacctattttttgcctggagatataatagtgaccacaataggcctgctccctgcccacaggaagcaggcattctagtgtaagcacacaaacaagtaaaagtaattaccaattgtgaaagttacatggaaggaaataagtgagcttttatttgtggttttatttcatagagctgaaggaagtgaagagacagatacctctctccccacttctttcattgctgaatgtctgaagtatttcttactccattggactactatgacagaacactatcgattgggtggcttgtaaacaacagaaaattatttctcagtgctctaaaggctggaaagtgcaaggtcaaggtaccagcagatttggtgtcgggtgagggcctgtttcttggttcacggatagctgccttctcactgagacttcacatggtggaagccgtgagagagctctctaggatttgtcttttcttttcttttcttttctttttttttttttttttttttttttttttgaggtggagtcttgctctatcgcccactgcaacctccacctaccggcttcaagcaattctcctgcctcagcctcctgagtagctgggattacaggcatgtgccaccacgcctggccaattttgtatttttagtagagatggggtttctgcatgttggtcaggctaatctcgaactcccgacctcaggtgatccacccgccttggcctgccaaagtgctgggattaggagcatgagccaccacgcccagccggatttcttttctaagggcgctaatcccattcacaagggctttaccttcatgacctagccacctcccaaaggacccacttccaaatacagtcacattgaaggttaagtttcaacataccaattttggggatacataaacattcagtctatagcagtattttatctggggtttcaaactcaaataccttcagagtagaggccaatggggacactcctgtctcatggttctaaccagaggggacttgcatatccattcacctaaagctccgttaagaaaggtgaggagccccgggccagacccacaggaagtgtccccaggttgcatttggctctggtcacatattcactttttccagagtccccaaggtatactttagttccacatcaatgcctaccaggcctggttcagtcttacatttcaataggtccccttgtgggtctcggagaaaaagagagcagcattagaattttactaccacagtgagtttttccacttcactttggaaacattgagctattcctacgcagtttggatgacagaaatactgtgctcagtgcaatctactggaaaatctgagtgcttggaaaaatgtcaggaatactctcttttgtcatggaatttctccatattgcggcggtacttcagtgtgagtcagcaggaggaacttcggtgcaccaagcaggcctcacatcagtggggttgtgagtcccagctctgattgaagtcaggggggtgggtaagtgatgtcctggccagtccagggatgggggctatttctagtgtgcaatgctggccctcctgaaccaaatgtgaacccccctggactctcgcatgagtttctctggaaagctcgtcttctcttctttacccaacccctccccctaccactcttccagaaagttgctcttcagaattccatgaaggatggaagcagccctgaactaactgccctggggctctttattctcaggctaccaagaaaagaaaaaaatgctaagaagcagggacctggctgcctgatcttccctatggtcactggctcttcttgaacaggcatgtaatgaaatagtgtggaacagtaagaaagctcctacaggcagaggccatccatgaagcctcttctcaggcaatggagtcttcaaatggaatgaccacagactgttttctttgaaggtgaatgcacatgtctaagccctaaattgccctgctaaaatcgtcttcccttggacaccaaaagcatagctgacaaaagcaaaaataagtgagagggagtacatcaaactaaaaagctgctgcataggacaggaaacacttgacaaaatggaaaggcaacctatggaaagggagaaaatagttgcagatctgataaggggttagtatccaaagcatataagcaacttatacaacccaatagcaaaaactaataataataacctgattaaaatggacaaaggacctgaatagacatttctccaaagaagatatgcacatggccagtaggtttatgaaaagttgctcaacatcactaaccatctgggaaatgcaaatgaaaaccacaatgaaatatcacctcatacgtgttaggatggttatccaaaaacctgaggacaagtgttggcaagggtgtggagaaaagggaaccctatgcactgttggtggaaatgtaaattggtgcagccactaagcaaaacaatatgtaggttcctcaaaaaaattacaaatagaactatcatatgacccagcaatcccattcctggatctataaccaaaggaattggaatctggatctcagagatgtctgcactctcatgatcattgcagcgttattcacgatagtcaaaatatggaaacaatctaaatgtccttctgcagacaaatagataaagaaaatttgctatggaatattattcagccttaaaaaagaaggaaatcctatcattccggacagtgtggatgggcctggaggagattatgccaaatgaaataaggcagacccagaaagacagatactgcatgatctcactcatatatggaatctaaaatagtcaaaatcatagaagcagggagtagaatggtggttgccaagggtggttgggggacagagaaatgggaagatgttgatcaaagggtacaaaatttcagttatgcaggataaacaagctctggaaatcctactgtacaacataagacctatgattaacaatgctgtactgtatacttaaaattttgctaagagagtacatcttaagtgctcttatcaccaagaaaaaaacacaaaggaggcaggaggaaacctttgaagattatgtacaggtttattgcactgacagtagtgatgattttacaggtatacacctctccaaacacatcaagttgcatacattaagtatctacagctttttgtatgtcagttattccttaataaagcagttatttttaaaaatcctcttccctttggtcccccagcctttaacatggcaattgacatggcaattgacatgataaaagctactgtatttccttgatttaaaaaaaccacagctcacaaaatgcccatgattgctgatttgattaaaacaactgtactagcagctggcaagtgtttttttagccactagttttaaggaacattcctgtttcagaagtatcaaaggggagggagcagcacagatcatagaatcaaagtgatacagagattagagttgtgttcccctctaggtagtgatagaggaattgtttcctctctaggcacagtgatagagggtggcttcgttaacagtattattaaggccatcttactgacagcaaaagggaaacaagacagagtcctgatagttgggtaaaaggatcagttaaatttgaaagcgcttccttttgtatgttctggtcagtcttctgcgggaggaggatgtataaagtccactgtgtcagaaaagcagtcagtctacccctccccagtttccatctgggtatctttgtgctcctggtcatttctttcccagaaattgggggatctggtctcagataagaggagtgggtttggatgtcccaatatcacatatggtaaggatgaaaaacatggataagatgattgagtttatcttgtatatgaggccatgtgttgtaaatggtctttttttgctaactttcttgactctctagatgtatcttgaggagtgaagcatgaggacactgttttactcagtcacaacctagagtcaagtttttttctgttattttctcaagacagtgctaccaattagattgtatgcatcccatttgtcctcatttgattcccatccatgttctcaccttctccaaggtgactgttattctgattaatgttcagattcctgtaatgcattgttagcattgggtgctggatctgagccagtccagggtctggagagctatgcagagatagaagtggactctagaaagaggcccccgaatcctgccattccctctccaaggtgccagagtttgcagtttccaggaattgcatgtgatgcagattgtaaattacgcgtaaatatgtatttgtgtcttaaatgacttttttagtttggagaatgcccttcaccctatgactggcataccgcaacacactcattagccctttgttggctgacactttgaaaacatgcagcctcaaagaccattgttaagtcatccatggggtttgtttgaccatgaaggagacttcttcacgattgagttaccaggttcaacaggtcctgggcatctgctttgtgctgtttacctctgaagatcaaaagataaatcagaatctttgctctcaggatttagtctactgggaattctaaacacacataaattgacgatgtaagatatggtaccataaatgctcagagtgaaatgcaaacagaatacagtgggtgcttagaaaaggcaactatgaatgttggctgggtgtggtggctcacgcctgtaatcccagtactttgggaggccagcgtgggcagatcacttgaggtcaggagttcgaaaccagccctgccaacatggtgagattctgtctctactaaaaatacaaaaataaataaataaaaataaaataaaataaaaactagccatgcatggtggtgggttcctctaatcccagctacttgggaggctgaggcaggaggatcacttgaatctgggaggcagaggttgcagtgagccaagatcgtgtcactgccctccatcctgggtgacaaagtgaggctccatctcaaaaaaacaaaacaaacaaaaacaaactatgaatgctgatggagaggttcagtggaggccttgaggagatgacacttgattctgatatgcaagttttccattaacagtgaaacagggaagtccatgctaggtagacatagcgacagggacagaggcgtggaggcagaaaagcgtcctgtgctaaggaatcatgaggactcggtatgatcagaggaccagagcctgggaaggagcagggcagagctggcagctgaggtagatgggggtgagaacctggaaggttttgaatgttgggctaggaagtgtgggctttattttatttgcctttcaatagaagccaacagaggtttttgaggaagagactaacgggaaataaatgcagtgtgttagagtaagtaacagaggagtaagcctggaagccaggagttcaagtaggaggtcttctcataggtcaggcaagaaacagtcacagcttggggcaagccagtaatggtgggaagagaaaggaaaagaggagggggagcgattcacatcgaagggagtctgatgatgtggttgggggaccaaggagtaggcgttaaagatgactccgagatttccagtgaaggagcttttaactgagtagggatagcaacagagtacagtttagtttttgtttttttgtgtttaaagaaacacttctggtagttttgcccataaagcagttagagatgcggcctggctctccggagagaggtgtcaggatagggatttagactggggagccatctgtctaagggaatacttgaactcacgggactcaactgcaaggtaaagtgtcaagcagggcaactgtgcacaactgggcagattgggccctgaacaaccctagggagtgccaccgtatcctagtcattgtagatttgtgcaatgattgaattttctggcagatggcagtcagatgtcttgagaaaggggcacctttttctaatgtgcacaaaggtaccatatggtgtggcaggaatgctggaagtaaacccaggcaagagccaagaacagaaccttagggaaccagctatcctataagggagggtggaggaggaggagcctccggaggagacacttaggggtggtgagagacttaggtaggatttaagtgtttagttgcctccaatttgcctgaaaatagagtcaccacacagtgaactctcatcttactttggtttaatgactcaagtagagcctctgctcatattatccatcagttcttccttttcacatagccggtgagttttccttggcactagcaagtgggatcattaactgtctccatttggttcggatgtagaattattaaacctgtggttctggtcttgagagccaatgcctggcaggtgactgtggcccagggtgaatacctgctgcaaagcctcctctagaaggcccactgcagagcctgcctggggagctcctaggagggcaaagggcaccctgccaggcaagtcacctgtcacacctggctccagccagctaggagtcagattggggcagccccccacccagaactgccagagcctctcggatggctcaagtcctcacctctgagggcctggcagggtgaagaacgctccttgcctcctgaaccatataagaaagaaaaggcatccccagagctatagcttggaggcttggctcctttatggcataaactacaaaggcgcacagcctccccgatgtgtgccaataagatggcataaatgcttcttgtggaagagaaggcttgtgccctgccttggcacatgatcctctgcccacacatgcttgtcattgctgcttcctggcgcttgtgacctcctttgcatcagtggaaagttacaggaggagagatagcaccacctttctagtcaggaatctgtcacgcaacccagatcaaaaacttcaagttcacttctgtgtcaacgggatcccgactctgtgggtggatagaacattgtgtggaaaggctgtaaaactcagagtgtaactgcagtttttatctgagtggctggaactctagcttgtttattacctagatcagacaggtaaaatgttctactttcaaataattcatgtttttcagatcttgaattttggtaaatttttttcatcagttgattctgtttcttaatttgaggaatagagttccttttctaatgggaaaatatatcacttgtcatgtctgtggtgctttcttgtgttctacaaactctacgtgagcataggctgtctggctctggggatcagaagcactcagggagctctgaggacaggatttcatatactacatcctgaaactgggcagatgatcacatgaccctttttttttttttttttttttttaaagcagggctcagaagcagagagagaaagagaatttttccacagcctcagagagaaaatccaggaaaatccaggagtagaactcatgaggctgaggttctggaactgtgttcccaaactgccttctctggaaaaaatgcagagggaaccagccgattcctagtaaaaaatttttgacttactgactttcaaaaagaaatgagttccatatgatgggaattgcattctttgatttggacttaaaggattttctgagcttttaaatggtttcctatgtaatattccatctcttctggtttgggagttttccatgaaatgcctttttaaaaaatacccaaagcatcaaatgagcttttcagcttgatgaagaacttaagaaatttcatcattccttttcttcctggctgaccttttaattttacacaagatatacaggagtgatttgtcttgtctggtttgtaaggatttttaatcaccagccacacacattagtcactggcttttgtacctacaagcccaattttctttgttttgggggttttttaaataagtttgtttgttcatttatttggagacatggatcctgttctgtcccccaggctggagtgcagtggcatgatcatatcctcaaactcctggattcacgtgatccttccacctcagtctcccaagtagctgggactacaggtacacaccaccacacccagctagttttaaaaaaaattttatagagacagggtctcactgtgttgcccaagctgacacttacagtaacagtaggatcagactgagagctggaaaaggaacagcgcaatgggattggtagcataaaagatttaccaccagatgcagaaagcagttctcaccattgcttcctcagttccttagcatccaccacgcgcagaactttacactttacactcaaggggtgtatgaataaagggaatgcaaccaaagtttaaggtaagaaactcagagcttgttcagttcagttagtacttaattggctacccagccttgtgccaggtaccttgttctggggctagagagctgaaataagcatggagaagatctgcagggaaaccaacagatgcaatcagtgcaagaaatgctgtcattagaagtgtgtaccaaacaccattggagcacaggcggagagacaccaaacttggcctaggaagggatgcagaggctttggagacagagaagcttcagttaagagtgaaaaagtcagcccaggagagaaatgagctcttccatttatctgtggtgataaatcaatgtgttttaatttttcctttttcagtccgtttaggaccaatactttttataaaatgtattaaaagtaaattactagaaaaatgaaatttccaaatacatataaaacagaagaccacatttttattattagattcagcggacttatattgtcatgtagtatgacagtatgatagtttgtcatactgtcaaatagtttcgaaaaactctgtgcctctacttttacctcaccatgggtcagcgccagtttgcagatgagcggcagtttgtggaccacactttgagtagcattgccctgggcagaggaggacatatgtgaggatatagtgattgactgatgtgagaaatgtggagggaatatcatcgtgtcccatcccatcgttttacagatgaggaaactgaggcccagaaaggtgacagagctaagaccagagtccctgctttctaactcgagacagttcttcttcttgtcctttgactaactcacctgaacagtcaccagatagcaccagcattccagcctgcctaccctgcttcacccacgcctactgcctctgaagaaagggaagaatctgtgtccatcagaacatgccggggataccaggacaccagcctgctgcccaacctggctgacccgtctgctcacggaccctgtcttaatgacagaagccactccaagagttcactgtgtcctgcagtagccagttaaattcatgtaaatcctgtttgggcagtcagtggaatttttaatactcttctcctttaaaaaaaaaaaaaaaaaaaggaacaaaggtttttctcatctataagccaaacatgagcaggcagtcaccaagcagggcaaattgttatctcttggaatcagtttggttctagactggtcttgaaggattgacgcctggtctggggtggacttgagagccacagagtatgctgtcctggtcttaggtcatccccaagacaggggacctctgcaggcaatagcagcttcacgttggctgtagaggtcccagatgggtcccagggtcccagcacaaaccagaatccacccagctccccccacatcctccctaatccttcctcactgcggtctcctgggaacctggccaaacccaatggtcagggagggagttgctgttcagattaatagccatttattatgggcctggtatttgcaaagcactgtgttaggcactgaagggaaccccgaaatataaagatatagaaacgaaggcaatgagtctcctcatggatattgcattttaggtggagaaataagtcatataacagcccagacgggattttgaaatttgttctctctgcctgcctcttttggtccccatgaccaaggaaggcaaacaccagtgcagtggcattgatataaattcttaaatgtgaacatggcacttggagttgattgcttatttgtgaaaatacatgataaaaatattcatagattcagacatgtcaaaaagattccttcatttatcacagagttgtttataacagtgaaaaatttaagaagtctgcaggtggccttgcatggtctgggtgttatcacaccactgagtgtcaaaccagcatctgctgttgggtatgggtcctaagcaatagacagggagggggtgaagaacaaggactggctgtacagttgaattttatttgattacgttgtgaagtacagatactgtttcacttcctgggaattttgtgttttatttctggagatttgaaattctccagaatggaaataaagttctccagccactgtggtggtgtggatggcaacagggttcagtgacttcccttatcctcgttcaacttattctacctagcagaaccagtcacctgtggtgaattcagtggcgtttgacagtctaggatgaaccgaatgaacctcaacttaaaccagctttttgtcattgtactgacctgggcacttgacactaaacagagatcttaattcctgtatcttcatgcatcagaatttggtcttagtggagatgtcaatagacgacggtgttgtggctggttgggtttaaccagttctggaggcattttgctcgttgcccaaggtactggtgccagaccatgtcactgtatgacccatctggctttggctcctggctctattacccagagagcagtttataagccagatgtgtcacttaatagtaggcatacctgcccaaaatgcaaaagcttacagtagttatctagaatttacgaagcttgtttttactctttatcagtgttgattcttataaaaatcatgacagtaggccatgtagatattatctttcttgttgatgaataaataatagccaagggctctacagcacttaatgcattccaggcgctatgctaaacctaattcacattaagtaactcatcatttctatgaggcaggaactgttgttatctacatttcttgatgaggaaataagcccagagtggttaagtaacttgcccaagatcacacagctagtaaaactaaaactaaactcggctaatcaggctctaaagtctgtgcccgtagcctcacaatatgctgcccattgaaatcagacagacagatgagatgtggtatgacctccccaagccacttgggtaggggagggaagcagattgagggaggcaactgtaaaagcatggttgggaagttgtccttggctcatctctctatatggcacagggctccaaactgaaatagccactattgggtcaagattagtccagcatttaggcaagaagaatgttagtccagtcatctgctacttttgctagcatgtatggtggtgacactttttaaactaaaagtaacacacataggctaaaaaataaatttttcctggtttttgaattctgtttacttttaagatcttaggaagttataatgactcacacttgcacatttaataatgacttttattaagaatgctatgacacaaaattagaaacattcttcagacagtgtctccacgtgtaagtacttaaagaaaacaactaaatggctatttgggaaaactgggccctttggttgcaaaaccaagtgctggggccggagtgagtgctcaagaagtaccagtgagttctcccaagggaaatttcttaggggaaaatgtgatgtcttttgcacatgttactatgatgtgagtccagtattggtaggaaatcagtaaaattccctgaactttactgtgtgtgttgccgtcttgtgtctagcccgtgattgacattctagagataatatgagaaatattccagacctgaccttagagtttgtaatccagttgggagaaacaaagccttttatgcaaaacataattagagaaccaagcaatatcatctataatctaaaagtaaaatgtgaggtatgtttttaattccaagagcctgtgagtggttctgaagtgcaagtgtcttcttgtgtttttcagaggtttgtgtttagatggctcaggtttaatctctaatggggatagcagggaaccagatgagacctgctgaggtggccacagtactgattctagtgggcaggctgcctcccctctgatactgtgtaaggcattactaatgctggcaacagtttgcatatagccaattgccaaaagcagcctgcacatccctcctgaggctggtcccgtaaattcttctctttcctgtcgtaaagcattcctcatcaccacctcccttttcacactttatgcaaggccgtgcactgggacagcaaatggctgcaactttcactgcttgcttttcccaagtcgaagaaaagttccaacgctggcaaagcaaggacattgctattttctgacaatcgaatgtcttcgaggaactagcttcagtgctgatagggtctgtgttcctctagtaagaatagcactgtttccattagaggggaccaggatgggtagacaggctaagacgtctgattactctttgctctgtgtatttgtatgacagctcgggtgtctggcttaccttcctgaggatgagagccatagcattatccatttaataacagccacagtgacagtgctgataatggctagcatttacctagcactgtgtgccctagaacatttaatagtttcactctatgaactcgtttgttggtcttcatgccatgtgtccaacataaagctagcaggacccatctgtccttgcccatgcttattctgtgccacagccacccctggttgtgattaagatattaatgttaaagagggaattgagttctgatttctcctcattcaaaaccattctgtcatcttcatgcacatgccctgcaggcagccagccagtaaggggtccttcatacctatcctgttcctggctggtggctctcagaatctgccatggctctttgatcctgtttgtcctcctgcccttgagtgactggctatcagaaaaccttcatttccttgttggattctgcctccaggaagcaaagccgacccagtggtttctgtgggtcagctgcacttggctgtctgcactggggaagagacttggcttgttggctgttttatgccctttggactgtcaggtccaagtgtactgttggccgcagcatccagtctgtgctatcagagcaaggcgctatggtcaggagacccttagccaccaaaggtctgttgtctcctggtgtctttgcctgaagacttctggccttcttgtgtttcatcactaagtgcatctataagctgacccgctgccaggtatcatgtctgagcattttggcaaggagagtcggtgagagaagttttcttggcaaccataaaataaaagtactatcaggagctgctaaataaatttgcaccgcttcagccagggaatttcagctctcctgggtgggatagtgataggggatgtggaatgcaaaaaaaaaaaagaaaaagaaaaagaaaaaaaattatgaggctcagctgtcagtttgatggctcatttatttgatggtcctaaggagatgtatgattggtacactgaggatgtttatcaaactcatttcctcttgtatttgtccagagagtcagcgaatggggttttttgggtatttttttctaccgtgagacaaagtgaggggaaatctctgagtccctttgctcaacttaagttggtcctgtgtatctgcagtggtgatggtgggaacacactgcctacatgtcaagggcatcaaacacccagaacaggatgaagaccaacacctagtctatgggaattagtttgtgagtctgtgccctgtttgtttgtttctttgtttcattattgttttttgagacaggatcttgctctgttgcccatgctggagtgcagtagcacaatcatagctcagtgtagcctccaacccctgggctcaagcaatcctctcaccccagcctcccaagtagctggacctacaggagtgtgccaccatacctggctaagttttttaaaaaattttgtatagctggacacaatggctcacacctgcaatcccagctctttggaaggctgaggagggaggatcacttgagcctaagagtttgggaccagcctgggcaatatagcaataccctatctctacaaaaaatttaaagattagccgggtgtggtgatgtgtgcctggagtgccaactacttggaggccgaggtgagaggatcgcttgggcccagacggtcgtggctgcagtgagctatgatcacgctgctgcactccagcctgggctacagaatgagattatgaatgaatgaatgaatgaatgaatgaatgaatgaatgaatgaataaataaaatttttgtagagacagggtctcactatgttgcctgggatggtcccaatctcctaggctcaagcaatcctcccaccctggccctgttttaaagagggtgaagtaaccagattcaaataggagtcatttttgtcatttctcatcccaggtagctgctgggaggaggtatgagggggtagtggggaagagcctcagaagagccttggcaacactttctgggctggaaattgttttactgactttcttcattataaaatgaagtattttacattcagcctcataatgatgaatgttcacatcttgtatacgtggtcttcagcaagatattccaataggtcagcctcaggaacaccagattaagtgtctgtgaggagaaatggcatagggacctcatttaataattaggaatgctgctgcttttagtaggaaattcattttcatacttaagttcattcagacttcagggacacattgtggggctattgaaaatataaatgccatccacgacaatcatagacacttagtagacattaagtaatttctgtggtaaaaaaaaaaaaaaatgagctgatggcaacaagttcaattctaagtctacaaatgtgcaggttctctaagcaaacaggatgtttttttccaacattcccttggagcctgggttccaaaagaaatcctttgcactctgaccaatgggtccttttccctgcacatcttccttgggaattatggccttaaatactacagaaaccaaaaaaaaaaaaaaaagaaagaaagattaaagctagaatatgtaaacacattttaatgactttttcctggttaacaaagtaatacatgattcctgtaggaaatttagaaaatccaaaacagaaaataaaaatcacccataaacatatcacctggaaatagacttttatgtttttcctcatctccttttttcctcctgtctttcctcctttttcctcctgtctttcctccttttctttatccctctctgtcacaattgtaacaaattaagagaatattgaaaatataattttgtatcctgttctttcacttagaattgtatgagcctataagtaagtcatgaaacccagaagctgtgaaggaaagattgataactggactatatcaaaacaaaacttcaaccaggcgataatatttacaacccatagaaccaatataaaaaattattactatcccataatatgagcttcttaaaaaaatcaaaaagataaacaactcaagtttttaaatggttaaaccatgtgaataggcaagaaaaaattcaaatggccattaaacatatattcttcttaaagcttaatctcattaatagtcaagaaatgaagttgaaacaatgagctcatttttcactggcggtttggcaagaattagaaggatgattccatctagcctgaacaaggaagccaaaacattgacactttcatgtgctactggtgggaatataaattgatgcaacccttttggaaaacagtttctctacatctgtttaaatttaaaatatttatgccctttgatatggcatttctacttctaaaaaaatgtatcctaaataaacactcccacaagtgtgcaaatcatgttcattactccattgtttgaagttgcaaaaaatttaaaacaacccaaatgtttatgtagaggaactggttaaattgtggtagatttttacagtggaattgtatgcaaccattatagagaatgagccagaggcataggagatataaatatgtccaagacaattgttgagaaaagtattttactgtataatattgtgttagtgtagcattgagaagaaaagtttgaaagactgaacccatcatcattttctctatacctttttcaggaatgatcaattttatataatgaaaatattacttttataatcaaaaaaacattttcagataacatttaaaaattctattataaacatttccttacatttttagtccttcataaaaatttggcagctttcataagattctgtcatagaaataccattatttatttagccattccacggttgatacataatttagctttttttcaaattatatatgatgcagcaaccaatatctttgtaaaataagattcttaattttacactcacaagagtatcatatcacatagcagagattgagaatttaacctgaaaataatccattgggtgattctgaatgtacaagattgatgtttttctaatctttttattttattttattaattttttttttttaagatagagtttcactctgttgcccaggctggagtgcaatggtgtgatcatggctcactgcagccttgacctcccaggctcaagtgatcttcccgcttcggcctcccaaagggctgggattcaggcgtaagccactgtgcccggccttaatctttttaaagcttacctggactataggtggcccatatggaggcaaaagatttgggccccactctctaggcacacagctctgctaccctactctaagtataatttgtcactagtttttgtagtctcagtgtaaaaaagagcagagatcttggcctcaggagatcctcttcccaaggctcagtcccaggctctctccttatttcattccttctcctgaggtgaactcatccacacccaggtaatgactctcaaatttatagctccgaaccagccttccctttgacatctagccatgtgtattcagctgcttaaatatctccacctgtatgtctaaaaaaagtagctcaatctgtccaaaataaattctgtgatccagaacctgctgatgcctccttccctttatcctttacatccttccattgctaaatcccattgctttcccccagtagttcttgacacatctagttctctttaccttaccaccctccctataccaggccaccatcatttatctcctggatactctagtagcttcccaaatgatctcctcatgttcattctcaactcctctgatatggagtcctgtaaaatcgaaaatctaatgccatccctctcctgagtcagagttttccatggtttattgggctaaagactgaaatcctcactggcccctgcctcatctggtccctgctctctcctgtctccatgctctcttctctcgccacccaggactccaaccacactagtcttcatttcttgactgaaccccctcacctctgttccttccttctgaaattctccttaccctcactttcccttctttctgtctcttcacttggttaataatcttcacagctcagttcaaatgtcactttcctgggaaatcttcccccagtgctaggtcaggccatcccttgatctattcccatgttttctcctcattgcactcatcacagttgataattgtaaatttagttgtgtggtgatctgtctgcttctcccaccagacattaacccccttgtgggtagagatggtgccccctttgcttactattgtatcccaacatcctggcatatggccaggctcatggacaatactaaagaatggttgggtgggtgaagggatggatatctcgtgtcaggtgatgcatgaatggcactactgtctaactcacgatgaaaccaaatgttatgcttttgctaattcagtgacttttcaaaagtcttttgcccatttaatacaatccatcttgctttgaaaaaactttaagtataaacccaggcactcaaaacacaagccagtcctaagtagttttattctaaaattaagaccataacccacattcactcacttggcagatgcccccttttcacacttacctacatgctagttcctcctcctcagtggaaggcagcaaatgatctgcacatttgaccacttgagagatttgctgtgcactcccctatgcctgtatcctcaaggactctgtaaaatccattgaactctatgcacaagctaagaaaaaaaccttgctttgcagtatttcgattatgcatttcatagtaatatgcataaaacatccctctatcatagtgccatcttagaatatttattgattccctcaggtggttcttgtttcaattaaagtccttttgggaaacaatctatccgggggattggccggtgacactgctacatagaagggattgggcctggtgtagtaagtcacaagcccaggccttggaggtgagcagaagtaaatctgaatcctgattttacccctgtctagctatataatcttggggtagagcctacttcatagagttattttgaggataaaataagaatatagataaagcacttagcatttgatgaacattcagtatatgttaaccactgaagacactgttattcttgttattcacaaaagcttttttccaggttttctagacagacccacagactcaccacccccaaatgagcaacagacaaatggcagtatgctgacaatcataaattgactgtgtattttatgataatgggtatcaaagttgtactctattaaagaattattatctttgagattcagatattaaaatgtgtatagatgaaatagctcatatcctggatttgtttcaaaataatctgataaaagatggatcagggagggagggagtcgatgtagcgagggagcatgtttggacgtgcattggcaggtgccgaggctgtgtgatcagtatgggagttgtgtcattctccctacttttgtctgttttgaaatttcccataataaaagttgaaaaatatgttaaaaatagttcatataaatagcctcctagattcattcttgttcaaggagccagctctcaactcgctttcctttatttcttttggaagagtaactgactctagtgatctaagcagtaagactcatgtcaatctgttttattactctcaggatagcttatggtggaaacaaaataaatccaatttctgaatctcctttgtcttcaatcacttgggaattctctctgaaactactgtgggcattttaagtaaccctgattacccagcaagaacaatgtagctttcagacaagcacagaggatagaataactctttctacccttctatgcttgcatgacaaaagctgtagctattaaataccggtgctcaatgagctaatgaatggcaagccggtaactgtggttttggcattttagtatttgagcctctgccctgtatgaacttgtaatcttcattgtgtagccttgttaagttcagctgctgagttacatgttggcataggaagctgaggtactcctaagccaaaaactgacctctgcatatttcaaactaaagtcaggaggcttagggtgacttcttttgctttaaaaaaaataaaggcatgatttccctttagagtggaagctgaccatgactgtaaatggctctataatctttggctttgtttgagtcaccctctccatgttctgctcttccgtttggatgcaagccaacatgaggataagtgttctgcttggtcctcgttgtttaataattgacccttcaaaaccactttctttctccagcttcatcaaagagaagaatttaaattttgatttcaggtttcttcttttccctcttgagtctatctttaaggggtaaaacatgtggctttttataagtttaagtactttggagcaaagtttatggagtgtccttccatcccctaaaaataagataggctctgagttggccagggcagtcccattggggtccatctgaaatgcttctgtttatccctttggtcagcacctcctgccaggaccatgctggagctgctaagaaggaagacaggtgcacagacagagccttctggaatacagtgcggggtatgctatcatagaagtataaactgggcaccctaggagcagagttgatattgctatgactgtctggggacatcaggacagacttcatagagcaggtatgagatacttgggctgagggcagcactggtagcctggaattacattatgctcttaattgaaccctcttgggatcccagtttgagcgatctgtcttattaaatagcacttggtatgagaacagccatggcgtttcctttacagctcatacagttctgagaatgcctaaaattagattgaaatcaggattaaggtgtctaacctgcctttgtggcctcgggcatcctgtgaccaggatgagtcacatccctgtcttgcccacttgcgtcttctgagagctgcgtcccaagacttccccatgcagagctgattgtaatagttgactgacaaaactgatggcccagcactttctctccctgcgcgattcctgctgcccatgacagcagctgagtaataagcagtcagacctcttacctgggacattagtcacaagctcttaagcaactgcgggtcaacgcttgagaccgttttggatttctgttagcacttgtttctgttgcccaagaagatcctttccaagacttcagcaggcatactggcttcgggaaaattcagaaactcagtgaccttgtttggaaatgtgagtgatagtgttctgggctcaggtccacacaggcctggcttgtcaggctaggacacagtgtcgataaagctgggctcatgggctttgtccccccggccgtgctctctcctggggctgcagactagtgtgtctaacctcagccaggcgcctctctactgtgtgcccgcagtcccagaggagccaggcacccaggccttatagtgcctcccaagtcagaaaacacttgtggaagaactgagagtggtggcctccttcactgggcaggaccacgatcatcctcacccctgctcccgtcctgcgctgctacgattgcaaccttttgtaggttaaactggctgtgctcatattgtatttatgtggtggggccaggggaggaagcagcttccacaaatcagcccactgaaaacagtcacttatatgggacatgggattctgcgtggagaagggctgatttggagccaggactgggtttgggttagagacacagaaagcttgcttcgctgaagtgggtgcacaggtactcagcatgcctttgccttatgcccctgacacccggggaggctgctactaagagcagagaagtctgttctatgttccattgatctgtgccatgaaagctttgctgctttaaccacacttattggggattcctggaataccagacttggtttccattcctgggcattttctagtggccattttctgtaagacctgtatggccaggctgtatcaactcacaggacagcgtgtggaaaccagtcatgccagttctgtcatcacctacctcctccaagccagcaacgtgatccaggctggacagagaccaaccttttgccttgggccatgcaggccaacagaccttgattctcacactgaggcaagaaaatagaacctcgagtgccctgacacaacccacagtgaatatggcactccagaaagagcagtcagctgcagccactgaggagacgccacagcgaggggggctccaggcggcccaaggccatggcagcctcccacaatggcagttaaccacaaagctccaggccacctagcatcccccccgtgacctgcagcctccttgtcactgatcagcctatgtgggttgcctctgagcatattgttcctttaaaaaccaaagtgtaaatgtctcacccaaaaggccaagctgttgctctgtccagtctagactgtgcctgtgaggctagcaatgccaccctccctctgtaacagtgccctggggtatgggtggcaacaggacaaccaggtgcttgtgctgggaagcgggtttttttaagagagcactgccttttatttacagacagctttatcagtacatggccatgttcctgccgaccttgaggactctttaccaaacaatcctgctgctgaatattcacttccttccacatgaatttgctcttagggattggaggaggggtggaaatgctttcaaccagtctccataatctaggcttcttgtgcacctggggtacccacaaacaaaccctgttctcactctggttttccttttcctgattaacatccccacaaacctactggatttaagacaaacccagaagtcatcatttctgctgcttctctctatccgtctatctctaagtgattatcaagccttattactgattttgctttcaccgaagccctgcttcctttcccctgactaactccttattttccattccattcatcactgtcctggttcaggtcttaacatctcttccctggacggtttcagcctcccccaactgatcttttcttgtccagccaggaatctgttactcccttaatgagggagcatcaatgagttccttttgcctaatatgtaaaaatcaaaattccttcgtgtgacattcaggacccttcatggtttgaaggacttaactttcctctgtagccctgagatttttcatggccccagcactcctctgtcctgtgctgcccgcccctcagcctcctccaccatacccagggttctctgagtccacctgcacagccatactgctgggcttgctgccgtgtccctgccccatccgcctgtccatggcggccttctcactccccttctctgcctgggagactctgactcatgctatcagacccagctcaatttctgcttctgctgtgaggctgtctctctctcctcccactagaaggaattgttctctcttatgtttctctcgtagcacttggttcataccttcatcgtgccactaggatgatacagcaattggtgtgttccccctccccacccctcctggtctatcctgtccatgtgtgtgtgtgtgtctgtctgtatatgaaatatatatctatttgttttacacacacacacacacacacacacacacacaaagtatttctttcttctcttttcattttagagacagggtctcaccctgtcgcccaggctggagttcagtgatgcactctcagctcactgcagcctcaacctcctgggctcaagtaatcctcccacctcagcctcccaagtatgtgggactacaggtgcatgccaccatgcccaactaatttttgtatttttcgtaggttgggatgttgcccatgttgtccaggctagtttcaaactcctgaactcaagcaatctgcctgcctcagcctcccaaagtgttgggattacaggcacccagccgacaagtatttcttaagtacattatgccaggcataatggcgccaggcataatggtgaaccgcataaacacaatccccgccgtcatggagcttctagcctagcaaatatttgtctcccattacactgtgagttccttgcagatgaagatcagctgtactcctagtgcctgtcaccaccccgggcacacagtggccacctcccctatgggtgttcattctgactccgatgggtagagatgggtgctagagtggaggatggggtataggctgagtatgaggtaagtggaaagcctagaaaagccacattctgccctccgtttttacaggacagcctacattttcctgtggtcagcccattcttaatgggcgcatcatcttggagccatgaggcaagttctgagacttgatctaaatgtgtcatccagatagcacagagaagtttgttccttttgacgtgtgtacaggaagctcatgcggccgcatgtggccgcacgtgtgtgtgtgtgtgtgtgtgtgtgtgtgtgtgcccattctgagaggtggatggtttggggtctggctgccctatctcgtgctgctctttgtatctttcagagatctgaaactggacaatgtcctgttggaccacgagggtcactgtaaactggcagacttcggaatgtgcaaggaggggatttgcaatggtgtcaccacggccacattctgtggcacgccagactatatcgctccagaggtgagtgcagctgcttgatgcagctctgaaatctgagctctccagtaactctgaccagaaatgccactggctgcttttatgcactgcagctttggaggcagcattgaaaggtgtctagagccgacacctctagactcatttatggctcattgggtgaatgatggctgaaaatggcctaagtccctctaataagaatttgagttaaaaaagaaaatcatgctgctataaagacacatgcacacgtatgtttattgcggcattattcacaatagcaaagacttggaaccaacccaaatgtccaacaatgatagactggattaagaaaatgtggcacatatacaccatggaatactatgcagccatgaaaaatggtgagttcatgtcctttgtagggacatggatgaaattggaaatcatcattctcagtaaactatcgcaagaacaaaaaaccaaacaccgcatattctcactcataggtgggaattgaacgatgagatcacatggacacaggaaggggaatatcacactctggggactgtggtggggtggggggaggggggagggatagcattgggagatatacctaatgctagatgacgagttagtgggtgcagcgcaccagcatggcacatgtatacatatgtaactaacctgcacaatgtgcgcatgtaccctaaaacttaaagtataataaaaaaaaatatatatatatatgtaaactttgcagttgctttgggctttagccctaaatgaagacaaagtgtacgccattcatggctatttattttcctttttgtctctacttagtgatttaatttcagcgtcatttagcagaactaaagaaaggctcttgaatccttgaatccttcccgtatgagtgagtgaacccagtccccttttttttccagactgatatatttccagaaccctttctgtttgggatctgcacgagcccatcacagtggcccaatcaggccataaatatttgctcacctagatgagaaggcacctctgagttgaccacagggaaaacagaccactctgtagaaatggaatgaaatacgcttgctagcacaggagacttttttaaaaaaactttgatatttcctaatgcatcaatttccctagttatgaagaacacatttgttaatctgatgtatgaaccaccttctcacgctgccccctttgcacagatcctccaggaaatgctgtacgggcctgcagtagactggtgggcaatgggcgtgttgctctatgagatgctctgtggtcacgcgccttttgaggcagagaacgaagatgacctctttgaggccatactgaatgatgaggtggtctaccctacctggctccatgaagatgccacagggatcctaaaatctgtaagtttggcttacccagctagcttctgatgtattgcaaaccagcttgtttcatgtgctgcttgagtcttttcagtacttcccaccagtaaaccactagctctaactaaaatttgtattgttctaatctaaagaatcaaagaaccagagttctgtcaggctgttaccctctcttatgcaatagaccctctcttatgcagtagttattttggggtcaatttcaatagcccttgataactttgtttgccaaatagcaagtatttctagcacttcgtaactttagttgagggcaggtgatgtttccccttcatacagtcaggccacaccagagttttgggtcaagtaaatgccattcccagcctgttattatatcaattgtgtttctgttggcatcttcaagttgcaggatgaagcggtcgggtctttctcttagggctgggagaggagaaggaaggttttccaaacctctgcagatctattttgcctccatgttattcttatgaaagccgggtgccacgcccaggctgcaggtgcaatgttgtaatggatcatgttgagaaagtcttttctgtgtgtgcatttaaggcactgtgctggatgcctttgaattgaggataaacatgtactggacgcctttatgttgaaaataaagtacatgtaatttgggtcagttctgtaaccacattagttgagctccaaaatcatgtattttcacctactatatgcagaggggttgtaaaggcaaataaaagatcagtttttcaagaagggataaatcagaacaatctatattctgttggatagtatctatggcataagaattactatccttaagttatatcctttcagtaatttgagacaaaagcaaaatgtgggaaatatttgctatcttgttgaaagacttgtttctctttagaaacttctagccctataatcagtgccatttcagggacattttttatgtgggtcactgtgtactggggctgaaggcttgattgtccctgagaattctctacatcgctaaaagagaaataatcacagaaatccttctgaggcaaatattaccaaagtgaatcataacacatagctcaatcctcaagctgaggtgtcagtaccctcctgaaactgagaaagcactaatttcacagaaataaaagcacagtactttgggattctaccaaatatctcctatctaacatgtttttgtaagaacagttcatttgttatattagtagaaattttagaggaaaccataaatatggcttttataattttatggaaaaaaaaagtcacagagaagggcctgtcttcgtggatttgtgccatgaagtttcttaacttcctgaagggaaatgtactcacctaggttggctgcagccaattttgataacataaaccatgataacacagcctcatcgtgctgcagacggaggcgtactttgcatgatcactttcctacttccatggcccagcacctggctttttgtaaaaaagcatgccagccttctgtggcctgcaacagccaccttcatcatactaatggttttccatgctccacatatttagtccaattactgtagctgatttagtagttttaatatttagatgaaggaccccacagttcataattcaaattaaaatactggttcaagccataaaaaaaatgcctgttatcagcattggtgtataaaggtcactaggcttggtaccatgaagggtaggaaataaaagtcagtctatgcctcaataaatttttatattctctaatataaacactggattagcaatccagatcagtgtttctctgatagataccctatgccttttgaatctaggtctagtagaaatcttaagaggccacatcaccatttgagttggacattcctaattttttgtctttacatttttagaagtcctcaacctcattctcgtgtttcagagtcctcttgagagaatgctttccaactaaatctgaaactaggtatcatccccttagcctagaacctaggacaagtactaagcaaggttaagattcctatggaatttttaagacttgtttctttttaaccgggtgagctcagttacttcaagctatatcttttatgtaaatatggatatttttggtaacgagcagatacactgtccagtaatagcctcatggtctttcctccaagaggaaacagcctctggtgcctaaggagaatcgcatccagtggagactgagttgttctctctccttgcaggttcacttttgggaagctacaagtcccttcacttctctttatttcagctcctttctcatgccagctgctccactgatggaggcagcagctgcgattgttacatatcatgcgtctagcactcattttcctaaataacactcgacgctctctctgggtatcttccacataggaaggagcaggggctctgggctcacagtgccgggcctgcctcccagtcctgttaccttctggctgagtggccttggtgagcctctgtgcctctctgaatctcagtgtccttgcttgtaaaatagaggtaataaaatccataccatagggtgattgtccagattatatgaaataatataggtaaacttcccgggcacataataagcattctgttttttcctccttcaaggcatgtaccttcaatgtaattttcttaaaaacacttaaatgttgtcagataaaattactaaaaaaaaaaaaatcactaagaggatttctgggattttttttttttttttgtgcattttactctccatgcctaaaaacaagaagcttaaatggtatagatgaaaacattcagctagtctttgcaggggactgagacatttaaatagaaatgtgatcaaagagaaaaaagaaatgttcagagcactcaagacttgaggagacacactgaggagggaaaggcatcagaattgggttggttaagaacctgcctccagagcagagctgcctgggggcagatcttggctctttgactaataggctgtgtgaccttgggcaaatggcataattcttgcatgccttagtttcctctccatttccttgggcaaatggcctaattcttccatgcctcagcaggtggggtgtacaacccacagggctactgcgtggttggcatgagataacatgtgtgggtgcctgaagcagtgcttggcacagggtacgtgcccaggaagtgtcctgcactattactgctgagagctgcatgcatgaaatgatttttttacactctgcccttatctctgaaaaagtatttgtcatattaggaggagggttcgagatagcaaggtgtgctatgccaaccactcaggctgctttctggctctaattgcaacttgatttaattaggccaatatagttattttactaccagaagaaaacttagagattgtcccttccaaccccctcgttttatagatgaggaaaccatgaggtactgagaaattgtgactcatcaaaggccatttaacacattacttaaatcaattggggcctttgtgcactgctgatgaggatgtaaaatggtgtggataatggtatggtgggaggttcttcagaaaattaagcagaattaccatatgatctagcacttctacttctggatatttacccaaaagaattgaaagtgggaactctaatagatatttgtacacccatgtccatagcagcattacgtacaatagcccgaaggtggaagcaacccatgtgtccatcaacagatgaatagataagtaagatgtggtacgtgcactctgaacaagcattcatttggctgcacagggccagatcaaggtatactgtgttctttaccaatattgacttgacgcctttttccagaattttgtgtccacctaagatcaggctttctgggagcttggtgacttcaagagttcctcatgtgaatagttgaatccattggatggtgttttgcatagttctaaaaacagtagggaaatcatgagtgctaagttttgaactgtaattatttgtctttgcccttaattttatagagctttgtgatcattagaggcataaacacagaattgtagagctggaaatagtttaaaaatattttgtccacatttcctcatctgtagatgaggaaacgggcccagagagatgaagggactttacatgttagaatggaaagaacacaccctagacctcatgtgacttctgccactgattttcagtctataaaggtgtgataataacacctatagtgcccgcttcaaataaggcagtatacatgaaagtgttttccaagtggaatgcacgatacaagagtaagtgattagtattgctaacttgtgagtagtaatttcacaacacacttagagatgtcattatcctcatcttctccttgaacagttcagcaacatcatcaaggttattaagtgcttaattttacacaaggctgtggtaggcttttattcctaaggaaattgtatttttgtttttccaggagcttttaaatcttgaccaaagacatataggtggggtgtaaatagccaaatagatattgatctgtttatttatataataggcttatatcaatgcatatgtgcatagcaggcatgggttctgcaatactcaggttctgtgcgaggtgccaggaattcagtgatgagtgaggcaaacatgatcctgctcttgtggaatttacagtccagttggggtggggagggagaaagaaattttaaagagaaattaaacattaactatatacttacaatttaatgagaaaaaaataaaatccaaggttctttgaaagcatttatttaacaggcagatctaacatgacctgggccaccaaaggaggccatctggaggagatgacatttaataaaggctgaagagaaatgaggcttgaaagtgtgcagaggtcttgagaaaggagcagtccatttgagtagctcaatggcaggcgggttggagtgtgatgagcaaaggggtggggcagtgagagcttcaggtgaggaggctgagggaacagtgagagcccaaaggacatcctaggtcacgcgaaggagtctacactttatctgaagtgccaacgtaagtctttgaagaattccaagcaagcatgagtgatgcaatcactacttcatgtgtaaaagatcaccctggctattgtataaggagtggaccaacagactggagtatttgctgattaagtgacttctaggatttctttcaaattaatccaggagttgtggggagaaacagatgaaacaatattgggcatgtgtcagtaaccatcaaggctgagtgatgagtacatgagggtctgtgttactgtcgtctaaaatttccacatggaaaagttgttaaaaccaccatataaatgaatatcttttataaacaagctcagcgtgtgtgtatgaagaaacatttctagcctgtatagaaaaagtgatctccatcttcacaaatgaagggaaatggtttacaatacaaatatacagaaagagctaatgatgtgagccacatacaagctcccctgtggatcctggccacatctcttaaatccagtctcgggttcctggcctgggagtctatgtcaccctcatgattttttgccacagacaaaattaaccagtggttttagcacaactcatttcttcagcatacctgaagagtatctatgccttctcaagaagtgtccttcaacctccagggtagtaatgaagggtaccccaaagaagcatttttaacagaaaagagaccagagaaggagagaatcctcactgttggactttgccccatgctgcctccttgggaccctgggagatcctttcccggcctgctggatctgccctttccccctgagaggcaggaagagctgagatctccaagccagaccttcacagtgcctctctctacagtcttagtgtgggaggggcatctttccatggcttcctgagatggagatttatttaagaaggaaagcttgttgaattccctcttacctttttaaatgaaaggtattattattattctatatctggggaaactggtcagacacctgtttatgttacatgccatagagttacagatgttaaagacctcagggcttcatctggcgtgatgtcagcgagggcctacattcagggttggggagggtgtgtactgtccagcattcctctaaaagtgtgtgactggcaaggcaggctccagcatcttctgaccactaatctaatattactgtccccacaggccctccctgtcatcacctttaccactgccctctccacccgcaacacccccgaggttgtggacttgtgagttctttgtgtatagctgttcaaacatttcctatagacgtgggtagtggacaaaggacttgcttgtgagaacttttcccatggagtgcagaatcagtgggtgcgggggtagcttgagcacacttagtttttagcccaggatttctacttgaaaagaattccccaaatcattaaccagtaatcgcacatctaaaagtaactttatatgcacccaaataggcacactgggaagactatttttcttgcttccccttctgtctttctcatctttgcttcaaatgtttctgctcaatacttaacgtgtgcttgcctcaaaagcagcctgacctgcgactcgcagagaatggagtattcacactggcaggatcctcagaaattaacacaaaaaaggcatatgacgatgacacacacatttgtgtaaagaaaaaataaaaggcattccagctgttatttcttaattttttttaacttggtttgggaatatatactacctgttttctggtgtcaacatgccatcaggtttcttaggctgactaaatcatcccaaaatgctgataatgatgagacaaaagaaagtctatcatttttttagggcttctgaggttccactgagttttgccctcatctaggtccagaagggcttagggaagtcccaggcgagtcagcagagctcaggaagctgaagccttgtctcagaggttagtgctcctttgctgaatcatctccagcaagaaatcacgtgactcagggtctactcaggtgaagtcggcacccttgtctttgagctcacacaggtggctgagctaaataagtgctgaaaggagctgggtgcactctcctgagtcacctttgttgactctggaagcactgtaaacttggcatcagaaggagattataaagtgcttttgttcctaagctttataaagtgtgtgtgtatgcatgtgggtttctctgtcatccagcctctcagatttcatcatccgagcattgtctgcaggaatcctgtttgcctgtacgcacaaaggagggagaaccacagttaattcggggatcctcttttagccctgagtgtgtcccacatctgtcaccaggcagtgaattccaggagcattgactgtcttcctgttcatttccctactcccctcctgggagaggctggaatgttcaaggaagccagcaaaggtggtcagccaggagaaggctggggaagaggagggaaaaatgggacccgagtaacgcagaggatccaaccccagatcattagggctggtttttcaaacactgttaggggaaatccaaagaaagttatcaaaagatccttgagtaagaggagtggttaacatgcaacctggcagactgttgccaggactggaatacctgtctgaggaaaggaaggtgccccacaggcctcttaccaaaacccctagtgaggttaacacccttcagaaaaggaaccgtttgctcacagatcaaggccagtgtctgcagaaaacagaaaaacactgctcttcccagagattttgtatttgggtctttttaagtcatataattttactaaagttcttgatctctacttctttttccctcattaaattgtaagtttcctaaggttggaagtccttacattttgatagcagtgtaaaggattttttaaaatgtatttttaatagagtactcatgctgcatgtctcatttatctccatccctgccaggaagataaagatgtcaaagcttttgtaaaatgaccacggaaacttttcctgtgtggagatttgctaaccggtgtctgtgggtcagaaaagctttttgtttcgagttagaaaaactcttgtcaacaaaagtatttgactttgttgttttttgtttgtttgtccttgccaactatcaaaggtcagtaatttggggcagttgatcattagatttggtttggatgccaaagataatgcgcatccaggataaagaagggtactggccttgatttcatcagaggaggataaaggacattgtatagtccccactagagaatctttgttcagcactcacttctcttcagtagctacatttggggaatcatacctggaaaaaagtagttcgtatagcttgggcatgtagggtagcagcagctttttcttaacacttggaagtcattggagagcattgaaatccgccccatcagtcagagctgcttgagactggtttgtcaggaatagaagcatgttgtctaacaacgggcattggcacaactgcatgaccttgggtttccatctccgagacttgcctctaacctttacctacggttaatcaacattgtcccatgaccagaaagaagatacaaggaagcaataatgattataaaacccaggaaaggcagggtgttgggagccttggaaaggaattgagtatgtgcttatgaagggctgctggattccagtcacagacagcatggaaaacacagccagcaaacccaccacggatttgagcactgcccctgcccgctagaggaacagtatagggcatttagtgtactgagtttcatcgagagaaaataaagtacactgtgtagtgtgtctctggagatatcgcacagaatattctgatgctggtcagttacaacctgccaggtaaggcactgacccaccggcattctcaaatatacccacatgcccacttcctccatcactggctcagggagatcagcttgagcaagtttatttcactttatttttaataaagaaaagcccatttcagactcaaggaaaacaaagcatctgtagctgagggaaggacaatcttcaaaatgccagctttttttttttcctcccagagtttttagtgataaatgcaaaaatagaagaaagaaaagagtcccttgatatgggcacagactgtggaggccactggtgtggccacccacccacctgacgccggacaggccagtccggctctgcttcacgtgttttcaatgacacaatgctgttcctgccagggagcactctcatcacttaatggtactgagtattacaaccacattacgtgttttagtttttcttatgatgtatttagatatgctgcctttaacttccactccctgaacttatttctccctgaaattatttctcatctaatccctcttctggccgacagctctttgagtatttgaaaattttaagtgtccttctatcttttccagcaaaaagaccctcagtagtttgaaataaaaccaggtgtcaggctgaaggatgcctcggattttttccagccctattacttttctttcccttcacttaccacctgcactgtatgtacttctcagcccttctccttccatagaatcagaggaaaaagaatgtcacatgagccagcaaagaagtacaacacaaggaaacacacagagtgcgtgaattctcatcagatgaagtcctgagtgtcatttattaggtgaaagtaaagtaaactgtgtaatgattctcctcacctgtcggtccaagtatcttaacccagaatccaaataagaagattggtagcctcaaggggaagtctagcgtagggactgagagcaaaggcctgagttcaaatcctgactgtagcactcccaaactgtgtgacaggttacagatgggtctgtttctcagtttcctaatctttaaattaggaataataaccacagttgctttaaggattatatccaatgaatttggaacacttaatgcctatgcaacaaaggagtatgcagcatacatatatggtagtaatggctaccacttcttaagctgtaacttgtatcaaacggtatcattctctactctctccactcctgcagcttcccccttctcaaaccagtctggatacctggcagggtggtccattgccatgagtgtgcaggtaactagttccagccctccccagcaaattccatccagatccaatcttagcaggatagagcacctctccttctcttggctcgtccagtattccatagcagcaccattcggtataagaacctagacttgggaagattacagtttgtttccccagagagattcaggaagtctgttgtctgtcctttccaccctaccaagccccatcccacccccagtggactgtcatcagccccatcttgcatttaaatgtctgtcactgccttctcctatggaaaagtgacttatcaatgccaggtccaagcctggtgtctctcccatactgtgcagccacatccctgcatgaccactgccctgagctggagggtgctgctagcacggggtgtctccagatctccccaacagctggcaggaggggtataaaaggagaaggttggtcttcataactgggtcagaatctgcgtgtgccagcagcatccttcagacagacacgcgcctgcaacacgcatgcgtggtgtgcttctcgtcagccccaggtggccattagggtctatggtcatggcgaggttgggcgtcatggctgtgaaccgcactctattctgtgtcctgtgctctttctctgccctttctccccaggaccctctctagagccattaaatgccttttccccatttaggatcatcgctctggaatattggcaggaaggttctgtggcatagtttccttgccttctaacttgccagcattagctgctaactctctctctgccctttgtttaaggtctgaaattgaatgaatggagaaggtcattttgtttgcccaacagccacatccaaccattaggcagaaaatacagtgttctctggctcctggaagaaaatcttattagactaattgctttatttatataacttgtcctcttcctatgaaatcagacagattttgaaagaggaaaaaaatacttgtggccattacttatattttagtgagtaaagtacatttgggcccagttatttcaagactcataatgacacagcgttaaactctataatctggaacatccaacaactcaaaactgaagctgcctcctgtgtgcccacaagatgtgataagcaccatacctgacaccagatttgcaaagaagctgctccactgcacccatcttgctgcatttagtttctctgtcctattgttaatgcagatatagttgcacattaaaacctattgtttgtaggccgggcgtggtggctcacacctgtaatcccagcactttgggaggccgaggcaggcggatcacttgaggtcaggagttcaaaaccaggctggccaacatggtgaaaccccgtctctactaaaaatacaaaaattagtcgggcgtggtggtgcacacctgtaatcccagctactcgggaggctgaggaaggagaattgcttgaacctgggagggggaggttgcagtgagccaaaattgtgcaccattgcactccagcctagacagcaagagcgagactccatatcaaaaaaaaacaaaacaaacaaaaaactattgtttgtattctcgttttaagattgtcttagaaaaggttttctgtcaggaaaaaaaaaaaaaaagttttccaaatagggtttggtggtatgtgcctataatcccagctactcaggaggctgaggcaggaggatcacttgagcttaagagtttgagaccagcctgaacaacataggaagatcttatctcagaaattaaaaaaaagcaagaaaaaggaacattattttccaaagaccattcctcccactgcactactggagcctaggacagtgaaggcagaaagagatcttgttctctcttacctggctgtagaggaacagggagagccagatgagcctcagggtcaaggctgacctcagagtgtagtctctcagcagctttctatctgtgcccctgccttttagtagaacaggatggacttacaagtttggcatttgggtcccattagggacataagcaaataatggaagtattctgcaaaagaattatgctgccactgttcacagcggtgggaacagagtgtttagggacagtctattcgagcctaggacggcaacaagatgttcactaatactatcatttcttgagggctttctttatgccaggcgctttacgttaattctctcattgactcatcataactttttaaaatataggaaaatcttcatgttagagttgagaaatctaaggctcagagaagttaagaaatttgtccacagtcacacagtaactcagtggtgaaagaatgatacaaacacaagcagtgacactgcagagcctgaccagccctccatgtcagagaagctgttagttctttcagccttccctggcttgcaggaggcctcccaggacattcctatacaaacttggcccaaatcctttacatgtccccttagaactagcgtcaggagggagcatgcctgcttgctttcccctgcagccacacctcctctgtagtctgggaaaaaaactgttaagtgtctcattctcggggccaggtgtgcctctgattccttgagtatcctctagttcagttccactgtaatgagggccacagcaggaaggggaacataaaatgagtccctgagttcttgacccttctctttcccctgctctccagtcagtttgagacttacacttggggtagaatccagattttccaccctggtcccctcactcactctgtgcagcttataaagtgcttttcttggccctagaaaacattctgcttcctttagtaaatgtgtgcagaatatttcatgaagtcacattattttcctctttggccgactttccctcttggatcacagtcagggagaaagtcagctgaggtgaggcaacttttcagtgtgaccttaaatgtggatgaaagtgatggccccgaggagcacaattgttaacttactggcatttgggtcccattagggacataagcaaataatgaaagttttctgcaaaaggattatgctgtcaccattcacagcagtaggaacagagagtttagggaaaggcctgtgcccagcctaggatggcaagctatccacctccaactccacaccatctgcaccaacgtgaactgtgaaagatttcaggcctgggactaatgttaaatgttcccttaactcctcatctccacatcactggacgggggtagtggtagaagggccaccccaccaccaccacaacacacaaagcttctacccccttagtatcaccccggaccctccttctcccggtcctggtttctgtttcatggtattcatcctcctctggcctcttcatggcatcctccagctgccactctggctgcttctcaccctacaccaggggtcaggagccatgaaagtccgtgagtgataccagccaggtgggaggtgatagggagtggtggggcatgtgactgactgggcatctggtgccccatgaaaagcagaagcccctgctcaactccaggccgtttctatgagaggagtgcaggcccagtgttcccgagtatctcattttccacgagaagttggaaaacctgacttttcatgtgatgtgacatttcctagcgtttaaatatttgagaagtaattaaaattatttcaaaacacactaggtaggccaaataaaatgtgtctgagacctagggctggtatcagttctagtctgtctctgtcactttccacaatctaacctgccctcccagcttcagtggttactcaaatttcaatgtctctgagcgttagatggccagccctggcctgcaccccagatttaccctagaattcatctgcatgtgggtgcccacacacctccaatgcaaagcggagcccatcagcctcccagatttggcagactgtaggatctcagtaagtgtgagctatttttgtctttgttccactaacaaaaatactactactactaacactgctactaatactcatgctacaaagaataatctcttgcccctcttttgttccatttctgttactcaacaccactgccccatcaggcagccagggaggaccctgtgatcttggactcttcactcccattcccggcagttagtggattgtgtttattcttccacggccctctagaatgtgcttccaactcttccttccaattaactagaaactctcctagttgctgaacttgtcatgtgttctcagctattgtctcagcctctaactgctcaccaccaggcgctacctctgcatttaagatttattcatcacgctgtggctagtgtcatcccctaaattgccgtgcagctctcatcactcacctcggatggatcccaccggctgcccccgcagttcctcagccatccctgcatgccagctgtaccaggcacttgtatgcctctgcatttgtgctggctgtgtcctcaggcgcattttcttccttcatgcctactatgttaattctgttcgtcctcatctctggtcaaatgccacctcttccacgaggctgtcacttgccttcccaccaccagccccagtgttatttgccccgtgcctcttccaagctctcacagcacttgatctaagtctcttttcatttcatccggctgtgtattatgaagtttgcttgattcttcccccttctcttgattagctcctggatgaagagacactgtctttgtcatctgcgtatccccaagaaacccctagtgtgctgccttacatgtagtagacaccttgaaaacctttgtcaattgaatcaaagtttgtttgtgtgtgtgtgtgttttgttttttcttttggtttgttttttttgtaagttgaggatggctgcatctaaagggctcaggccaaggtattaaaaacaaaactgcttggttattcaaaaggatttatcagaaccccaagaggctaagtatcaagctagtgaaagggttattctgcctgtccccaattccaagggtgcagtttttagaggacggacggtcgtgtttggtctacttgtcgtcaggcaaggcctcttccacagtgccccatggaagcttgggttcagtgccaggggcagggaggaatgggcaagcctcttggacactggggcttcagccaccctggcatatagagtcctgcactgtttgtcttgcccagaagaacaggctgtacccacccattcacaagatgtcctctctcacatcattggcaggcctgggaatttcccacaggccatctgggtgtgttctgccgtcctgtctcccaagttttttgcagcattgtttcttgttaattagctcttagaatagcaactgctcttccatcaggaattgtatcccgttgactttcctaaggcaagaatctactcatttcttttttgtaagcattttctcccttcctgcctgcattgcacaggcttacttagtgagagcccaagcagtgtgaactaactcctagctcttacagaactgagttacttataatatgcatctcctgaatcctgggtgaccactgtaagtgcctgaagtggcagctgctctgactgggcctgtgcagctctgaatgctgcatttacttttgggtcctgcctccaacccagaaccacctgtggcctttaattcctgttactaggagagaggagaagcgattaaaccctgtcagtatattcatttattagctgccctttgaagcttttttgaaagcattttacaaggtatatcccgtcaggttgcttaggaacttttgcagcctccttcttcaacattatcattttcatttgaatcaacactggcagcttgacacctctggacacctggcatggcagtgggaggtacctccaaacactgtctttccgtgtctgcaccttcaacaagattttctctgtaaattcagctccaaaacaatttttataaacacagcattacttttgtgttgttcacaaatcagatttggaaagaggtgcttggggactgtcatgagtctatttaaagataacctgatttaaataaaaacaaaaacaaaactttttatccaaggcaattttctttcaatatgggaaattaaattagcttcagtgtctttgaaattgagaaccacactccggccatgaaaagtgaattatcctgtactaatccttgctcaggaagtgatcaaaacacctttcctggctattttgtgaaagcagatttagcccagcatattttgataggagcccagcactaaggaagtttcccaactgatggaaatacagagaatctctatgcacacatcgcttagctgtgtggcagcgctcgttttagtttttggtctatggagcaatggaatctcagtcattgaacctacttcgaaacagcagtggtggggggaacatcttgaagaaaagcctttcatctagagctatgatatcttcgctgcataaagaaaagtggccaactttgttttttctagagccaggacacagaccttttcagtatgtcacctttgctgcttcttcacacagatcttcaaaaataacgactctctctcctctctgtggtctcgtcagagagcaggaatcctggccagctggtcaggtcactcagaaaaatggcacagctgtttctgaaagtagccccattcataagatgtctgctgcccacaactgcagtgttggggaaaggcacactgttataaagagcttcttttctttaaagaggaaagaaaaatacatggtgtttacagaaaagaaaactggaccctcctgctttcttttagtggccatgtctgaaatggaagtgggaaaagccataaatccacacaggcaatcgcgcctttaaggcatgattcatactgactgtgctgcctgtgatggaaaacccagctagttaagcaagacctgccagaaagtctcgcacagctcctctgccatggctgatgcctgctgtcttgtgacgtgctggttgtatgtgaatgaatgattgacactttctctctctctcactcagttcatgaccaagaaccccaccatgcgcttgggcagcctgactcagggaggcgagcacgccatcttgagacatcctttttttaaggaaatcgactgggcccagctgaaccatcgccaaatagaaccgcctttcagacccagaatcgtaagtgtcccaggctgtcacagagacattcctttcttcagatgtcacagcattccaccaaagtccgtagaagagctggatggcccctgtgggtgacagaccagaaattcagctggatactgcacagggcagcctcccctggggggaatctgggctccttgtccatgggacaacaatgtcttcatgtgcccacattaattcttaccaagtttcacccctcgtttacccaatctccaacttctctcaacctaaattaaaatcttgtagggtataagaggcctgaaactttccaggtttccccaaaagagtttggctaattgagaaagtcattgttctggccaatttcctcatgctccttggggcactttttgtgccttttctaagcccctgagaaagcagagtgggtaggagatgttgctcacttcactgagcctggcctcttggcttggagagcctgggtctgtaatagctgctgcagtgcagagcccaggccaggccaggcttctttgaccaaagaaatactgggatctccaggggctcctctccaagctctgcagctgaggctggtggccttcctgagcgtggtcccgcttgtggtctgagagctgagctcgtgctcatctgtgggtcaagagctccacaggaggaaggcagagaagcaaggctagcgatagatcaagagtgatggggagacctggcgtggtggctcatgcctataatcccagcactttgggaggccgaggcagatggatcacttgaggtcaggagtttgagactagcctggccaacatggcaaaaccccatctctactaaaaatacaaaaaaaaaaagcctggtgtggtgatgcacacctctaatccctgctactcaggaggctgaagtagaaggattgcttgaacctaggaggtggagattgcagtgagccgagattgcgtcatgcgctccagcctgggcaactgagttagactttgtctcaaaaaaaaaaaaaaaaaagtgatagagaaatatcattgattaaggtaagagcagtgagatgtgtgatactcacttagaaatgatctttgcagcgtttgtttatacagatataaaatactcaacttttaaaaacatacagtgcacttaatcactaacagcctactaggctgttggacaccaggcacccagaggtaaagccgttccttcaatggtcagccccctgccagcgcccctgggattagggagagcatggccttcagaggctggagcctgtagtcctaactgcacagctggtccagcagggcgtaacgcatctacctagagagtaaaatgaccaacagttgttccctaagctcagcacttgcaagaaatcttttgggaagatctcttcaaatgtctagaactctgcgcaaacaataggtaggacaagtgtgaacctacccaacctctgttgacaaatacagctgcacacccctcagcgaggcctgctgtgaaatgccaccttggtgaaatgagaataaagggtgagtgagccagctgcttttggatgaccaaattaattcttagcctcccattaagacaggcctgctcagcaagattttcatgggattagtgaattggtggttgccaaatgccataataatgcaccatgcagtagacttgctgtaaagcacagtttcatcataacaataactgtaaataatgctactgaacaagctacagagcactcctctgaactcactggaatgggctatatcccatgcaagatgagtaagcctcaagcgcaaaaatctcacccttgtttcccttttttttttggcagaaatcccgagaagatgtcagtaattttgaccctgacttcataaaggaagagccagttttaactccaattgatgagggacatcttccaatgattaaccaggatgagtttagaaacttttcctatgtgtctccagaattgcaaccatagccttatggggagtgagagagagggcacgagaacccaaagggaatagagattctccaggaatttcctctatgggaccttcccagcatcagccttagaacaagaaccttaccttcaaggagcaagtgaagaactctgtgaaggatggaactttcagatatcaactatttagagtccagagggagccatggcactagaaatagttgataatgaaatgagattttatgaagtataccgctccacctatgagcgtctgtctctgtgggcttgggatgttaacaggagccaaaaggagggaaagtgtgaagaataaagtagatctgagaaattctgagccaatcaggcttcttaattcaagagacaaaccaagacgttctgtcaactgtgctgtgctcttctttaagccaatgaaccccaattcctggcagtctacaagaagtctcttaatgctaatgaagaatttaaaggtctttttaaggaaatgaagggctttccaaatagaatgatttactctgaagaaacaaacaatggtatctctgaaactcacaacctaaagcccaatcttgaaaatatgttgtgcaccaagacgactgcttcagcttcttctcttatccttactttctttaatagatatttattaaactgtccagtgaaaaggtgccacaatgcccagtattgtaaacaacaggtttgcattcatgaagctttcattcattctggagtctactaatttacctgaatggtgtttgcattctgtgaaatgcctctccacgttgcatatgtcacacttttgtctgcacataactcttttttcacaagaagggtcactgccacaacagcacagtcagcgggtgaattacaggtgcctgctgcctgcctacctgggtaatctgatcttgtctgtatcgccgtgtgctcatcactgaagaattgcaggccactcatgtcagtgaccagatttgtggcttataaacattagcagtttatttatgttttaagatgcaaagatgtgtgtttgatattcactttaataattagaaatggatcttgtaaacagggcatatatcaaagatgaccttataatatgtacccgaatatacagttcaagaattttgtctgactggaaataaatgcattttgtagcaaaagg

SEQ ID NO: 36835 - DNA, 2548 bp, Homo sapiens
tgtctccggccgatcgctcggcgctcgggtccgcggccgctgcggcgccgggcatttctccgcagctcggctcgcggccgcgcccgccgccgcccggcccgcgcccatgcaggccatcaagtgcgtggtggtcggcgacgggtgagtgcgcggcccggaggccgcttggctgggctgggcgggaggggggctcgggggctcggggcgcagccggggcggggcgggggtggcgcccgggtcctcgcgaggcggccccgccgtaccccgcccgagccgcgtgcgccccggggtcgaggagggcggggtggggcggggcggggtccgcgggcctccagctcgggcccacctgatgctgcccggctcccgcttgggctggctgcgggcgaggcggggccgccgccctgtcctcccagtgggtggggccaggcctctcacctgggctgaaccctcagccggccccaccctctcctgccgccaccctcggagtcggggcctctgcctggggccccagtgtggggcgccctgcgcccttattcaccaccccagcccccggagcccggcctgcccaggtcgtcctccagccttaggtcgccacggatctggtgggctgggtccccctctcgaccccagacgcccctaactcgcctctggctccgggagagggggctgcccttgctgggcagagggtccgaggccgggcccgggagccacgtggcttgccctgtccgcagcgccgtggggaagacatgcttgctgatcagctacacgaccaacgccttccccggagagtacatccccaccgtgtgagtgtgggggcttcccgggagagcacaggccctccgtgtgagtgtggcatgggggggacacgggcagggtctcctctgggcttccacgtcggctcaggtggccctgtctctgggcttcccggctggagctgaggtgctggccagagttctagttctgtgcagacttgtgaaccccaagacacaggccagcagggctgggggtttctgggacccctcccaagccctgaccctgccctcactgctctgcagttttgacaactactctgccaacgtgatggtggacgggaaaccagtcaacttggggctgtgggacacagcgggtcaggaggactacgatcggctgcggccactctcctacccccaaactgtacgtaacaatggggccagccccgggagctgggggggtccctgagatccgcacaagggagggagcagggccctggggagcccctgaccactccaccaggtcccacctttttcccaaggacgtctttctgatctgcttctctctggtgagcccggcctccttcgagaatgttcgtgccaaggtagggcaaggctgggggcccctgtggggagagggcttgccccagtacctgccccgacaagttgtcctttagaggcaattgcgatacgggttctgcctggggtaggcacacggagtggggtctgaagatgaccatgggggctgatggggtgccgtggtggtggtcacagctctcagaatggagggttctgagggctctggctgctggggatgggccttgactaggaggccctgggaggtctccaggttccctggctgcgtgtttgttcctggtatctccccaccaaatccgcccctggtcaccccttgaaggaagaagagccaagtgtagctctggaacagtggggaaagtccctgagggccgtgacttgctcaggtggggctggggtagccgactccgggcctagggatcagagcgtctgtccctgcagtggtacccggaggtgcggcaccactgcccccacacgcccatcctcctggtgggcaccaagctggacctccgcgacgacaaggacaccattgagcggctgcgggacaagaagctggcacccatcacctacccacagggcctggccatggcccgggagattggtgggtaggcgctggcggcctgcaggggaggggtggggaggcgcagtaagggcctccctgtaccccaccctcactgtctcccctcctcactgccgctaggctctgtgaaatacctggagtgctcagccctgacccagcggggcctgaagacagtgtttgacgaggcgatccgcgcggtgctctgcccgcccccagtgaagaagccggggaagaagtgcaccgtcttctagagccctggcccacccgagcctgagggctggcggggagcagccctggacgtgtccgctgttgtgttgagacgtgtggtgtccctgagtcggctgtggggagcggtgggggtgggccggggggaagcatggggatgaggctgggtggcaggatcctgtcctctctgccgcctcattctggggtgtggctccagccttccctggcccccgccggaggccgggagggagcagggtctccctcagggctgcaggggcaggtgcagggaagccccaggatgggcttccctggagggggagggtgggggggagttctgttccttgtgccccgaggtggggcagccccttctcattttatacaataaacattctccacctac

SEQ ID NO: 36836 - DNA, 8759 bp, Homo sapiens
gggagcgggagcgccccagcggccggcgggcgggcgggcgagcggacgagcggcgcggagccggcccgaggcgcgcgccgagggagccccgtccccggtcgtgggggcaccgcccgcaggctctgcggggtgggcagctcccgggcctgccatgagctctccgccgcccgcccgcagtggcttttaccgccaggaggtgaccaagacggcctgggaggtgcgcgccgtgtaccgggacctgcagcccgtgggctcgggcgcctacggcgcggtgtggtgagcgcgggccgggcggggcggccggcggggcgggcggggcctgcgcggggtgcccggccttcccgctaagcggtccgccccgcagctcggccgtggacggccgcaccggcgctaaggtggccatcaagaagctgtatcggcctttccagtccgagctgttcgccaagcgcgcctaccgcgagctgcgcctgctcaagcacatgcgccacgagaacgtgagtcgcgcggccccgctccgggaaggcgccgcggcctcggcttggttcagctgggctgggttcccccacccggcaacccctcctccaggcagcctgctgtggggccgggcgggggtcgggccgtgggtccccaggggagaaggagagcaaggcctgtctctccttgggagacgactcccccaagggccgttccccatcctccgccagccccgggaaggactcagccccttgactcggcgcctcagccaggccctggtcagggaacacgacttggccaggcccaggggatcctccaggtctcacgccaagccttgcccccagccaggaagcccgcggtgagagcatgctcccggcgggaggattttcctggaaggggcaccttccctcttccccatcccctttccagcccctctgtggagcccactctgctgctgtccatctcccgagtcttccgacccggtggtggagggggaggaggggggcgccagaacgcagggagtgtgttgaaccctcaggagcccctgggggtgaagggtttagggagctgctgtttgaggagcactgggcgtggtggccgcctcacagacaccctcctgtgcgttgtgggggcccatcctttccagtccttccagtgagatgccacgtacagctgccctgggcctctcccatggcggtggctggctgctaagaacccgatctctctgccaggggtgctctggtttctggatacagtcccacttgtccactgccccccacgtcactcctgccctccccctggtctgggcccagcctgagggctggtggtctgggcacccggaccctacctacagggtgagatgctctggaccctcctgggtcatctgagccaccggtgccttgggagaacgagtccctgcgtccaccagcaaagtgccccgtccaccagcaaagtgccccgtcccccggttcctggccaccgctactccctcagccccttggatgggtctttttctctgaggcttcccatgcccaccctgacccccagctcactaccctgggccctgtgaaatccatttgcagtggacaccagccctgcccgcacctcgacaccccgtcacacccagccctgcccccacttcgccggcaccgcacccccccaccacccgcccatcacaccaaggccttgccccaggactgcagccttccccacggccccctgctcccacccacccactcacccacccgtgccttgccccatccagccaagcgctctggggctttttttctttttttttcttttgagaccgagtttcgctcttgttgcccaggctggagtgcaatggcacgatctcagctcactgcaaccttcgcgtcctgggttcaggcgattctcctgcttcagcctcctcagtagctgggattacaggcgcgcgccaccacgcctggctaattttttgtatttttagttgagatgaggtttcactatgttgggcagactggtctcgaacccctgacctcaagtgatctgctcgcctcggcttcccaaagtgctggggttacaggcgtgagccaccgcgccgggctccaccggggcttttctttagccaccgccccgctgtgctgggatctccgctgtgcctgtgggcccaccccctgggctcctggcctgcagctgaggctctttccctggaaccccatcttcctgggagactgaagctctgtgaggccacgtgccttgctcagcgggggaggaggctctgccacaggcctcagtcctgccaggccgcctccctctccaggccagcccccataccacagaggccaggccaagtcctgtggcccctagcccacaggaccctgctctccgtcttctgctaaagcactctcccgggcaccctccagctctcatgtccacagtccccgctgccccctggacaccccctctgttccctctcctcctccctccacattcttgcccatggctctggcccacgtggctccggcggagctgtccttccagcttgtgtccattcttacctcactctggccggttcctacaccacggccaggaggacgcatttagcctcacgtccccatttaaatcgtccccgtctcttgggatcaaagccaaacttccacctggtgtgtgctgccctgccggctccctctggcctctcctcagcccctccctggcctgggcctccgccacctggcctccctccctgtattcttcaaactatccaagtgtgctccctcctgcctcggccactctgtgtgtgccctctgccaggtgtcccgcagcccacatgtctacctgcccctccacccttggctgtgcaaaactccaggcctccctgggaccgtcaccccaaaatgctgaggcggcagttgtcacatgacctgtctactgtctatctccccaaccaggggtgctgaggggaccaggtctggtgggtcacggtgctgtccgcctgggcctcaccagcagaggcctggcctctttccatagcgctgtccccaccctgggcctggatctgtttggttggggtgaagaggggtgaaagggtcaggcggcaggagccctttggatggttcggagccatcccagactccgggttgcccctcccccagaagatcccggttgtcaccgtccaaaaataacctttctgtgggtatgtgtgccagggctgggccacactgccagtgggtatgtgtgccagggctgggccacactgccagtgggcagagccaggccctttggacagtggggcatgacaatgacagctgcagagggggtttcctgcccagagggttgtgccactcttggggggtgccccagcccgtgtcctctgctgcattctcaaccctatgtggcccccccaggtgatcgggctgctggacgtattcactcctgatgagaccctggatgacttcacggacttgtgagtgccgacctgggctggccgctgggcacgaggggtgttgggcagctctgggcactggcttcaggttctaggttggcaatggggttctcttcctgcagcctgagtgggggatgcacaccgcccaccccctccccataccactgtccaccccacgccctcccccacatggtcctgggacccacgggcactggcacagctgggcagagctggggctgctgcctctctccacgcctggcacctgggccctctccagcaccggaggtgtgaaccttggacctgaccatttgttaacaggaaggtcccgtgctcgggaccctggcaccaagtgtgtggccggtaactggagctgctgaccttttccagcgggtgggggagaagcggtagggaggacccaccctgcccctgccctgcagccgaccaccctgggactcacaccctgtcggccaagagtgaagggccaggccgaggaaggcctggagagggtagcaggcgcctcccgcctgacttgcagaggtcaagtcagtggcctctgggaaggtgctaaataccattctcctgtgtctgtctccaccggcccagccgacccctctgacccagatgccttgccgcgcccccatcgcccccaggcacctccctcatttctggcacaaagttgtgaagttgaaacctgactgcctccctcccctgcctgtgaagactcgagtcctgctgcctctaccatggagcctcagcccctagcctggcacgcagggcgcttcagcggagggttcaaaaaccccaaggcagcctcctccctgcctgacagtcctcagggtgggaggggggtgtgagcgctgctggcagtaacagttgcgggaggatggagcctggcactgcaaggtggggctgcgaggacaccgaggccagtgtggatgtgtgctgcaggggtgaccttcctgggggtgcctgttggatccgggacgggtctgagcctgggcctgctgggtgggtctctgggatgcagaggctggctctgtccgctgacagcgctccggcccctcccacagttacctggtgatgccgttcatgggcaccgacctgggcaagctcatgaaacatgagaagctaggcgaggaccggatccagttcctcgtgtaccagatgctgaaggggctgagggtacgggccccgggggaggctgcagggaggcaggcagggcctcggggctgggcagaggagggccctgtggctctgagagggtgcgctgaagcctgccaaatcctctgccccccgcagtatatccacgctgccggcatcatccacagagtgagtcccggtggagaagccgctcatcagccctcccccagtgcaatccccccgcctccacgtcccacctgtgaggatgtgatggggtctgggtgctgagccacgccctatgcacagcccctggtgggaacctgcctgggtgcccaggtaccttggtctgcccttgaagggctgcagagagcaagggggccaggtccggtggccccatctttaggtgccacccaggctcttggctgtgcccatgcttgggagggtggggcacagtggccacctttcctctgcccccaggacctgaagcccggcaacctggctgtgaacgaagactgtgagctgaaggtgtgtgctgcctggcagggggccctgaggtggggcaggggccccctctggatctgcccatctatccacctgtcaggcctgggcagggggccaaggtcccaggctctgggcagtggctgaggagctggtgggtgggtgagcccaagaggcagtggtacacaacatgccgtacccagggcacctgctccgtcccgagggctgctgggcttggtgcactggccagagggaggagctcggggcagtttggggtccgagggcgtggcctcaagtccttgaaggttgtcaggaggccccagcttgggagcttcaagtccaaccccccggggtctcctggaccgtgggtggcctgtccgctccttgggagtcccctagaacccacctccccaattcttcccacagatcctggacttcggcctggccaggcaggcagacagtgagatgactgggtacgtggtgacccggtggtaccgggctcccgaggtcatcttgaattggatgcgctacacgcagacgggtgagaagctgcccagagatctgggcctctcaggctgcaccatctgcttctccacttcttcacggacagccctgtggtggctgctcccagggaggctgttgagctggggtgggagccgggcaggtgggctgtgttggtgtctcctccctccccgtctcatcctgtccccctgcccacggagctgaccagggcttctatctcagtggacatctggtctgtgggctgcatcatggcggagatgatcacaggcaagacgctgttcaagggcagcgaccgtatcctccagccgcagggcggcaccaggggcgggtggggatggctcctgcccaggtgggggcagtgggggccctgatctctggcccccgagctgtgttcctgacctcggtgcagacctggaccagctgaaggagatcatgaaggtgacggggacgcctccggctgagtttgtgcagcggctgcagagcgatgaggtaaggggtgagtggggagctgggtgggggtgggggcggacctgggccttggtgttggcccctcaccctttcttcccacacaggccaagaactacatgaagggcctccccgaattggagaagaaggattttgcctctatcctgaccaatgcaagccctctgggtacggctggctagtgtgggggccaccgggtgctggagtgtggggcctcccgtggtctggcctgatgcaccttcccccgcagctgtgaacctcctggagaagatgctggtgctggacgcggagcagcgggtgacggcaggcgaggcgctggcccatccctacttcgagtccctgcacgacacggaagatgagccccaggtccagaagtatgatgactcctttgacgacgttgaccgcacactggatgaatggaagcgtgagtggggggctcctggcacggcctgtgtggacccaagtggggggctctgggcagggcctgtgtggacctgtgagttgggggctccgggtagggcctgtgtggacccgtgagttgggggctccgggtagggcctgtgtggaccctgtgggccctgtgcaggtggccaggctcagagtcctagatccccatccctgggatgcaggtcaggtgaggaggatgggaggtcagggcagcatggggccgtgtggcctggtggagatgacctctggctggagctggaagttgaagggaagggtgttcctggcaggctcagcacagaggctggcacagaaggagccgggagtggtgaaaggcagctgtgagtcagggaaccagggcccacttagcccctcctggcccccagacctgctgcccttccgccatgtccaggccagagacctgggccaccctgacaccctcaccacgtccgcttgtccctaaggcctctctgctcacacctcctgaatctgtccttgcctctccttgccccatttttgttttttgagacggagtctcactctgatgcccaggctggagggcagtggcacgatcttgactcactgcaagctccgtctcccgggtacacaccgttctcctgcctcagcctcccgagtagccgggactacaggcgcccgccaccaggcctggctaattttttgtatttttagtagagacggggtttcaccgtgttagccaggatggtctcgatctcctgacctcgtgatccgcccgcctcggcctcccaaagtgctgggattacaggcgtgagccaccgcgcccagccctctccttgccccactttaggatccctcccccctggacaactgtatacccaagacagtccccagggcctcgcctgtctcccccagcccccgctaagcagtccagactccaaccccaactgctggggtccatcatcccctataccaggggctatcccctcaacttggagggctggccaaagcctgtgcagcctcaggctggactcagagaagcctccccagctcccgcagctatgctgcggcctgaggctgtgctggacctggcttcatttctgctccaggatggcaggctgtgtcttcttcatggctgcatgaccagcctggggtgggtgtgcccggggaaagtaggtgtacactgggagccgtgccatgtttcaggccctgtcctggctctgcctcgggtgcgggaccttggtcctccacactggctgggtggggctggatgggttgagattcacatgtgctccttacgaccacgggtccctgggtgcccgcagcagggcctccacccttcgctgtgtgcatattcgtgtgcttatgagtttggctttgtttgattaaaggtttctgctgctagaaagataacttgaaagccatgggccataggatcctctctgtagtccccacccacacaactgtggctgaggcctcagctcttaggacagaccgtggtggacatgtggccaagccctggccacctcccctttccctggaaaatccagatctagagcaatggcctcttcacacaaaccttctctcagtggttcagaccacattaggattagagaagggccccacgaggcaccgccaggcgtgtctgtgagcgactcccaggatggaaggcaaaggctgacccccctctctgttgtgcccgcccccccacccccgccaggtgttacttacaaagaggtgctcagcttcaagcctccccggcagctgggggccagggtctccaaggagacgcctctgtgaagatctctgggctccggggtggcagtgaggaccaccttcaccttccacctgagaggggactctcgttgccaccttgaccttggctggggcttgcatcccaaggcatccatcagagcagacgcccgggttccatggaccctcctccccacggccatgcctctgctcttgggcgcccatcatggaggagcacctgaactttctggacaagacctctggccgacctggggatggcctctgatccctggagcagtggcccacttgcccggtgctctcagaaacctcagagctggtggggctccagatcaggccttggcctctgagccctgcctgctctgggccatgcagaggaaggacagagggtgggcgcagggcaccaactcagggacatcccctctcctgggcgacgtcagtggaccttcctgcacccccagcctggaatgtaaatcagctgtgtggtgcccgcgtggctggaaggaaatagacccttttgtagctccct

SEQ ID NO: 36837 - DNA, 2656 bp, Homo sapiens
gataataggccttttgccatgtctgggcgtggcaagcagggaggcaaagctcgcgccaaggccaagacccgctcttctcgggccgggcttcagtttcccgtaggccgagtgcatcgcctgctccgcaaaggcaactatgcggagcgggtcggtgctggagcgccggtgtacctggcggcggtgctggagtacctgaccgccgagatcctggagctggctggcaacgcggcccgcgacaacaagaagactcgcatcatcccgcgtcacctccagctggccatccgcaacgatgaggagctcaacaagcttctgggcaaagtcaccatcgcacagggtggcgtcctgcccaacatccaggccgtgctactgcccaagaagaccgagagccaccacaaggcgaagggcaagtagaagcctggattagtttgcagcaactcaatcccaaaggaaccaaaggctcttttcagagccacctacaattttgtggaagaactgagcactatgtttaatgtaatttctcgtctttgcctacttctaaaccactccaaaggttacgtagatcagtcttcggtgtcttggttaggtagtgacaatctcgttagctttataaaaagcctggataacattaaaagtattaaacacgccttcatcttaagcttagtggaagaaaatttagtttttcctaagctggcattatccaagtatgttgaattctgtatggttcaccgtcgggttttacttttagtctgttgaagcaaacatgtctgctttggggccagatgttttctgggtcttggtaaataacaaaccgggcattcgacgttcaatccaaatctagatcaacgacttggattcttcatttctgagaaatatctctcgaatctgtataattaattgcatttgaacattaatgattgagttgagaataattattagactaattagaacagttacttatggtgccaggtagttctctttgaagcattttctgaaaattcattgaaattaaaatttcccgagctttcccacccccagccacacaaattgatttcttagtacagagatgacttaatttgtttcagcatggtaaattccacttttaaaatatctgacttgatgtttttaatctgaatcagatctggatgtacgaatggaatagattcttaaaagaaaatgaattacatttctagagtattggaaaaataagctgcaatggaattactttaatctaaaagtgaaaagttcacataaagttgtttctttgacattttttggccttgaatttctcacatgcgaaccagcttttcttggttataaaaatagaagttttttaaatttaagtggtcaaaagatagaaaattgaggggacaggtgtataaggctgtcctgtccagtattgcagccactagccaattgtggatagtgatcattggaaattccatagcatgaattttatataaaatacacattgcatttggaaaagtcagtgccaaaaagtgtaaaatacctaacaattttaatttcgataacattgaaatatgttggctatattggattaagcaaaatattaaaaattaatttttccttgttttgttacaatgttctcctagataagtgtaaattacttatattgctctcatttccactggaaatcgctagtatagtgaacaactgtatagcgaaaatagaaaataaaatatggagaccatgaactgctaagtctgtcagaggaataggtgaacaacaaaaatttgagtccttcgccaatccggttactgttgggtaggccttcagcatacttttgtccaatcagcttcagactctcactataaataagcggctagctttctctttctcctgaagtgaatctagctctgaaggcatggcgcgtacgaagcagactgctcgcaagtccaccggcggcaaggctccgcgcaagcagctggccaccaaggcggctcggaagagcgctccggccaccggcggtgtcaagaagccccatcgctatcggcctggtacagtggctctccgcgagattcgccgctaccagaagtccaccgagctgctgatcagaaagctgccttttcagcgtctggtgcgtgagatcgcgcaggacttcaagaccgacttgcgcttccagagctccgcggtgatggcgctgcaagaggcatgcgaggcctacctggtggggctctttgaggacaccaacctgtgcgccatccacgccaagcgggtgactatcatgcccaaggacatccagctcgcacgtcgtatccgcggcgagagggcttgagtctcaaggactcactgattacatacccaaaggctcttttcagagccacccacatgcgcgctgaaaagatctgtttctctcaggaattcttcctggtacttgttttgcctgtagtagatagggcccatttccagacgttatacaatctgtttcgtaagactcagcctatccctttttgaatgctaattttgggagtcttaacatctaataatgtccggcatttttccgtaagcattgagtgtagccaaaagttccttcgtgtattgctctcccatctccgcagcccggttttgaccggatggtgcttctaattttctgctaacctgtactgtggtgtgtgtatatttcttgccaacacgccag

SEQ ID NO: 36838 - DNA, 37899 bp, Homo sapiens
cggaactccagcgccggcggcggcggcggcggcggaggaggagaaaggaaagaggaagggggagcggcgagaggcggagacggagcccgacaggggcggcaccacggcacgagccccgcacagtccagtgtgaggggagcggcgctaagagcaggcgacgccgccgccgccaccaccaccgccatagatacactctcatcctacgggccacgcctgggccttgctgccaggaagcttcggccccgcagctcggcttgctgcggtctcaggtaaccgaaccgcccctcctcctgcgcagcgggggcctggaccccaggttatccgcggtccccagcctgtccgcggccctgccggtactgagaccccccaccccttctccctcacgcgcagcagtgccctggaccagagaactatcgaacccggcgtcttgttctgccagccctggtgactcatcctccaggggctctggagaccgggatttggggactgactgagggagcgacgggtgtcaccctttcccttctcaagatggcgccgtggaaagtgtactggaggccgcggttccgcctggtctccgtcctggcagtcctgggggtctcggtcaaagcaaggcaggttcgggggaggaggttggaaaggccaagggacctggcgagtgctgcttatccaggcgatctgtagttggctattagctactcaggtgctctccaagcaggaacctgggcctactgcaggtgtcaatgtggggagctccgcctatcttcaacttccaaagatgagtagtgtcggtgggtgggaggctcgtcaaaataggctgtctagagacttgttttctgtttggaaggtagtgaactacagcgttaaataaattcaagataacaggaccgctgaactccttcactgggtagagaccatggaacttgctctggcgttatcttccctggaagctgcttacctctgagactttcaaacttgttaagttctgaacgtcatagttcacatacttggtttttgtcttgcttaaatggaatcaaagcgttcaatcagttgcctttcacataataagaaaaaaacacttgtacacctctgggaatactcaagactgctcataaactttattcctaaagtaaaatggaagtgataactcagcatttgtataaacaaagtaaatggaacagtgcctggcacaaaataagtgcccagtcaattttttgatcaaagaacccttagaaggattttaactatagaatgaataacagttattttcaaaagattacaaatgtatattatgcaaaattcttgttttgcaaaacagaagtttcagtaagcagtgaatacaaatgaatgcacgtaatttttaaccttagtgttatgctaagtgtatatttaccattaactttagttatttcctgtttgagatccttagggggagtagccacaattaagtagctttaaaccttaaaagtcaaagtgaaatcagaatcttgtttgatttttttttttaatgggagtctgatattttccctaaaattttggaagtgccgtagaaatttggagcatattgtccttgataagtaatttcttgttttcttaaataaaaagacaaatggaaaatgttttgattgtgtgtaatatctgaagatgtattggtgcattttcagtatatatgatgttctattgatattttatcattttcttatcaaaggagcacattattggcaatttcaatccctactatgtatattagagattgtttacatgtattgttttatttaattgtcacatcagctatgcaagttagatattatgggaatagaaacttggaaattaaagagtttgcccagacggaaattggtatagccaggattacacccctaaatctggtatgtttgtggaggagggggcatttttatttataccttgttatttggaagcaactcagatattacgtcaataaatctgtaaatatttcagtatgtaatggtaaaagataaggactctaaaaagctggtgtttagttaaggcaaggaggtagtttcattgccttaagaactaagatctcgtggacatgttagggaattcattatgaagagcgtattataagctcattttatgggaaaggcatatttctttcttttgtttttaatatagagacagggtctcactgtgttgcccaggctggtctcagagtcctcctgcctcacccccaaagtgttgggatttaccggtataagccactctgtccagtgtgaaagacgtatttcttatatgaggtagctaaatgaaatatagcagggtttttagagagggaatcatcaggtttaatatattagcatgtattcggattttgattaaagatagaaggaaactgttaagattggtttgtgagtggattgaaaaaggttcttcaaatattcactaattccttagagattaaaaattagcatagaagtcgccattcaggctagatttctttaatgtgttgtttaaataaaaaataatggcctgcaggctgggcgtggtggctcacacctgtaatcccagcactttgcgaggctgaggcaggaggattgcttgagcccgagagttcaggatcatcctgggcaacatagcagttaagtgtctctaccaaaaaattagcctggcatggttctgagcgcctgtagtctcagctactcaggaggttgaggcaggaggattgcttgagcccaggaggtctaggttgcagtgagctgtgaccacgccactgcactccagcctgggtgagagagcaaaaccctttctccaaaaaaatttttttaaaaatggcatgtatattgttcgtctaaagactacaaaaaagttacaattattgtaagtaaataagtcagtaataatcaccacatggagaacaactgttagcatttctgtgtatggtgtgcttgagcagatgaggaaacagttttaagtctgccgttaggcacacaaacctgggagactgaaaatatttgttgtccaaaattaccattaattaaatgaaaaatgcatcgtttaacagaaaacttcaaataatactaaattttaggatctgttctaaaagtttcccatttattaataacataatttttctcaaaacaatgttaatccaagtagcctggctacagaacttgaactcgagtcatctctcaggttgcctgggtttgaaactcggctctgtcacttctgtgacaataactgtgtgacctcaattaagcttcttaacatctctgtgcttgtttcctcatttataaggattgtaataatatctcattttataggattgttgagaagttaagtacttaaagcactgcctggcacaaacttgaagctttgaggttagcctttaaaaaaaaaagtaattttggactcacatcctatacctttgaatttcctttaaaagatagtgacataatctaaagggcattgaaggtctagtagagtttaagataatcatgctataggcaatatttaaagtgattaatagtaaatttgctttactgatttgtatatttaattcataattgtttctttacaggtttctttacctccagaaagaagaatattggccccttgaattctggaagttcattgaagagtctgaaattagggacttatttcaaatttggacatggctagtcgaggcgcaacaagacccaacgggccaaatacgggaaataaaatatgccagttcaaactagtacttctgggagagtccgctgttggcaaatcaagcctagtgcttcgttttgtgaaaggccaatttcatgaatttcaagagagtaccattgggggtgagattttcttttttccctgcttcatttaatcgaatcatacattgacagaaaatattttgatgttccaattgtgtgattatgaatagctaaataagtcatagagtgaagaaaagagctgttcagcttaccttagctttaaaacttgcctttatctttgttaaaatgatgtgtttttatatttgattgtttggttaatcccttgtggttatattgtagctaaaatacagataaaaaacatgagtagaatcagtgtctcaagtaataacatttgacctgatacctatttctagctaacaactagaagcttcttcaaattaatacagtacatgtttgtgctcaattatattggtttaaaatgaatagtaaaaaaggtaaccttaaattctgatctatataactgaagtatttgcaaataattatacttacttgtaaaattaaatgtaattaaatactgctagatgtacttttttttggtatttaagagatgggatcttgctgtcgcctaggctggagtgcagtgtccggatcatagctcactgcagactgcagcctgaaactctaggctcaaatgatcttcttgccttagcctcccaccaagtagttggacctaagggtgcatgccaccatgccaggcaagttttttttttttttttttaagagtcagagtctcgctgtgtttccaggttggtcttgaactcctggcctcaagtgagcctccagcctcaacctcccaggtagctgtgattacaggtgctccctgctgagatgcatatgtaagaatgctcctaagctgagggaagagaaaaagtgattaatggaaagggacataacaggaaaatggaacctgaagaaaaagatgaaagaagaagggaaagagtaggcactgacaagggtggttatggtgggacagagatgaggggaaggtaagatgcagggtgaaaaggagacaacaaacagtacagtattgtcaagagaggacgtgaaatgggaaaattgaattttagctggacatggtggtgcattcctgtagtcccaggtatttggaggctgaggcaggattattttagcttgggagttcaagtctagcctgggcaacataatgagaacccatctcttaaaaaaaattgactttaatcaaagaaacctataattatatagcagtgggacaagatagcctcttttgggcctctgtttcatctgtgaaatgatgcttttcaattagatgatgtgtggcaagagccacacggtttgagattcacaatattttgcaagtgatatataattaagcaatgctgttttctaaggtattcatgtatatattttaaccccatcctgtaaaattaaagtcaaactttggaaataagacaggtagataccaactggcatgtggcaacttcttggaatctgtctttcagaagcaaaactttatactgtgcatttagtgaatgctcttctgcaaatatacttgagaatgttattcataatcttagacccattctagtaagataagttacagaagtctactacctcctggcctttgtatatcttgttaaaatgttatattagaatgttttatgttttttctaatggctgagcatcagaaagcatcatggagcttttattttgagtcagaagtcttggcattttaaaaaatgttaatacacaatatattagacatctttgtgattttttttttccctgaaagtacatccacgtgtgattttgttgttgttgttgttattgttaatacattatatccagtttaataatgaaatactacttctcaagaaggctttgcttcctccagaagtgatttggtcaaagctaactgtcccatctagtaggaaaagtttaaagactgctagatcatgtccacccacttatttcactgttaatggaagcatttcccaaagtatatgtgcattctgggttaaataacctgggccacgtaggtttgggacttactatatgctactcttctcctctctctttattattttattaaaacaataaaaactctgaagtactgtagtataggacttaattcctggggagctttgcaagagcttaagattagaatttttatcttgttttggataatgcacttctaagtttattttttcctaatgatagctcaagaaggatgtttaaaagaaaaatgtaaccccatatcctgtgtatcataaatatatctctgatatgtgtgtatctctatataatctccatgtaacaccagttagattgtctagatttcattaatgaatttttcataaagattttcatttctatgtgtagagcttcctgtttaaaaacaaaaaggaatttgcatccaaatttctgttaatcctttttttttttttttttggagacaaggtctctgtcgcccaggctggagtgcagtggtgtagccctggctcactgcaacctccgcttcccaggatcaagcaattctcatgcctcagccccccaagtagctgggactacaggcgcaagccaccactcctggccaatttttgtatttttagtagagatggggtttcaccatgtcggtcgggttggtcttgaactcctggcctcaagtgatctgcctacctcgggctctccaagtgctgggattacaggcatgagccactgcccctggcccaactttctgttaatctttattggatactttttcactgtgctgaccccatgtgaatactattcaggaggtatgacagtaccattatggttatagctgtggacactattcttttatgctctgtactcatagctcttcacctttaggaactagagtagatgtaaagcatttaagaattttaaggtttgagctatttcatgatcaacctgaaagggccataacttgtaggtaatacgtatttttgttttgactgtcatgtggtagaagttacctgaaaaatgaagccaaccaactcttttgcatttcaactgttggtttattttttttgagacggaatttcactacgtggcccaggttggagtgcagtggtgtgatctaggttgactgcaacctctacttcccaggttcaggcagttctcctgcctcagcctcctgagtagctgggattacaggcccacaccaccaatcccagtgaacttttgtatttttagtagagacagggttttgccatcttggccaggctggtctcagactcctgacctcaagtgatccacctgcctcggcctcccaaagtgctggaattataggcgtgaacctccacgcctggcctcaactgtttaatttttcactttactgtttatatctcctaacatgagttattgttctgaagcactcaaaattttaatctctatttgattgtgttcgaaggtggatatcatatgttacactcttgatttgtggattctggattcattaagaatatcaagatttcttctgtaatttgtgtggttcttcctaaatacaataacttgatttacgaattcctgttgcgctgtgtgcggtggcttgcatctgtaatcccagcactttgggaagctgaggtgggcagatcgcttgagtccaggagtttgagaccagcctggccaacatagcaaaaccccgtctttacaaaaaatacgaaaattaaccgggcatggtggcacacacctgtagtcccagctactgagaaggctgaaatgggagaattgcttgaactgaagaggcggaggttacagtgagccgagactgcaccaccacactccagcctgggtgacagtgagaaccctgtctcaaaaacaaaacaaaacaaagaatccctgttgcctcaccatacttcatgcatcctacccctatagcacttctgatgaaattgcgtgccgtagatttagcaatttagagaattctagcttgtttgtatgggtttaaagtttgcatgacatttatgtttctattgttggtctaaagttagcccagagattagcagggagcagtaggctcagagagttgtcttccttctttacttggtactgcatctctaggcttggtagctcttcagtaaatactctcaaaaaatacttatttttaagaagacatttatgtgatatttataaacaaattaatcctcagtggttagaatatgcagtgaaatagcaagcagacaatcctttttttctcttctgagaaaagtgcttcataccacagttacaattttgtatgcactaatcaaaaaatgtgttataaactctaaagtttagatgatggaactgtacatgaaaataacattcctcttgctggttctgtgatttttgtacattagcttagaacagtggtcctcaaagagcgttcccacttccagaagtagctgcattaactaggaacttgttaaaatgtagaatcccgtgttgaatcaaaacatttgggtgggaccaacaatctaggttttaataagttttccagatgattctaatggcatgttacgtttgagtagttgattttacattggtactaacattgattcacccatacatggaataattggggggtttttttgaggtgtggtgtttgtcagatttttaaaaacattgttgactgggcgcggtagctcatacctgtaatcccaacactttgggaggctgaggcgggcggatcacgaggtcaggagttcgagaccagcttgccaatgtgatgaaaccctgtctctgctaaaaatacaaaaattagccaggcatggtggcgtgcgcctgtagtcccagctacttgggaggctgaggcaggagattcgcttgaacccaggaggcggaggaggttgttgcaatgagccgagatcatgccattgcactccagcctgggtgtctcagcgagactccgtcttaaaaaaaaaattgttcatgcaactaacctagtttgagaattacatgtattatgtactgctcacattacatgttatctgtatctctttataggagaatgccttcctgttagccacctgccagacatctttaggaaagtatgatccctctgtccaatcaagagtattctgctttttctctacttagggagtacccatagttttcagtcatctgtaccactgctgctctcctttcttgtcacaaatgatcaaggcctgataatacacaaaattaattaagaaatttagtgtaggccgggcgcagtggctcatgcctgtaatcccagcactttgggagggtgccagcacactggcagatcacgaggtcaggagttcgagaccagcctggccaacatggtaaaaataccagaattagctaggcgtggtggtgggtgcctataaccccagctactcaggatgctgaggcaggagaaacatttgaacccaggaagcggaggttgcagtgagccgagatcgcgccattgcactccagcctgggcgacagggcgagactccgtctcaaaaaaaaggaaatttagtgcaattattaactcttaagtgaagtgctgtttctacttacatatttaacatccatctaaattggttagcatggccaactagttgtttttagtctaaaacaacctgtaacaggaataaaagttactgttaaaatgaagaaaaacaaggcttatttcaaagttattattaacatactattttacctaacaatttatggccaagtcattctaaagaataaactattgtggttaagagagactgtatccagattgaagtttttaccacaatgcctggcacagtaaaaggtttattaaattatagctattacagttaccatcaccactgttaacttttggctgaatcgttttgtcattgttgatatttttgttgtttggtcatgacatactattatcttgagatggtagctgttacacctagtgcatagcgtttgatttagaaaatttgaagatttgaaaaattttgtgttttttttcctttttttttttttttttaaacagcctgctctgttgcccaggctggtgtacagtggtggcatcaaagctcactgcagccttgacgtggcctcaagtggtcctcccaggtagctgggactgactataggcatgcaccccacacttggctaattttttatttttttgtagggacagatctcactgttggtgcctaagctggtctcaaactcctgggctacagcagtcctcccacctcagcctcccaaggtgctgggatgaaaggtgtaagccactgtgcccagcccaactgtgttatttgtggaagtttctcagagggagaaattacagggctaaagtactacacgtgtgcatatattaaagttttttccagtaactacttaataatgtgtacttgaaaactgctaaattcttaaatgtcctcaccattaaaaaatagtaagtgccgggtgcatggctcatgcctgtaatcccaacactttgggaggccaaagtggtcagatcgcttgagaccagcctggccaacatggccaaaccccatccttactaaaaaaaaaaaaaaaagcaaacattagctgggcgtggtcgcgcatgcctgtaattccagctactcgggaggctgaggcatgagtattgcttgaacctgggaggcagaggttgcagtgagcccagatagcgccactgcattccagcctgagcaacagagtgagactctgtcgcggaggttgcagtgagctgagatagcaccactgcactccagcctgagcaacagagtgagactctgtctcaaaaaaaaaaaaaaaggtaagtaggcgaggtgatcaatattgaattaccttgatttagtcacctcacaatgtgtacatgtatcaaaacatcatgttaatatacatatgtatatattgtaaatacataacgatttttatttttcaacaataccttaataaagctggggggaataaagttacttcctaaacagaaaagctagccagaaaatttaaatccaaataactcatgtttttccagtagtagaaagctttctacaattgcccttcacttgttagccttcagaatgacttctttgtataattataatctgtgcatttatttaatgtgcttttacctttttgcatgtgcacattgttaaaagtgcttttgagaaaggatagaagacctagagaccaaaccaccagcatgtggtttttgattcgtgagaaaaattgtgtgtttgaagtattcattctactttctgatacattgatagttaaaatttgtggaagttaatcatttggtttcaagcaaaataataatatctttgttcatcatattttctcctaaaaagtacatattcagaatttgagaggttgttacccagagaagttggtagagatttgatatttcaaatttatatcacaacctaaaaaaatctttcggtagtcttaattattccccaatttcttaggttaaaatattatcatatgtggctacttaaacattcccgtgagctgggagtcagtatgcatggttctaatcctcacatgctttcataagcatttatgtgaactctgtttacacatttgtaacacgagagtattgaactctaggtaaggattcttgtaggccaggtgtggtggctcacgcctgtaatcccaacactttggaaggccgaggcaggcatatcacctgaggtcaggagttcgaaaccagcctgaccaacatggcaaaacactgtctctactaaaaatacaaaaactagtggggcgtggtgtcatgtgcctgtaatcccagctattgaggcattagaattgcttcaacctgggaggcagaggttgcagtgagctgagatcacaccactgcacttcaacctgggtgacagggcgctgaggtaggggagactgagacatgagaattgcttcaacctgggaggcggaggttgcagtgagctgagatcgcaccactgcacttcaacctgggtgacagagcgagactctgtctcaaaaaaagaaaaaaggattcttgtagagcagatgttcttataaactgtgtactcttctcattaaacaatacagtcaatacaatttaacttttgttttcttaaaatgtatttcaagatttggaatcattatgagcatcagtttttgccttgccgtgcttaatgtgttgatgtcctctggtgctttggaagtattcaagctgtttggtagaatgattttgccaaatagctcttagtgaactgctactgattcactaatttactgcttttatttgttatatatgggaaatattaggttgtctaaagcaaatcaaaataaaaccagaaatcatctctgatgattctaaaactagaaatcagggacaacttcttggtatagtttgagagacagattgagtgaacattgtaatctggtgctatatattaaaggtttttaaaagtgatattatatgccactttttaaaaattaagcctaaatctccaactgatcttcttgttatgtactaatttatatatatatatatgtatgtatatataaatcaatctccaaaagaagatatacatagaaagtggtctcagttacattccgaggaaatctgtaaatttgcataacctttagtgcatggactttgtgagatttattctggctgcatttactcttcttttgctagctttctggttgtgttctgattttttttttttttttttttgaggcagggtcttgctctgttgcccagggtgaagtgcaatgatgtgatcatggctctctgcagcctcagcctcttgggtcaagcagtcgtctcacctcagcctcccaagtagctgggactacaggtgtgcaccaccatgcctggctaattttgaaatttttgtagaggcgacgtcttgctgtgttgcccaagcaggtcttaaaactcctgacctcaagtgatctcctggcttggcctcccaaagtgctgagatatagccatgagccaccgcgctaggctgtgttctgaatatataaggtttccagataattgatctttttggagacacactcagaggcacatgaaagacacttggttttgaataataattggtggaggctgtgggatgggaagtgttttaaaattttgcttttagaatagaataagaattcttacttgatagaaacatgggaaattttggcaaactgtttctcccttttttaggtcatataccataataacctgacattgcatatacataatcttgtttatgaagtatgctgagtaaatttatgataggatagtatcatttggagttacatcaaaagccttttcagcaaacctctttgtgaaggagaataaagatgtgtgagagtaagaaaagcaataagagtacttctaaaggtttttgtttttgagatggggtctcgctctgtgctagactggagtgcagtggcatgatcatggctcactgcagcctcaacttctgggctccagccatcttcccacctcagcctcctgagtagctgagaccacaggcatgtgtgcccctgcccccggctaattttgtatttttggtagagatggctattctccatgtttcccaggctggtcgcgaactcctgagctcaagcaatcaacctgccttagcctcccaaagtgctgggaatacaggcgtaagccactttttcaggcatcattttttgtcttttaattcattggctaccttgatgtatatgtaaactttagttacctagttgctaaattcctcaagatgaaagttaagtgttactgaagtcatatgttggactttgaaaataagaatgctctacaaatcagaatatctgaagtaagtgttgctaaacagcattcatcctccgtttgaggaaaggtagaagcaggatgaagaaccggttagttattcatggttttttaagccttaagtgttcgcagtagtagttgttggatattctttgggccccaaagaagaagtgggtaatcttgatacatgactagtcactgcataattatcagacaccttcagcttttctcagtcaaaaaactgttctttatctttgcataaaactagagccagaatatattccacctagttactatcgtttttatttgaggtataacatgaatagaattttctcctctattgcattcataagtaatttgtaaattttagaaaaatgtgacttctaggaaataaaggataatttaaagataggacacttataataattacttgttatgtgatacattcctagaacttaaacaggattttcagaagtttcatctgtaccttaccatggctatatgggaaggtactaattttatagacaaggaaactgaagcaataaaggttaagtatatgcttgaagttttgcaactaggtgacagctgggattaaagacatctttctgaaatgccattcatgttctggaatgtactgtgtatgtgtgtatttctccttgcaagaacctatcagactagaaaatttggctcatagttagagtacacatgacaagtgttctgttaaataatatgtagtatttgacaggtaggggccttcttgctatgtatcacttaaggaaaataatgtgaaagtattttgagaacaaaagaatataagacgattatttaaattgtccatattcctaaattatcaccaccattttcatttttatgccatcatcatgtgtcacacgctatattttaactgcctttaatcaaatgcattaatttgttcatgtgagtcaaaattcaagaagtttataaggtttacagtgaaaaatctccccctcatcttctatctagcccactcagttctttttcccaaagatgatgttactttgttatatatccttgcaaagttactactatactcaaatctatatattcttgtctccctttttacaaaatttgaaatatgtcagatgtactgtaatacactttttatttttcactttaatgctgttctagttatctattgctgagacacaaatgactcctccaaaatgtagagacttaaaattattttgtcatctccatggttctggtgagtgggcttagtaggtggttctcactctgatcttttccttgctcttgcagttcattacggggcaagaatcatctcaacacatccggcagttggtgctggctattggttgggacctcagatggggctgttagctagaacacacctacatgtagtagccttttatgactttgctccagaagtcacatagatagatagcatctgttctattctagtcacaggcctgtacagattcaagggaagagtgtcaacatcacactgtaagaagaatgtggtgtagaatgtcttgttgcagctgccttagaaaatacaatctacaggctgggcgtggtggctcacacctgtaatcccagcactttgggagactgaggtgggcagatcacgaggacaggagttcgagaccagcctgactaacatagtgaaaccccttctctactaaaaatacaaaaattaaccgggcatggtggcgcgtgcctgtagtcccagttactcgggaaggctgaggcaagagaatggcttgaacctgggaggtggaggttgtggtaagctgagattgcaccactgcatttcagcctgggcaacagagcgagagtccatctcaaaaaaaaaaagtactgtctgccgtaagacctatctatatcaaaagaacgtccgcatttttcttggctgtaacagtattcccttgcatgggtcatattagtaatatcagttctctagttttagatatgcacattgttgtatctttggctataatagtactgtactaaataacagcagtaatttctcacatattctgagtatatctgcagtatatatttttagagcccagtgtgtttggtttctcttttcttttttgatttttttttgaatcggggtgtcacttgcccaggctggtgtgcagtgacgctgtcatagctcactgcagccttgaactcctgggctcaaatgatatttccacttcagcctcccaaatagctgggactacaggtatgcaccaacacacttggctgatttttaaatttttgtagagaagggttctcatgttgcccagggtagtctcaaactcctggcctcaagccatcctcctaccttgacctcccaaagtgttgggattaaaggcatgagccaccatgcccagcctgtgtttagtttttctgtgaactattcataacctcatgttacttctatgtagatttctttataatagtcacactactgtgttccatttgatttattaatggtaatatttctcagtacatctatattgtcatattttagtatctggcaatcttctctttttattattttttaactgttccattgttgggcatttaatgtttgcttttttgtttgctgttttaggtaatcacctaataggggatatcttagaatttcaccccccccccccccgacttattttcgtaagatcaatttctagaggtgattactgaacccaaaggaattttatcctaataaaattgttttgtaggatcaaaagaattctaatcttcatcctttttcatcccttagagatacatccagtttctttgggggttggcatagataattatatcctaggattacaggtttcctctaactgttaataggagtttaaagttttccctctctgtttagtcttcttttctattatgttgtaaaattctcagatatcagaacttttgtttttgttttgagagacaaggtcttcctctgtcacccaggctgaagagcagtggcatgattatggctcactgcagcctccaccccctgggctcaaatgatcctcccacctcaccctcccaagtagatggtactacgtgtgcatgtgccaccatgcctggctaatttatttttaagatggagtcttgctatgttgcccaggctggttttgagctcctggcctcaagcaatcttcctgagacaggaatcccaaagtgctgggattacaggtgtgagccactgtgcccagccaaatattagaacttttaaattcatttagtatgtaagcttactgccaagcatgaaagaatcactttgaaggccagtaatgttttaaaggtctggaagattctcttgagggctaggaagcattatgtgctaggttcttgaaccaggagaaaaggggtatcactaagaagaagggaaggaatcctggtatgcaaaatagcttgggcgctatccttgcacatttgacaagtttagtgaagtactattgaactgttcagtaaagtatctgttgcctatagataaaatgtcttttgtagatacttatatatctacctacctatagatatctatatatctgtatctatatatcccttaaagctaagctaatttccttaaccttttctctgttgatatttgtttggtagcctttatctgattctagttaataactcgtaccctgtcatttttttaaaaataccctttgtttttgtaatgtgttctttcattcttcttcccaattcagttttggtacgttcctgttacgtaaatctaatctggtgagcagagactttcttaggattatgccacttggtgaggcaatcacagggtcttagccctgaaggcgcccatactgactttatcagtttattctagggagatcaggtttggggcactaacttaatactaacaaactcctaagattaatttaattttatttatttgtttgagacggagtcacccagggtggagtgcagtggcgtgatcttggctcactgcaacctctgcctccctggttcaaacgattcttgtgcctcagcctcctgaggctgggactacaggcgcatgtcaccacgtctggcttatttttgtagttttagtagagacaaggtttcaccatgttggccgggctggtcttgaactacctcaggtcccaccttggcctcctaaaatgctagaattacacagacgggagctaccatgcctagccaaaactcctaagatttacttacttacttactttatttatttatttgagacggagtctcgctctgtcccctaggctggaatgcagtggtgtaatctcagctcactgcaacatctgcctcctgggttcacctgtctctgcctctcagatagctgggattgcaggtgcatgccaccatgcccgactaatttttgtatttttagtagagatggggtttcaccatgttggccaggctggtctcgcactcctgacctcaagtgatccacccgcctcggccccccagaatgctgggattacaggtgtgagccactgtgcccggccctaagattaattttcaaacaatgtgcatcagtatgttagaaatacctagtgttagccgggtgtggttgtgtgtgcctatagtcccaactactctggaggctgacttgggaggattgcttgaggccaggagttcaagggcgcagtgaactatgattacaccactgccccaacctgggtgacagtgggagaccctgtcttaaaaaaaaaaaaaaaaacttagggcgacgatgttcagctggtgacatgtggctgactgtcttatgtactggttagtgaattcccttagagttgggtgtcccgtaagggttgctgtcaagctgtgatagtaaaaagcattgacttctcaatatcctttatcctagacagtgttggagaaatgctaatttttattctttacctcactcttgacttcatgcaggatcttccctgtgtatcattaatattcttcaggattttaaattgtttcacaactattacctttagatgttgctcatagatttttatatttgtttccttccttcctttattttttggggcaggggttgggatggggacgggatgacagggtctcactgccacccaggctcaggtgatcctcctgcctgagccacaaacctctcccaccaaccccccgcccagtagctgggactacaggtgcacgccaccacacctgttttgtatttttgttagtagaaacgatttctccatgttgcccgggctggtctcgaactcccgggctcaagcagcatacccgcctgggcctcccaaagtgctgggactgcaggtgtgaaccactgcgccttacccagatttctttttaaaattgcggtaaaatatccgtaacacaaaatttaccattttaaccatttttgaatatacagttgagtggtattaggtacttttaacattgttgtgtaactatccaaaactttatcttccctagctgaaactctgcacccactaaacaataactaccccttcttcccgtgtctggcaactaccattcacctttttctctctgactctgactactctagctacctcacataaatagaattgtacagtatttgtacttttgtggtttccttatttcatttagcataatgtcctcaacgttccatccatgttgtaaagcaagtgccagaattttccttcctaaaactttttaggctggataatattccattgtatgtatatacttcatcttgcttgtccatcattggacacttaggttgctttcatctttagctgttatgaataatgttgctgtgaacattggtgtacaaagagtgttttaagttcctgctttcactacttttggatgtatgcccgtaagaggaattgctggatcatatggtgattctatctttaatatatttgagaaatctctatacagttttccataccagctgcaaagcagttccagtttctccacatgatcacccacactttacctttttctcttggtttgatcatagccattctagtggcagtgaagtggtaatttgtggttttgatttgcatatccctaatgattggtgatattgaacatctttccatgtgcttattggatttatttatttatttgtttcggtttttttgaaatagggtctcactctgtcacccagactggagtgcagtagcatgatcacagcacactgcagcctgacctcctgagctcaagtgattcttctgcctgtacctcccaagtagtccagcgcatacccccatgcctggctatgtaaattttttatagagacagagtctcactatattgctcatgcagatcttgaacgcctgcttaagcagttctattgccttggccttccaaagtcctgggattacagttgtgaaccactgtgcccagctcttattggtcatttgtgtatatccgttggatcaatgtttattcaagtcctttgtccatttttttttttttttgagatggagtttcagtctgccgcccaggctggagtgccatggcaccatcttggcttgctgcaacctccatctcctgggtacaagcaattcttctgcctcagcctccagagtagctgggattacaggcaaccgccaccacgtccagctgatttttgtgtttttaatagagacagggtttcgtcattttggccaggctgatcttgaactcctgacctcgggtgatccacccacttcagtctcccaaagtgctgggattataggcatgagccattgcgctcggccctttgtccattttctaatcaggttttttgttgttgctgagttgtaggagttccttacattaatatgttctagctttcagtcccttatcagatgctcattgatttttaagagtgaattgtagataaactagtatagatcacctcttaagatggattaatttggggaagattgctgtctttctgtatgctatctacataataattttttattttcttgttaggcttttggaatattctctttttgggtttactcacagtgtgtatgctttactgtgccttattttttcttttttccctcctgggtgctgagtaatacttagccctattctacttttatttcttactcttcctcacattaattgcaatgtaactcttccctaactacactcacgactgtcgcttctgcagtccattcactgggtgcttcctgtatacacacactttcataggaaataaaaatggcctcagtttttatttttcctgttttcggctatgtatgattcttctctgtgtgtaattttatcatctgaagttagtgcttatctgtctgagaaaatctgttatgtcggattactgctgttagtactcattttcccagtgaaccaatttctgtcttcactgataactttagtacctgattctaacaatctctaacttgaatttttttttatcacaaagcctcattctatttctgaaattttgaacaagaccctttctcccctctctagtcactgcatgcatcctttccttttagttttaatttaattgctacttaatacttagttactagtattttttttcacttacacattgggattgtttttttaaaggtactcaaatatgacagtctatattattgtttctctatacacatttatttactaccgaaaattgaaaaaaatagcacatcgaaatttccttttactgcaattcaaatttttgaaaaccagaaaatctgatttattatactctagccaaactacccagtgttttctttacattctttccccacaagttactttacttctgattctttcttttgagacagtctgtcacccagactggaatgcagtggcataatctcagctcactgcaacctccgcctccaggatttaaggtattcttatgcctcagcctcctgagtaggtggtactacaggcacgtgccaccatgcccagctaatttttgtatttttaatagagagccagggtttcaccattttggccaggctggtctcaaactctgggcctcaagtgatcctcctgcctcagcctcccacagtgtgctgggattacaggcatgagccactgtgcccggccttacttccaattcttgatgatggatttcatttcactaacaaggttgtttttaattattaaatagttttaaattctttgagcataaaagtttgttctacctactctcctgccctcacactatcttttggaattttagtgagattattaggttaaaaagtattagcattttcttgcctttgctacatgttgccaaaatcctttccaacggagttgtacgaaatcaccagctgtgcttgggttttttgcaaattggtgttttttggttttggttttttttttttggttttttttttttttttgagatggagtctcactcttgttgcccagactggggtgcaaaggcacgatcttggctcactgcaacctccgcctcctgggttcaagcggttttcctgcctcagcctcccaagtagctgggattacaggcgcccacatccacgtccggctaatttttgtattttttaatagagacagggtttcaccatgttcctggctggtcttgaactcctgaactcaagtgatccacctgcctcggcctcctaaagtgctgggattacaggcgtgagccaccatgcctgctgtatttttattttttcattatgctaatttaggagataaaaattgttttgactatgtggatgatttcattgactactggtctccttttctgttcttttgtgaattgtctttacacatttatccctgaggttctaaagtttttctaaacatttataatagctttctacacattgaaaatactaatcacttagcatccattgtagaaatttttctcattaggtttgcccctttgttatggatgttatgacacaagttttgcaaacctgaagtttcatatttttgtgtaatcaaatctgtagtcttatatagaattttggtcaattttaataaagcaattctttcctgtcaattttgataaataataagtttgggcttgaagttgtatggtttctcagtttttgtatttttcccctttctgtttaattcatgtagaatcattttagttatggggtggcggttactttgtttttcttttttttcttgagacggagtctcactctgtcacccaggctggagtgcagtggcacaatctcggctctgcaacctctgcctcccgggttcaagtgattcttctgcctcagtctcctgagtagctgggattacaggctcatgccaccatgcccggctaatttgtatttttagtagagacgggttttcaccatgttggtcaggctggccttgaattccagaccttgtgatccacccacctcggccaccatgcccggctaatttgtatttttagtagagacgggttttcaccatgttggtcaggctggccttgaattccagaccttgtgatccacccacctcggcctcccaaagtgctgggattacaggcgtgagccactatgcccagccactttgttttttaattattaatctttggtttaatgccatcaatttgaatatcctttcccttgcccagtgtgttacagtgtcttcccctggcttactgtttaagtcttgcatattataataggcctttggtatttgcagatttgacatttaaagcttcagctattctcacctgattccagggtctgtggtaaagtaatttgtagttttgctgaggctgaaatgttacttgcttgctgccaggcttgcaaataggagctgatcacgtagctcagagggagcctatcagacaggccagcacccacatctcaacgcagctttgtttttctctacttgtcatcgcgtacacagtaactctcgaagtgataaaagctgtttctttgtgaaatatgggcccgaaaagaaaaccaactgctagtgctggtgatggaagtgaagagaaaatgaagcggtctaagagtgatggttcttagccagaaaatagacgttttggataaattaaagtggttttacagattcaggtaagtttgtggttggttaatgttgctacagtattgatgtagtagttttatcttttcagtggcagaatttgtttacgtaactttataaattactagtaatgtatttttaggagcactgaggatttgaagatgtcacctaaatgtcagttacacttcaccgagttttataggggaaattaaacactgtagtggaatttggccaggtgtggtggctcatgcctgtaatcccagcactttgggaggccaaggcggatggatcaccagaggtcaggggttcaagaccagtctggccaacatggtgaaaccccatctctactaaaaatacaaaaattagccagacgtggtggtggccacctgtaatcccagctactcgggaggctgaggcaggagaatcactcgaacccaggaagcggaggtttcagtgagccgagatcgcgccattgcactccagcctgggcaacaagagctaaactccatctcaaaaaaaaaaaaaaaaaacactatagtagtattttaaaactttaggactttgagaaatcatgaacgtcttagggtgtattatgtatatcaagagtttattatagtgggctacactattccagtaatatttctgttcatttagtactgtagcacttttcattttttaaagtatattataaaactgattttccctggcctctaatgttggtcttttctcccccaaaattatgctttatcataccacatgaacagtagtacggtggtggtggtggtggtggtggttgttgttttgagacagagttacactcttgttgcccaggctggagagcaatggcacaatctcagctcactgcaacctctgcctcccgagttcaagtgattctcctgcctcagccttccgagtagctggggttacaggcatgcaccaccatgcctggctaattgtttttgtatttttagtagagacgaggtttcgccataccggtcaggctggtctcaaactcctgacctcaggtgatccacctgcctcggcctcccaaagtgctgggattacaggtggaagccaccgcacctggcccagtacagtgttatcaggtgaaaaatatcttgatgttgtttttgaggttgtgttacaacttgagtagataccttgtgaaatatctattttttcacatttgggagctgcctctctctacattcaaatgttatctgaagtagcctctaaatggttccatgtatctttttgaacttccttcttttagtagacatttttgaacatctgtatgaacaaggatttatattaaatgttggtacagagaggagctactacaagttgagcatccctaatctgaagtctgaaatgctcccaaattcttcgagcatcaatatgatgtcacaagtgaacaatttccacacttaacacctttgctttctgatgagtcagtgtacataaacttggtttaatgcacaaaattattttagcttcaggctatgtgtacaagctttatgtgaaacaaacgaatttcatgttttgacttggatcccttcccaaaaatatctcattatgcaaatattacaaaatctttaaaaatccaaaacattcctggttccaagcatttcagataagggatacttaacctgtggtcattgctcaagtaactcccaatcaaggagaagaaaaagatataaaccaatgattataaaaggtgtgaaacgttattacacagagaactctgggagcacagatgtaggagatattaactagggtggaatgaaggaaggtttctaagcagagttgaggaatgaattgattatcttctttgttaatctgaatgggatccattcctgttcagcatgatttcccttggttttgttcctagatttaggaatgatgccctgttttgccataaggaagaatctcgtgtgtttattaggaatggatattgactcaaatgcctttttgtaatttgtttaaataaaatggatttttcttcattagcctgttaatgtaatagttttgtatttctgaaagaatgtacttggtaatgggcatttgtttgtcttaatgtatttgttgcaatttctttgtatttggcatttttgtacatgtatggtgtacatgtatggtggcctcttgtgtctttaactggcttgagaattggatcatattttctttaaggcaacatctctaatacagttggccctctgaatctgtgagttccacatttataaatgcaaccaactgcaagttgaaaatattaagggggaaaaaattaacttagctccaaaaagcaaaaattaaatttgccacacacttaatactatgttgaatctatgtggatgacgtgaggtgcaggcattgtattagatattataagtaatctagagatgctttaaagtatacaggaggatgtgcttaggttatatacacatactttgcaattttatatcggggacttgagcatcctcagattttgttatccattggggattctagaaccagtccttcatgatatatggggaggtcctggaaacagtcctccacagatactgagggatgactatagttatttccctgagcctgaagtttacttatggacgtataagtgaatgtttttagtactagtagactttgtgatcatagtatgtctgaaaaatgaaacagtctgtgcacattttaattcctttttttttttttgcaagtctgcatcaaactatacttgaaaaaaggcttatgtattgtgacttattttcctcttttcctttttggtaagagtactgtcttagggacttaattttagtttaaaattttagtttaaaaacattttttgatcctacaggagaacctctcgtgaccttcaaaaagtgacatagtgctgtctggatatcctttaccataaatacaatattttagaaaatggacaattctgctaattgttggttaaaaaaaagtttgaactggattagaatatatttacaatgtgattaatgagaattcataaaactattaattagaatctaggtccaaatgaagatgtttacagtattgtttgcaaaattcagaagattttagttgttgatactaaagccagcaaccagttaacctaaaagagcgtgaaaaataaatgttgtgtctaacgtaaaagagatatatctcattagactttgtttctttagcacatttgatactggttagtacatctctatcaacgtcactagataaacggctgtaatttagagaaatatatcataattcttttgcataatatgacagttttagaaaatggtaattcaagtgcataccaatttggaaatagggcttgaatatcacaccttgagctaaatgtagaaggaagggaggagcataccaatttacagtgaatgatagagcagcagcagagggcggtctaatggctgtgtgtaggtcttttaattttaacaatattgtatcattttataatgctactttttttttttttttgagacagagtctctgttgccaggatggagtgcagtggtgcgatctcagctcactgcaacctctgcctcatgggttcaaacgactctcctgcctcagcctcccgagtaaccggaaccacaggcaagcgccaccatgtcgagctaatttttgtatttttagtagagacagggtttcaccatgttggccaggatggtcttgatctcctgacctcgtgatttgccttcctcagcctcccagagtgctgggattacaggcatgagccaccacgcctggcctataatgctactttcctagtgttaaaattagaatcagggaaagtacagatccaaaaaattcttatggcagggaatgaaaggtaggagcaaatattgaatcaactgaacaaattaaatctaggttaaggtaataatgactaccacaattaaagtgtcacaatgttttaaaaaataatatagcaagaggcctggtacggtggctcacgcctataatctcagcacttttgggaggcactccagcctgggagatagagcaagactgtgtctcagaaaaagaaaaaaaaagataatataacaagaaatactaatttggtggtaactgactgggactaaattgccagtgtgcgccaataaaaactagtaaaatggaacaggacatggtgtcagcagtatagatggtacttttaggcacactgggtttcccccaacttcattttttaagactatcagtgcatttctttaattgtagagcaattttgaaatgcagtcttcgctgggcttggtggcttacgcctgtcatcccagcactttgggaggccaaggtgggcggatcacctgagatcaggagttcgagaccagcctggccaacatggtgaaaccccatctctactaaaactacaaaaattagccacgtgtggtggtgcatgcctgtagtcccagctactcaggaggctgaggcaggagaattgcttgaacccgggaggcggaggttgcagtgagctgagatcacgcccctgcactctagtctgagactcttgtatcaaaaaaaaaaaaaaaaagaagaaggaaaagaaatgtagtcttaagtttatttagtattataacaagcttttttaagatgcagaagtttttcaatctgtgatttcactacaaaggccctatatgtaagcatatatgtaaatagcttagaagcacaggtttgccagtatttaaagctattatcagctgtgggtatgcaatctgtcaagtttctaggtgttttctttttttttcccccctcatttattacttttaactgacacataatagttgtacatacttacggggtacagtgtgacattttgatagatgtatacaagcaggtgttttctatattatgaaaacatttggagaaaaatgattgacttattgtagtccttttctttcagctgcttttctaacccaaactgtatgtcttgatgacactacagtaaagtttgaaatatgggatacagctggtcaagaacgataccatagcctagcaccaatgtactacagaggagcacaagcagccatagttgtatatgatatcacaaatgaggtaagtatggatgcattccacagtaaaactaatttgagtacccacttttggtgttcagaattttgattaaatgttttggaaaatctttttctgatagtcatgacctttctgctgaagcttttgtgaattagaaaatctggttttaaaaaaaaacgaaaatgtctcataatacaatagtcctaataatttctttcccacagtcacttgggacagtcttttaaagccttgtatcacaaagatgcttggtaaccattttttgagcctgtgctcaatggctgtttctttgtttaacaggagtcctttgcaagagcaaaaaattgggttaaagaacttcagaggcaagcaagtcctaacattgtaatagctttatcgggaaacaaggccgacctagcaaataaaagagcagtagatttccaggtatgttaaatttaactctcatttgaaaggcacttttttcctgtatgtttttctttcatgtcaacacttgaattagttataatgtcaaaaccatgcaagtaatagaaaatactgatttttaaaacaaatataaagtactacatataataaaatgtttctgataaacctaaatttttaaatagattattgtaatatataaactgacccaaagattttgtagacttaaacaataaaggccgggttcagtggctcacgcctgtaatcccagcactttgggaggccgaggtgggtggatcacctgaggttgggagttcaagaccaacctaaccaacttggagaaaccctgtctctactaaaaatacaaaattagctggagatggtagtgcatgcctgtaatcccagctacttgggaggctgaggcaggagaatctcttgaacccaggaggcggaggttgtggtgagccaagatcacactattgcactccagcctgggcaacaagagcaaaactccgtctcaaaataaaaaagaaaaacagtaaaagtagtcattgttcacagtgcagaaagtgattgtatcctgccctaattcctccatcccacacatactttatgtcctaaccctcttctactcatgtgcaaatatgtatcagcacatgtgtgtaccccacatatgtacatacgcaaacacttatgtggttgttcttaaaggggcattcaaacataaaggttctgccaatctgtatccagagttggaaaataataagctaaaaactaataattaaaaaaaatttttttaaggctgagaaaatccagttttgtattacgattgctaattcagaatgtttgctgctgcaaaataggcaagtgcaatcacttaaaaacaaagcaagtcctctatttagacttttttttttttttttaagatggagtcttgctcagttgcccaggctggagtgcagtggcgcaatctcaagctcactgcaagctccacctcctgggcttacgccattctgctgcctcagcctcccaagtagctgggactacaggcgcccaccaccactcctggctaattttttgtgtgttttcagtagagacagggtttcactgtgttagccagggtggtctcgatctcctgaccttgtgatccacccgcctccgcctccaaaagtgctaggattacaggcgtgagccaccacgcccggcatacttagaccttttaaaactgtgcctgttctcttgctctttggcttctctactagaagggcggttgtggctgttctgtatatatcagtgatgaaatagttttcttttttgatgacgtagatggaatccatgtattcttgcatcattaggtattaagttgggcatgttacatttgtaattttatttaattcttaggacaacgatgtgagatgtagtatccattactctttccaaaattgttgccttcccagcacaagagtggcagagaaaacacttaaattacagtcagaagtggccctgtcacataacagttcagaggaacctcagttgtttctttgtccaatgggaaagatcattggttacccctcacaacagctatgaggatcaaaagtaataatatatgtaaactgtaaaagcatgacaaaaatgtagggcagtgatgtaattttcaaaggaatgatttatgatatattcaagattataatattgctgtagaagtcattgaaaattaaatatgaggttgtcatttagtgtttgaagccagtgttagatatttggtttccctttgtcttcattgcagacagtaagtgcaaataaaaattgccgttgagatcaaagagagttttatttagaataagataattctcccccatctctggaactcagtatttgaaagcagatttaatgtaagaaaagattaatcaaggtgggataatgcaagaatttcagacaaaaaaggaaatagtccattataaaattatcttgcacagtgctcttacctctgttgtagcttattatatagttgttgattatagatgattataggaatcaggttgtagtaataagaaagtctccttttctataacaagtttaaagcaggtgtagtgtatttccaagagatatatctcatatatctcattttttgttctgtaaacaggaagcacagtcctatgcagatgacaatagtttattattcatggagacatccgctaaaacatcaatgaatgtaaatgaaatattcatggcaataggtaagattaatatctctttttaaatgatcaatataagcaaaacaagtgtgaagcatatttggtttgactgtctcttttttaaaaaatttttgggggtgggtttgtgtgtatgtttatgtgtgtgtgtgagagagagagagagattataccacttttctaagtcccttccacaaaacaatattttgttggtaatattgttaaatttgaaagatgattacctattaggttgtaatactgtcagtttaggcagcttcttccaggtgagttaagccttaacctcttaacctgatagttcagacagacagattttgcaaaggtttcgctgggaaatttggataaatattttttttattagattatactttttaaaaatcaaattattggtaaatataactcagaagaacatgacacataagtatacagattgacaaattattttaatgtaaacattataaggaagatgatttcaaagcatagaggcgtaaggagaaaaaaggaaaacaaaacaacatccatactttatattacctcagatggtcatttgatcttacacaatgttcttgctgttgctttaaggtactttttttttttttgagacagtctcgctctgtcgcccaggctggagtgcaatggtacgatctcagctcactgcaacctccacttcccggattcaagcggttctcctgcttctgcctcctgaattgctgggattacaggtgcacaccaccacgcccagctaatttttgtatttatagtagagacagggtttcaccatgttggtcaggctggtctcgaactcctgatctcgtgatctgcccacctcggcctcccaaagtgctgggattacaggcgtgagccactacacccagcctaaggtactttctttttttttttttttgaaatggagtcctgctctgtcacccaggttggagtgcagtgggacgatctcggctcactgcaagctccgcctcctggattcacgccattctcctgcctcagcctctcctgtagctgggactacaggcacccaccaccatgcccgactaattttttttgtatttttagtagagacggggtttcaccatgttagccaggatggtctcaatctcctgaccttgtgatccgcccacgtcagcctcccaaagtgctgggattacaggcgcgagccactgcccctggccctaaggtacttttaactgatggtaattgctgtttcagttataagtaatgaagttggagtagtaataagcctccttttttctataacaaaaataaaggttggttttgttttttggttttggattttttttttaaccctttcctctttccagtggttttaatgtatagattctacctgaagggtctgttttggtggttctcaaagtttgccgtctgtggttttcatgtgcccagcactcttctcatcccataacaccttttattttacagcactgattcttaactggggtgttcacagtcctaaccccaagtaagaaatattcttaaattgaactcataaatagttaatagctgaatcagagaataatgaaaacccagtaaaagttgcaagtatttttattatttttcactaggtgacagagtttaatggtacttcattcgaaatgggaaagaacttgccttttctcatgtaaactgttttcctgaaaaactcaagtttgcagtttgctagggaagtgctggcacagttgcgaaggattgtgtgataatatactcattttacaaatgtgacagatgacacccagaatcacatctgaaaagttagaggaaacaatgagttaataggcctctcaaatcagcctgcactgtaaacctttctcacaatatttaaactctaccagatgggctttagtttgtacctttttattcaaacatgctaataaagtcatttttcgagttagaaagcagcctacatattttagttttttgtttttttctgaaatcagaatgttgcacttcttaaaagaaaatctatgttgtaaatggaattgtggcctttccatttccttcactaggttagtaaatttttttttctttttttttttgttatgaaggaacactttgatagattagtaacttaaatcacacagtgcactcataacaactctaatcaatgcaaggactaaaaagttactcgttctagtttacctccttcatcctcttaatctcactcacctctgatttaaacacttagggaacatgctaaagggatacatgattgattactcaatctggaacctaagttgttattatatacaatatatagtgctattttgtgtcccaggtaccagtgttcaacatttctggggctttgcttgtaaatacatttgactggagatttaccattataatgctatttatgctaccagcccagagccagtcccagagaagtggcccaattgaaggctttctttccaaacttcagtgctcctggctcccaaatccattgcccaacccagcatctaggattctaaaaatgattgatgctgatgtagaatggaatgtgtagaacaaataaaggataaaaggttcacaatgcaactaggcaatccgatctcaaagcagagtgtattcaatttctgagtaacctgagtcaaagctatggtaaagttagagtcttaccatagtggtctgtccccaagattgatagagatcagtgtgtgcagccactcttaaaatcagtactcttagtcatctttaatattctgcctcccctcaaaaaatgaatttagcacatcaaggatcttatgtattaaaacaaactacagcaatctccaactttacagtggtttgacttacgattttataactcgatggggtgaaagtgatatgcatttagtacattcttaacttactacgggattacatacagaaacccatcataaattaaaaatatcataaatcaggctgggcgcagtggctcactacctgtaatcccagcactttgggaggccaaggcgggctatcacctgaggtcaggagttggtcaggaaacaagccgggccaacatgtcgaaaccccgtctctactaaaaatagaaaaattagctgggtgtggtggtatgtgcctgtagtcccagctacttgggaggctgaggcaggggaattgcttgaacccaggaggcagaggttgtagcgagctgagatcgtgccactgcactccagcctgggtgacagagcgagactccgcctcaaaaaaaaaaaaatcataaatcaaaaacatacaacttaggatggatatatcaggatgtagccccattgtaagtcaaggagcatctgtatatccagcaggtaagtttttttaatcagtgggaagcacactccagagaacagccactagctgtatagagcttggcagaggtaaagccgtaactgctggttgagagtgttgtctgaatttgacaagccacactcatcggactcaaataaaattaagaaatagtttttggagatgaggtcttcaggataattctatctggattaggtacagctactggtcagtcagattaggattcatcagcccataaaaggagaaaatgaggttggttgaggtggctcactcctataatcccaatactttgagaggccacggtgggatgatcttcaaggccaggagttctagaccagcctgggcaacagagcaagaccctatctctaccaaaaaaaaaaagccaggcatggtggtgcacaccctgtagtctcagctacttggaaagctgaggtgggaggatcttttgagcccaggagttcaaggctgcagtgagctatgattgatgcaccacactctaacttgggctacagagggagaccttgtctccaaaatgaaaagaagtatggctgcaggctacattcaaactaagatcacaacgaagtgttgagtatgtataaatgtatgtggatatgtttgtgtctaagtgtatttccactagcatgctaaggtatgtttgtgtgtgagtatgtttcctccagtatgctaagttttgacacatgcaggcatctaacttgggtgttatctgtccttcctttgcccaaagcatagattataattgttcattctcaaaaatgcaactcttatctatttcccctttatttgaaggcagctgatggttactctgcaaggtgtaagtttctcttttaaaaactaagcggtcgagcatggtggctcatgcttgcagtcccagcacgtgggagtctgaggcggaagagttgcttgagcccaagagttcaagaccagcctaggcaacaaagtgagaccccatctcactttggaactcaggactgcagtaagccatgatcataccactgcacttaatcctgggtgacagagtgagaccttgtctcttaaaaaaaaaaaaaaagagagcatgtatatagatgttttaaggccaaaggctgtggaagccaggaaggaaatagtagatatgatctatcacaattcggggtgataattagttgcacagtagaggacaagttttgttggggtgatgattgcaaaggtatttgtatcctgacttgttctaaaaaatgtttgtggcagtctagagaacgctgatatgagctgagcttctttataaacttactggctggccatcatctttattgacttagattttatttaatagaagtaataatgaggccaggtgccatggctcacgcctataatcccaacactttgggaggctgaagcaggtggatcacctgaggtcaggagttcaagatcagcctgggcaacatggtgaaaccccgtctctactaaaaaacaaaaattagctgggtgtggtggggcatgcctgtaattccagctactcgagaggccaaggcacgagaatcacttgaacccaggaggtggaggttgcagtgaactgagatcacgccattgcactccagcctaggtgagcctgggtgacagagtgagactacatctcaaaaaaaaaaaaaaaaaagaagtaataatgagtataaaataaaatagaacttttctggtattattgagtgaatcggtatagagaattacataaagcactagttaggcttaagttttaattgtatctacaaccagtccccatctaccgttcccccaacacaattaccccagaaatcaaactccctaagacagcaaccaatattttggcattcaatactcagtaaacatttgaaaagaatgaacatatggttatatgatactttgggggtaacctaactggaaagaaaaattatagataagcaggtgaaactgatattaatatgagtattcaaatattctatttatttgatcattttctttcagctaaaaaattgccaaagaatgaaccacaaaatccaggagcaaattctgccagaggaagaggagtagaccttaccgaacccacacaaccaaccaggaatcagtgttgtagtaactaaacctctagtttgaactagctggaatagtcttctgcttcctaaatgttaataacaatggaattggagcatttaaccagcccagtatgacttccaaaagaagagacttatgatagagtcaagtttctaatacagaattattttaagtgttttgaacttaatttttaataacatgcatgggtccctctcactaatgtttcaacaatagggaaaaatgagaactatgtggacacttgtttcattggaaggttagggggaataatttctcatcactaggaatatagacaaatgactgtctgggcccacacagttaaccagcccatttctccacactggtacagtagtcacctgtgaaaaaaaaattggaacttactaatttgggcttttcaaaaacattctttgtttagaaggagattctaaagttatttatgatgcttagccatagtattcaggcaaatgttcatttctcctggtacctgtatttaaaatgtacattccacattttaataaattaaccacaagaaaataatcccacatatacaaggtcaggggtggggaagagtattaatggtatcttaattatacccagtctggttttttttttttaaatggggtaaaaatcaaatgcaaccccatcttgttttaggaattttgagaactaataaatgcaccttaatggtcagtgttcctttcaaacatgtgagttctttaacaaaaatgaaataaaccaggtgtctgtgatttctaattaatcaccgctggccattacacaggttttgttgtttggggtggggagggggcttttgttcccttttgacataatatagtcaatgcactaacaattatgtatattcaaacttgattattttaaattcgatcttcagctgtactgtaaatagggtactgcattgtagtctccatatctgtattacttttctgtaatatttaagagttgcttaaaagcatacaaaatgtactgttactaaaacagctaattatttctctctccccctttgacaggaaggggcttcagttgttcctccatggctagaaccataataaacaatgtacccgtaatttgtaacataaagtattgcaatatgttagtaacaatcttgcagccttcctttccaaagttcattttattttgatcagttcagtatattgcactaattattttaggtattttcattatatgaaagctaccatgtgtcagagatgatttaatctatttaagtgttggactgctaggagaacttgtacatttatgataatgcagaattaggaaaacggttcaccagtgtttagttttatattgaggtgctcaggtt

SEQ ID NO: 36839 - DNA, 5642 bp, Homo sapiens
gatcaatactgaggccgcgtccgacccccttgagccgagatccccccccagcccagcccccaccccaccccccgcacacgccccaccccccccacgacccagcctcataccgcaccagctgaggcacccaagaggattaccccctggggccctctcccgccccccaaaaaagagaagatcccctctcctggcccatcccttcccttcttccctcccccctccccccgaactttccctctcgcatgcttttcccctgcaccacggatcgcctctcggatgccgcttgcctggaagctgcgttaggagcgagcggcggcggtggcggcggtggcggcggcggcggcagctcgggagtgctatgaccggcaaactcgccgagaagctgccggtgaccatgagcagtttgctaaaccaactgcctgacaatctgtaccccgaggagatccccagcgcgctcaacctcttctccggcagcagcgactcggtagtccattacaatcagatggctacaggtaagggcggcggggaggcggcgaggcagcgaggaaggaaggggagaggaagaggaggaggggacgacctggtgatggatggatggatggatggatggatggatggatggatgggtggatgggtggatagataaatggatggagagatgggggcgcgctgggaattttgcggggggcgagttgcttttcccacccactcctcccgccctcctcgatcgagaaggctaggttggcgacgccacggtagaggcttcggttctcccgggtgggggcagccgccgaccggagggaggtaggtgcgagcggctctggggttctccctcaccacgcagggggcccgatcgccgggctacgcgcaaggcgtggtgctgtcgccctcttcccgggaggagcccggcgtctttttcacccgcgctctccccccttactccctcagcctcccacccgggatggagccatgtgcggcgtggagtccccgcggtgggagaggtactgcgacgctgcctttccggggcgttcagcaaagccgtgggggtgtggggacggcggggagaaggagggggttcacccgcggggcgagggcctgccacggggaacgatcccggggccggggagctggggaagggcggcctctcccgccatggagacaccggccggttttccgccgctctccaccctccctagctggggctaggattttcccctccagcaagagcctaaagctccttcatgcccgaggaggctggggccggggtaggtgaagggagagctccctttgagggcgacacccttctacgctccgaggacaaagcgtcggagcgctctgggtcggcgacccgggagcagcgcgcgtggggggcatcgccggggagggaaaggcgcggcgtcctggagcggacagggccaagggaagaggccgagttgtgtgcggtggagagcgagagcccagcgcgctccgggtctgaaactacctgtagctgcagctacctgcccgccccacctcgggaagaacaacaatgcttctcgcgcgcgcgcgcgtgtgtgtgtggtacgtgagtgtgtgcgcggcttgtgcgctgtgtgtgcagcagccactccacaccccgatccgtagtattttgctatatccaggttgcgcccgggagcgcggcaccgcccgctttgcgcggggctcagcgttcctcttaccccatgcgctacgcactccacccggccgcaccctccgcacctgggcaaggacctgggcgccgcggcccggagccggatcggcttcactcacccctcccctctctcccccgctctccgcagagaatgtaatggacatcggtctgaccaacgagaagcccaacccggaactctcttactccggctccttccagccagcccccggcaacaagaccgtgacctacttgggaaagttcgccttcgactccccttccaactggtgccaggacaacatcattagcctcatgagcgccggcatcttgggggtgcccccggcttcaggggcgctcagcacgcagacgtccacggccagcatggtgcagccaccgcagggtgacgtggaggccatgtatcccgcgctacccccctactccaactgcggcgacctctactcagagcccgtgtctttccacgacccccagggcaatcccgggctcgcctattccccccaggattaccaatcggccaagccggcgttggacagcaatctcttccccatgattcctgactacaacctctaccaccaccccaacgacatgggctccattccggagcacaagcccttccagggcatggaccccatccgggtcaacccgccccctattacccctctggagaccatcaaggcattcaaagacaagcagatccacccgggctttggcagcctgccccagccgccgctcaccctcaagcccatccggccccgcaagtaccccaaccggcctagcaagacaccgctccacgaacggccccacgcgtgcccggccgagggctgcgaccgccgtttcagccgttcggacgagctgacccggcacctgcgcatccacacgggccacaagcccttccagtgccggatctgcatgcggagcttcagccgcagcgaccacctcaccactcacatccgcactcatacgggcgagaagccctttgcctgcgagttctgcgggcgcaagtttgcgcgcagcgacgagcgcaagcgccacgccaagatccacctcaagcaaaaggagaagaaggcggagaagggcggtgcaccctctgcatcctcggcgccccccgtgtcgctggcccccgtggtcaccacctgcgcctgaggatcgggcccccagatccccacttttcccctccagtgcctcccggctgctagcctgaaagcagcgggaaagccagccacggaggcgtaggggccgcgccctggcctctccatggacgtgcggccccttgcttccccttcgatgcccccggttcccaacctttcacgccggccagcggtcaggggccagggctggaggcgccttcccctcgcggtcccccacttagccaaggcgtgggggcggaaaggtggcgtctagcccgctttgttcagttcggatcgccttgatccaggggccgccgggccgcgccaaggacctgcaagggactgaaggcggagcccatccaaccctcgcccgacccaaacacctcattgtttcccccacgtctccctctataccccctcgaagactcgagagggggagggggtaaggagcgcaccaaagcgcagagcttgctgcccgccgcacgcacgcgcgcctgcgtgcggggatgcgcgcgagtgtgtgcgtgctcgcgtgtgtgtgtatgtgtgtgtgtgagtgtgtgtgtgtgcgcgcgcgcaagcgtgtgtgtttaagactcttgagctgaactgggctgtgtttaccccaaactcttccccacctcgggtccccaagccgctgggagatgtcccatgctgggggtccgcacgtggctggaggaggtggtcttccatccgctctgaaatcatgtttcttagagaaatgcctcggatgccgccgacgcggtgctgctgccgccgcttcgggtttggcccctcagaacccctccttttctgagcgcttccctcttaggcctcagggcagtttgatctgtggggagaaagagcagccatcgctgagcctgccttttaaaatatatgtgtatttccttagccccactctaagaaatctatgttcctgagtttgccccctgccctcccactccttccccttctcccctctaaaccttctcccatctctttcaaaatcttttcccagaaaggcaggcttcaaccagccactccagctttgtgtcttctctcaattacatagcaatttctccttcccaccatcatggggaagctggctctgcttttgccctttgtcatcaccaacacaacagatagaatttaaatataagtatatggtgtgcgtgtgtatgtatgtgtatgtatatgcatgcatgtgtataaagatgcacatgcgtacatatacataacatacacacaatatgtattcctagcaaaataaaatctctaaggtacttggttatccagtgcagtgcaccggaataaagagaatttgtaggcgtatacagctttaaatgatttattttttatgaaaatgttaactgatgagattatatctacatacgtgtgttatgtgtgtggatatagatgcacacatatctgtacatatacatgtgagtgtacatatatacacatatacacatctatgtatggatatgtgtgtatacacatatacacatctctgtccaaaatttcctcaaagatatggggattttttcatgaatccatgtggatgaatgaggtgtctcctttccatacccagtctcaccttctccccaccctacctcacctcttctcaggcacccctcttccccagctgtcctgccagcccttctcgtacagggtggctcctttgaagtggagtaatagggaaggttgctctctgccacagcttgcagcatggtcttgactgaatgtactgttcctgttagcgttacttctcctgtggtcagtaagttgcccagagagaaggaacaaaggtctggagtttacagaatgtctgtttttaaagtcactttatgcgttttccacttttttcttttttaagaaaaagaagtaccatttttgttttgttttgttttgatttttggtggtggataaataatactaaaaggactctagtggaaaggggggatatcgaagagcagggggttgtgaatttccaggtacttggactttttgtagaaggagagagaagaagatgaagtttgccaggagggcccatattttttcagctgaagggtaaaatctttctttgcagagacagtattttgctgaatactttttataatgtgatgattattaaaaaagcaaaaattttggtcacttccaagctagaaggaggaatcagataccctttaatattttttcctcgctccttctggtatatgcatgtcactgcatgataattgagttttcctttgttttaataaaactgttctcagacattaagctaaactaagagaaaaataactttgttgccaaaaggttgtgctatccagattttttatatgtctgcatgtttaaaaaaaaaaagcaacaaaagaaaatgcactctaacttatgtgaactgagagaaaaaaatcaggttttaaacaggaaaacctatggggaatgatattttttgaaagacttttgtataaagttgagtacttagaaaaaagacaaaccagatgtaatatattttgtggatgtttttatttcttggatttatagtaccttatactaaggttaaaaaaatatgcttgatattgtgaaaaggtgaaattcttcaccaacatttcatttgctcctttgtcatattgtaatgccaatataatatagttaatgaaaacagcatttttaaaaaccgaaatattgaaatggtgtaatgttgtaccatttgcactgtgagcaaatgctaatacagtaaatatattgtgtttgctgacaatcagccggcctataaatctccttattttatttcttgtttttatagcataaagctttagtttggcctg

SEQ ID NO: 36840 - DNA, 29224 bp, Homo sapiens
gaggaatgcggtcgcccccttgggaaagtacatatctgggagaagcaggcggctccgcgctcgcactcccgctcctccgcccgaccgcgcgctcgccccgccgctcctgctgcagccccagggcccctcgccgccgccaccatggacgccatcaagaagaagatgcagatgctgaagctcgacaaggagaacgccttggatcgagctgagcaggcggaggccgacaagaaggcggcggaagacaggagcaagcaggtctgcgcctccccggccctgcgcccgcgcccagagcgccgggactcgagcctggcacccccggctggatccccaccccgaggactcggggagccaccaccctacccccaccaccacccagggcggccagggcgcgcgtctggaaagaaggaagggaaacgcaagagccaggcttagtctaacttagtctggtctgaggacgcttatttcccttctctggttcccatggcccgcgaaatcaagtcctagaggcgctttattctcaggactgggaatcagtttgggggagggaggaggacacccggttcctggggacgtttgaaggaagggcgagggatggagaaagggggtcgagtaactcaagtgttagaagttcgttgacttttgactggggagaaaggaaccttaaacttggggaggagaagggagtcctggagttgttacctaagaacaaagatggggcggaatggaggctacagcccgaaagccaggccagcagtggcgttcttctgtgtccccaagtagtggacttgagcccgctgagacctcggcaggagtctcgtcccagggcaggtgggtgtgcggggtgagccgcggagcggttccagctcgggtaaagaggaagttacctcgggtcctttgcactccaactcggcggcgccccgagcccgaggggccccagccaacccgacgcccgtgtgttgtgtgtgtctaacacccggtccgtgccggccgcccgcgcccgcccgccgctgcccccagctcgaggaggacatcgcggccaaggagaagttgctgcgggtgtcggaggacgagcgggaccgggtgctggaggagctgcacaaggcggaggacagcctcctggccgccgaagaggccgccgccaaggtacccggggcgcgcggcacggcgtggcgcacgaatggctaactctttctctttctctctctccctccctgtctttccctctgtctctcccgctgtccctgtccttctggttctgtgcacccacacccctccccttcgggatcacgctgcctgctgcacccccctccctccctgtaccccctggccaactcccagctggaagatgagctggtgtcactgcaaaagaaactcaagggcaccgaagatgaactggacaaatactctgaggctctcaaagatgcccaggagaagctggagctggcagagaaaaaggccaccgatgtaagtgcacgctcacactgcttccctcacctcttgcctgcgtggccactccggggtcaccacagggctggagagcaatgaaggaagtttaccttttcctgctggacacctgcacacagccctgccatggcccagagcattggatgccgcctctgactgctactgcacacattcatttatatttcatccactcctctcttcttctcctttcctttacctccctgggggtggaggtgggtggatgagaggctgggagaatagagcagctgaaattggactctggaggtgaacttcacctccctggtggcagaaaacccttgaggtgtcatcaccaaggtttgtgtagagaatgccaggttttcttcactttctttccttttgccgtttccagtgggtgggaagttctgggtttggtggtgggtctagtcagggttcagagaacctggcctctaaatgaaagaaatgacacagcggtacctttacttagatggctgcacttcatggtggggcacagagacactttgaggcttcctttctcattagtgtaagccttaatccaccccttaagatctgcctgggaagatgatacttgcttgggtctgcagtctgaaggcactagatccagaaagtaagctgtgagttatatatagctcagtgctttatatggtatagtgagctagctgccccctgcccctcctgctggccccgcccccacctgtcagccttctgacaaccaccacatagttgcaggggtgatgcacacagctaaggctctcctaagctctttgtccactgccctttggaagctttttaattgatagcttgcctcttctgcctcggaaagtcaagccaaaggaccaacttcttttcacaccgttggattccattctaaaagctaattaagcctagaggcccaattagaaaagaattccttgggaagttggtaacaattccaagaatgtgtgagcaccagggaaagctatgccagcagttgaaacaccgagagcaacagcagacttttttatatgaaagtaacatgcaaataactgaagggtctcaggtcttgaaattagtgaagtcttttgtagcatgaaaggcttgagatgtatatccaggtgtgctttgtaaatgagaactccagagacgacatttaggatctgacaaaaagaaattttcagtgaaaatcaagcttcctggaaaggggatttggggggaagcactgatttcgctaaaacatttaaattctaaactacctggctttggaaaaagagccaaaaaccatatatgactctgagcctactttgtataatgcagatcagatgcctgctctatatatggctaaatggaagatgcctgcctcccgcaaattctccagcaggacgtttatttagctttttcaaaagagctgctaatagatcaaggaaagatattccttataaggaaaagaatgcagagaatttgaaaatagcccagtaagactgaaggcaaaagagggagaaaaaggttactacaattcttaagggaaaaaaataggataataattattgtaactatgtagtgctaacatgtctttattgaaaagtcttgttgaagggagcgctggaatggggtggggcagaaatgggaaagaagttatttaaagtcagctggtgtgggaagcagcaggggagggagcttcttgaatcttgttttggttatttttcccaccgggaaactgcccctaaatctggcatatatggcttttttgatagtgtattgatcacattcccttttaggacactttaggttgtctggagtttggagcccgtaggaatattgaagaagttagtgaagaaatgctatacagtcatttgttgattaatgaagggggataaggtctgagacatgtgtcgttaggtgatttattcattgtgcaaacaccatagagtgtatggtacttacacaaacctagagggtatagcctactaaacacctaggctacaaacttgtacagtgtgttactgtactgaatactgtcaacaattgtaacacaaatcaccaggcgataggaattttttagttctattgtaatcttatgaggctactctcatatatgcagcccctcattgaccaaaacatcattatgcagtgcatgaccatattgagagtattcgttttttatttactaaaaaatagtcaaaacttgaggaggaagagacagatgtcactagaaaaagggagaagtccggtaagggagaagtcagcttcctgaggtggaatcgtattacctttgggattaggacatttcattgtcattattcaccagtgtaaaacacttttacatttttctactattattactaaaaacatttttctactactttacaaatcctattctggaagtgggctctacctagcttagaagattgtcattcaggagtagtatccctgatggtcttgtttcgaattttgtgttgtctttccacctaagtcaaaagtgaggctgaaggggatcgaagactccatttttttctggcccccaatctcttccccagtaactgtgatatatctgatatttatagcatatgagtctttatccctttgtaggtctttacttcttaacttagggattctcaaccttctctaaacataatcacttagggagcttttaaaacccaaagttaggatgcacccaaagccagttaaatcagaatccctggggatgcaacccaggcggcagcatttaaaaaatacccaagtgattccaacctacagacaaggatgagaaaactctcctaaactcttgtataatgacatcggcatgaaaatgaactcacctgaaactgaccttcccaggacattaagtcactagttggctgcttatggcacttgccagtgtccagcagtttcctggctgctcctggaggttgccagacacccggttcccccattctcaatgttggaggcccacagtctctgcacttaggggaccagctgtaacctccccacctgaccagatgaaccgcggggaaacaaagcgagaagctcccacctacaggatgcaaggacccaagctgggatttgtgagagtctcagcagaggctgtgaggaactccacagaaaatgaggcaggaaagcaaaagttccttgttagggcttggaggaggagagggttgtcaagcatgttttctttattattcccacacataagggagctggctttaagagctttctgtgacaaacctgaggagaaaaagccctgagacttagaaggcatttaagaatacagctcaagggggaaatcggtggagactgtatctgcggtggttttctccacctgtagccagaggctctctcatagggttctgtggctttccttggggtgccttttaaaggcatcccagtccagcccaggactgactggattccaggagatctcagaggctggtctgacaccaaagaaggctgtaaagagaagagaccatttggatgactgttttcatggaaagtgagccccagggaggctggcctgagattacacagctgattatgggcctcagcctgactcttaaaacaatgcttgtgtatttcttaatcgtagctatcatttgagtttttaactatgtacaaggtattgtgctaagcgctttacagtccttcataattctcatagcagccccatggggaaagtactattattattcccacttttacagatgacgcccagagaagacaggtaatgtgtccgaagtcacgcagcaggaaactaggagccagagtcaacctaggaaaactgcatttagaacaggaggtctaaccactgtgctctacacgcgggtggttttcacttcgtgaagttttggggaatgggggtagtgcttgggttataatcttgcggttgggatcaggccctttagggcatattccggctccagacccgccgctcagcttctctggctcccgggcatgggaatctggactcgggagcggagcgctcccgcggccagcaggagtcgctattgcccttagcagccagctccgttaccccgggtcaccaccgcgccgcggaggggccctagaagtggaagccagagccctagtgcagtggcctcccggagcgcccagctcaccaggtacccccgcagcgcgccgggagcgcctttctccccgccgccgcgagcatgcgcagtgcccccagccagtcccgggatccacggcgcgcgcccctcccagccgcgcgcgcccgcctgcggtttgtctgcgcagccctggaggctgcgacttccggactgctcctggccgcagggggcgccgccatcgcacagagaggcctgggcggggcggaccggcgctgggcagccaggacagccgcggcagccgggtccgcagggcagcagccggcctctcccactgcagccctcccgcccgcctaccgtccggcgcgatggcggggagtagctcgctggaggcggtgcgcaggaagatccggagcctgcaggagcaggcggacgccgctgaggagcgcgcgggcaccctgcagcgcgagctggaccacgagaggaagctgagggagaccgtaagggatacacccatcaccccgcagcccccagaggcgcatcctcccggggcagccccgcagggccctcctgcttccccccccgcaggccccggtccctcgtccccacgcctccagggcgcacctggcgcacctgggccagctggcggcgggctctggggaggggcccggcctgttctcctgagcctttgttttccatctcgctgatccaaagtaaacgctcccaggggaaacgggtggtgttgagaaggttctggaaggagcattttcccaggaagggtctgtttctggggtggtggctttcagtcgtgtctgtgcgtccccgggaggtgcactttgcgctgctggcttgctttactctgagagtggagagggaggaggtccttcctcttggagatccgtactttgagaaggggcgccgacaggtcaagtgggagaggcactgtggacttggggcccggggatgctacactccgccgttcccgtcgaccctgtggtttcccggcggcctgtgtctccgaggcggtagacagacattgacagcttgacagcgccgcgttctgctggaagagctaaactatagtgcaaaacccttaacccgtcccttttttcagcagtcctcctccccttttctctcatacagatagataatgctttgttaccaagtcttggaaaaagttggcgaaatgtcaacagttattgggtgtattctcttgcgggcttcccctcccccttgttaaatgtaatacctggcttccttcctttcttctaaggcaaatgtatccagcaaacacgaacaggatttcagaggtagtctagtattggatatttgtcgattttgtgtgtgtgtgtttttaatgaagatactgaaacaaacaccttgggagttttatgacaattgatagtatgatgtcctgctgtgcttaatatacggggttgttctgagttgagtaaatcgttctagttaagtgtttgtaaatggctgtatggctggccacagaaacttcaagacctgaaatggtcctcttcagaggaaagctcaactagagaaagtttcagataaaatacaagcaggaataaggaaattaataggcaaaagataattctcagtatttgctttataggacgagtcagcaaaagtcctgtggatatccctgaacttggctgggtggtaaactaattccgactcccttactcgctagtagctgtccttgaaccattagaactatatagaatatgatggataaaaacaagaactttggacccagactgtcagaacttgaatcctgtctccactacttactagcagtgggcaagttacttaatctctgtgtttcagttccctgtgtgtaaagtgtggatagtaacagcatctacctgtcggttaaaggagttactatgtaaagacagtacactgatgcttggcgcaaaagggtaagtgctgtgtgcccgctgtcattaaaactgcacagccctggcagcccagtgctccttcaccttcagttccccacccagcaagaggtcttaaagatggcctgctcatttcatgacatcataaaacacttcatttactgcttttaatcaacatttgttggggcggggggcttgaatgaagaggaagtgggcgggctggtaggcatgtttgatgggttaaagtggtatcagtggtagaagtctgaggtctcctcaccctgctaagaaagagtatgtgtgaccctatgcaggagagccttgtattggctcctggcctagtgattgatgttagacacaaaagataaattttatgaagggcacattattacttttattcttaccttctcttttgcacgtcgtttttataacagaactcttcctgtgccagttggctaaagatagtactttcgttcttttcacggctttatatcaaaagtagtttaagtagtttcaatttttttaagtaatctttgcaaacaatctacctgggtgattgattgaacacagaaccttttaagacagcaacttgaagactggatcagaccattgaagagagactttcaggctgcaagttgttcctaacttctgaaattggaacttaaatgtagctgacttaggtatttagatgtagcttgggctgtgagttaagctagcagtaacagtttcttttggcagcaaagataaaggtttagtgacaaaaccatgagccactgcaaaaaatatttgaccagagagttggcctaaattcaaatactcagactgtaattaataggccctattaaaccagcccttaccttggaaaaagcagccatcccttacttcctcctagtctgtgtttccaaggtgtgtggatccttcaaaatgttggaatgaggctactttgcttgacatgattgattccagatcttgtgacccactagggttatgtttgctttttttcattatttaaagaaaaaggcaggatgaatcttcctttctgagtagtatccagcaaacaaggagacagggagttgtggccagaaggttcttaattagtaacatgattaaatcatgggaaataaccaatttacaaaaattcccagcactttccctctttacacttggtaagtatttccgggataggaaaaccgagggtgcattttgtgcttgcattggcactcccagagtggctgttaactggaatgtatactctcgatttccgctttcatatgtaggcaaggcagaggcactacaatgccttgttcatgtctgttctccctcattatacaaatatgcttcataaattatgggctttggcacacacaggaggttgtgtttatctgttatccatgggagtgccccttaatgtcatcagtgtttttttttttcccccctttccttaccatataagggcagaagtttagcttggctgtggtcacttggccttacacagcaagttgggtgaaaccttcttcgtataactacagtttgcatgaaataaaaagacctgacctttgatcatcccaagttccactccagttcagtcaggactttggaaacatattccagaggattgatttctagattataatattctcccaccagtattttttcttaataaccttaactggaatacttttttaaaaagtaaaagtcactgccatttttaattttctgttgttgtattggctaaaacatctggatttcatgaaaatctaggcctcataaaagttgtttttttttttttttttcaaatctgatttgggataatattatactatggtggggtgggcatgcccttgatttctatatagtaccatgttggggtgggggaatggggtgcatgcccttagaggagggtcatatgcattgtaaggcacctcaagtacagagcaccaggaagttacttaaaaacatctgcaggaggacattggtagcctttactaatacagcagtctcttttttgagtagttcattgttagaacacaatagcacttttgaaataaaagaaactagcatcccagattgaaagacttcactggcagtcagcacatgggctgctgttagaagaaagctaacttggctgggtgcagtggctcatgcctgtaatcccaacactttgggcggccgagacgggtggatcacctgaggtcagcagttcgagactagcctagccaacatggcaaaatcccatctctactaaaaatacagcaattagccgagcatggtgtcacgtgcctgtaatcctagctactggggaggctgaggcaggagaatcgcttgaacccgggaggtggaggttgcagtgagccgaggtcatgccactgcactccagcctgggagacagagctagactccatctcaaagaaaaaagaagaagaagaagaaagctaactcagtacactaagagtgatttacatgcctgcaaataatttgtgtctggggtcttgaccctccccaaatgccttgttatttatatctctgcttttagataacagatggtcatgtgtctatgggcttgtaccggcagaggcaacagcaggtccttaagactccccaggtgccatgatgaaaagaaccttagaaaatattgaaataagctcaaaacttaaaaaaaaaaataccagaaataaaagctagtaaaggtgagaggtgtggggcttttggaacatagagcataataaatcagaataaaaagtaaaaataagaaagagaaaaaagtggccctgattaaattataaaattaagcatatcttgaattctaacgagccaaacaaaaattctactaggccagtataatagggcctgcagagcctgtcatgggttcagggttttcccataaagataggtgtacctcagatactactcctaggtcctggctttaacctcaaagcccctctgcctgtcctgctctgaaacctctggggcagtaggcattgacttctgggctagggagtaaatgttccgtgtccttatgtgagcttcctattacccattagcattgttttatgaagttttcaattttatatcctgcctcatttcaaaaagattgtgataatcactttagcagatgatttgcattgcagcaactgttctcccagtcctggttaggatctgtgcctgaggccttttgtggggagttggggtgggggccggagaacatctcaatctgatctcaggagagataaagacacaggagtgagaactgccagttccaaggtttccgtgatgttccgggaagccaggagaagtgacatagtggagagccggcatgctgggagcctagtgacttggatcttaatcctgtctcacactgatggctgtatggcctccacatacttctgtgcccagggtcagagttccctcctgccgcctgtttctagtcaagagctagaagaatagccagcttctttgggtggtggcaaaggggattgtttatttatagtacagattcctgccctccccctttgacctcctgaatcagaatctctagggacacggcctggaagtttgatttttttttttttttttttgtttttgagacaagagtcttgctctgtcgcccaggctggagtgcagtggcatgatctcggctcactgcagtctctgcctcccgggttcaagcaattctcctgcctcagcctcctgagtagctgggattacaggcatgtgccaccatgcctggctaatttttgtgttttttgtagagacggggtttcaccatgttggtcaggctggtctcgaactcctgacctcatgattgcccgcctcggcctcccaaagtgctgggattacaggcgtgagccacagcgcccagctgaaagttttttttttaatgctcatctctgagttgattctgacactcagccacttgtgggaattgctgatctggacaatgcctagggatccttctagctaaaaaattgagaccctattttttggatttacagggcctcctcaggaaggggcagccactctcaggtctgctgtgtgtgccctaccattcctcccactatatcacaaactggcacctagaaactggtctccatgcccagtcgttgctggggcaccctgtatgaagccctgctggctggtattcctgtaggacatattctctgatgtccaggagtctgaggttctacagaatgcccctggggaaacaagagtggcatttagacaacagcattctgtaaacacagtgccaagagctaagggaaagaatgggggtgggggtgatcggagggaagacacggatggattggtaggggccctttgggtaggaagatctcatgtgcaaggctggaatgaacatgaggtgctgtttccttcctttctggtgactcggctgtgtggggagctggggatagagacctgtcacccagagggttctttccccaaagcataaacagtcgtctttctgtgagtacaaagtccttgaggttcaggcccagatctaaagcagagcagagaacttggaacttggtagctacaaaaaagttttgaaaatcttgctggcatttctctaataggccatagcctctgtaacaaggatatttgccatcatattgaaaatgataagaaagggggaaagaaaagaaagtgtacagtgcttttgagtacataacctagacactctatggaggctttttgttgttgtagggcttttggtttgtgtgcttggtttttttgtgtggctttaaattttgttttgttttgtttgccctttgtttttgcttccgctttgagtctcccccccaccctcaaaaggaatagaattttactggaaaatgaaaatatagaaaagtgaagaaatcttacctgacccaaaagtatatccttaatatatacatccttccagtaatagtaataaaaaaaaaaagcctaatggtttttaaaagacacttccctataattgagagatttgttatcctattaccctcacccttcaatacacacacacaccagaaacaacagtcatctgccagtaattcctagctgggtccatttaccagctgtgcactgataatgatttactttgtaggcagtacagttgtaaatgctcttcctctgatttatttcacatttgccctgctccctgcctccatcaaccaattactacatttttgtcaagataaaagtgtatttacatgtttttatagagtccttcaccgtggttggagatgccctactcacctctcttcccagataaaacttggcatttaaaatcttacaaatctaggtgagcaaagagctgaaggttctcagattcctttgattaaagactatgaccacagtttctaactacatttgcatttccaactctgtattgtggatccataagctgagaacgttgcttttattaaaattaggttggttttactcatcttactgagcccatactctgtgcagagaactgtgagttctctggatgtgagcagcttacagttcaatgacaaagacagggctgtgtgtagagaaatttgttatcctattaccatgggtccctaagtgtgtattgtaatttctagaaaactcctaagtgttctgaaaaccccaccaccccttagtgaacatacattcaaagtggatgaggatattttacctgattagtaaattccatctcccacttccatgcacaatatttaaacagccaccagtgcaagtgtgtataatggaccatcatagtcttataagtgttctgaggctcatagcaacaatttcttatgacaggaaaaaaatcattgcctctcaaagaaaccaacattttatttcagtgacagataccaagtaaaaacagtacttgtattatttttctttttaggagtttgatacttttcttgtattaaccttgacttcaaagaaaaatcataggcttacatcaaaaacacttgggaaatttgtcttggctctgttccaatgaggccagttattctaaaaggggttactggattgtgttgggccttcatgtggtgtgtattttagaaccactgaattttaaactatttaagttcctttgtaaggatcctatgataaagtggcttgaaggaaagagttgagtgaaactcttgagtccgatttctggctgtactgctattgtcttacatggctgagcctgggtaagtcttgtctcagttcacacttcaggcccccagtgagtgaggtggccgtgatgacgctcttgtttaacaggcaagtaaagccagggtgttgaactctacggaagtgggccgggcgcagtggctcacgcctgtaatcccagcactttgagaggccaaggcaggtggataaggaggtcaggagattgagaccatcctggctaacacggtgaaaccccgtctctactaaaaatacaaaaaaattagccgggcgttgtggcgggcgcctgtagtcccaactactcgggaggctgaggcaggagaatggcgtgaatccaggaggcggagtttgcagtgagctgagatcgtgccactgcaccccagcctgggtgatagagcgagaccctgtctcaaaaacaaaacaaaacaaaacaaaaaaatctacggaagaaaggaaccatgtgaaagagcgtttgctaatgatctgtctgtctgatgagaattgtgtgtatagatttgtgtatacacaaatatggatgttcactgtataaatcaatgtgtaaatgtgtccgagaactccagagttgatgagggcttgtaatgcacttaaaggtagctcaccacaagacagtcttcctatctgaaatcagcattgcagtcccagccatttcctgaagctaccaccctcactttctccccaactctgaaatgcttttcactctctacctaggctgaagccgacgtagcttctctgaacagacgcatccagctggttgaggaagagttggatcgtgcccaggagcgtctggcaacagctttgcagaagctggaggaagctgagaaggcagcagatgagagtgagaggtgagaatgcctcatcagccatcttttgcagctgcctttcctggtggaataaaccggagggctcctgtgatctttgaggtttaagaatttttcagtcccctggtggtgggatcatttcctctattgatcccaggtataactcggttggttttgttcatttagcattagtgaaacacctactatgtccaaagcactgtcctaagccctaaggttacaaagaagaagatgatcttgttcctgcccttacagaactcaccatctaatgagggagacagacatgtaaaggagaaatgtcagggatacaagttggccctttcactcctactgaccacagagcaattgtgcattttttaaagtgtaactttattttataatatacaaggaggcttaggtgtaaataaaggaactgtggactatcagttgtcaaaatagcttaacaaataggtggaagaaaaaacacaaagcagaaacatggtctgcaaaagtaaaatattttggacttggtcttagtaatatacacaacacacatgcacacaaatagtcagatgctcgtgtgttctgagcccacctccactgtaatctggctgtagctgaattattactcagattcagctttgtggtagtaaaggaaagcatggttcgtatagaccagcacagccttgtgtggtctaaaaggcattttcccttaagctcaactgttggaagtaaggatttgccatattgcatagaagtacttcaagagagactccatgaggtgagagagcgttctgccgcttgagggatggcatagcatgaaggggctcagagcactgaatgtgtatctgtctgtgctgtgacctgggcaagtgaatgcagtcagtcatcttgtccatttcttactctttgaagtgaccctaccactaggtaccaggtataaagagtgatttcagactttaggattaaagaagatttttagctaaactttttaggccattattcaccgctgcttagtgtttcttcgctaaccaagcattttggacttctttaagatgactaagcatcttacagtgtacgcataagagcagttttgtggctgacttctttctgaaatatacttgttagtgtaccttaaaggcagtctggtaatgttagacttcggagtaaaggggacttggggatcatttagtcccttagttttacaaatgagaaaagtagggctcagaggctgatgtgacttgcaccaaggctcacagcatatttgtggctaagccaagactccgacccagatctcctcaactgtattccaatgcttcatcaaaagatagtgggccagatgtggtggctcacacctgtaatcccagcactttagggggccgaggcgggcagatcacttgaggccagggattcgagaccagcctggctaacgtggcataacccctaaatctactaaaaaatagaaaacttagccaggcgtggtggtgcacacctgtaatcccagctactcgggaggctgaggcagaagaatcgcttgaacccagtaggtggaggttgcagtgagccaagatcacaccaccgcactccaacctgggtgacagagcgagactctgtctcaaaaaataaaaataaaaaaatagtggttcacttatactgcctacttaaattttgataaatgaattccattttacatgacttgttattccatatatctgtaaaatatcataggtcatttagtatttttctgaaacattacaccacgctataggaccctaatatacaccatgccataggaccctaatacactcagtgtagaggacagtgtcaggcctgtctcccagcattgctgtcatgaaagggttccattataggtaaaacttaatttgatgcattcagttgaaccataagaaattgccattattacttgtctgaaatggtcaaatatcagcattctttgtggacttaatagtttattaaatctaacattaagtctaatatttttgtttatgggtggcagggtaagaagattctttgtagaaagaggtatataaagataagtttgattttgttctagctttggttcatgtgcaagctgaggcttcccacaggaaaggcaagaaatctcattatctttttaatagtaaagcatattggcttttccggtttcatactgccaagattcagacagattcctgacgtggtacctttcgtcatcattaatgttagatgcctgatagtttcatcagtactcaaagtgagagagttcattcacagtgaacagagagaaatgtgtctcttttttccacctttagctctggaaattgttgtttcctggtttggaaaataaaagtagctctgtgctctattttggtctaccacttacactaagcctcacaagccacagcagtgcagtgtgcatttgggaagttcagctctaaatcttgggttttcttgcttgtctttcttttcagaggcatgaaagtcattgagagtcgagcccaaaaagatgaagaaaaaatggaaattcaggagatccaactgaaagaggccaagcacattgctgaagatgccgaccgcaaatatgaagaggtcagatcctggggcccaaagccttgtggacacccagcagtggccttcaggaagccagggagcaatgtacagtcttgattcccgagtgaggccatctgctttgttggcagaaatgggtggttttgagaagcagagttcctttgtgtccagaaaacggttctaattttaatcctgctaggggatcccaggctttatcaggaagccaatcagtagcactgcgaagaaggaccaaaactcctctcccccagccacaaagacccggacaaaagatctttggccggaagggagagttgggccctgtgtcttgtgaaaggaggctctcatgctgtcatggtgcaagtcatttcttcccagagtgacctggcacatccagattgggcagcttagagaccacagacagtttctcagtggattcacagaggcctctctcctcaagggtggtagaaaactattatcaacgcaggttttcagcagaatttgctcctggtcgtgtccccatgaaaacagcctcctgtgataagaggcaacttgattattaaggtttctgttttttccttattggatcacatcgtggctatcctgaaacagcattgcccctcctttttattaccattattaccttcagattacactatgctcacaagttttgatctgcttcagaggctcccttcctctctctggttcttccactaaatacaaatttgattttgtcagttatctcaccaacttgtctcacgttagtgtctcttgtattcttccactgcagtaaggaggtagatgcacagatcagccatcaaattgatggagttcttaggtttactttgttttcctggcagcccccacctttttagtacatgtctcatcctactgctgtttttgagattgtgaatgtgtattttatccctccttccacattttggtctggctgccggttcacctaggtcagacttccaattgagactgcccaatcacagctaaccattctgagtcaaagcagaagcctctgatctcctctctgctggcactcctaatagagagttgcttctctctggtctaccagaaagaggatcatattgtttgtagacaaaacccttagggcctgatgggatctgatctctacccccatgcccttctgttacacaaagcttgcaagacccatggtgtgtgtgttgtgtcttcctgctgcaggtggcccgtaagctggtcatcattgagagcgacctggaacgtgcagaggagcgggctgagctctcagaagggtaagcgggcccggcgccaggaggccacgaatggggtgctgcagagcagtgactaaacagcatgaccttctggcagctgcacattacctgtttcagctccgggctccttttgtgctcatttgatgtggatgagccacgagtatggaacatggaggactcgtgtggggtgtcttatgtatgaatgcgtgtatcactgcatgccttacctgcacactgattttgtgaatggccttgtgcatttcctgtgtccactaacagccaagtccgacagctggaagaacaattaagaataatggatcagaccttgaaagcattaatggctgcagaggataaggtactgatggctcgtgtggtttttaggtttaactgcaacccagacatctttcagcttccaatgcctcctggttcgtttggtataacgactgcaccttcacttcaccctctgctatttatatcttgccttaagtgctttcccttggtcctttatgctcctttgttttcccttcataaatgctctttgggcagccaaaaaaggagccaaattatcgcacttcaaagttgttggatttggtcaccctgccttctgctgttgcgaggttggggggcagtgttcctggaaaacctaaacattttaatacctgatgatttggctactttaaggcagcccttcgtctctaggactcagttttcattttttcccatccctctcctttttctctcctccttcctttggcttgtctcccaccctttctgcctctgatcgaaaacattagcaaatgtgccgagcttgaagaagaattgaaaactgtgacgaacaacttgaagtcactggaggctcaggctgagaaggtaggccaggaggatggtgtgggggaaaggcatcttttaagagctgctcaaaagaggccctgccagaaagcaacacttacagtagacattttagtaaaatggcaatattgtgaggtgatttttggagagttactagataacaaattcttttttttaactagagaatttattttatgttagggatatgaggcatcaatttaatttaaaccaagtgccaagtggataagttatcttgttgttatcccatgtaaaacaataggcaagaaagcagagaatgtattgcagtgtgccatttgatatcagaggttccattacctcctaagagatccttaacatctgttggctgagctggcgagttctttgcatgagaagccatgagtagattgagctgcagcctgacatctggaatgctctttctaattacagtactcgcagaaggaagacagatatgaggaagagatcaaggtcctttccgacaagctgaaggaggtaatatgagagttgtggatgaagccaactggattttaaatgagtttgttttcatggaaccggtcagggccttttcattttaaagttccaatgatccaagtcaggaatattcaaaggtcgccttggagtttatgtactgtgctaactgccatttctcacagaggtgactgaaactgacaagtagtttctgatccattttataggtgatgtgcttcattttcatcctctagttttccctatgtttgtagctacaggaaacataaaacttcccaactttaactcaaataaatcattacaggctgagactcgggctgagtttgcggagaggtcagtaactaaattggagaaaagcattgatgacttagaaggtaagatcttaagtagtgtttttagtttaatccttatggttgaataccaacctggcaaaacaattttccaattcaagggcatccacattgatacgctcctttgcacttgcacattcttcctgtgtgtcctctggggtttttctctgtggctcttgaactcatgaacctaagtcttctgctcacgaggtgactagttagccaccagccatagtggcaaatgccatccagcttgacttcatgctcattacaagtgtggcaggtttatttttcactgtgagtgaggtgcttattggtgagaatgactctagtatattttatatctttagtgttacttcctaattaaattgggaatgatgtggtgattgtggtcttgtttttagaagaacccatcttcttccaagtatgaattcaaagtaaggatttaggggttattttaagtcatatattatcttaacaaaatactttatatcctgaaggaggagggaaaaattatacttaagcatttcttccctaaggcacttaggttttattttagtaataaccactctatctcacagatatcctaaatgttgagctttgaagcttgtgaaggattagctgtgaacaagaaagaaaaaagacaaatatctacatcacagaagggattagagaaggaactagtgtttggtgcagataataaccaaaatagtggagaagagagaatgacaaatggttgcaaaatgatctgccaaagtgcagcaaagtatgaaacctgcagcattacaaaaactaagttgcagacttgccatataaagtgtggcgcccattgcttttcaagcctcctggaccagtaataggcagcttgagtgggaagaccacaggagtagcttaaatggcactaagaaatcgctatcccagtggtctagtgtggtcaggaagtcagtggtttgaaggtggaaccagataaggactacaggctgtagtcacaaattgttcttccaaaacactgcccttgcatttttttcccattgtttatagctgcagatgcctgactactccagtgtaattaaaatatagctctgcaaaagaaagatgttccattagcccctgcctcccctcaccaggagacagccttctgtggtttcgtttacaatttaacatggtttactgatatacctaccatatttgttaggattttcatattgagtctttttcattttattttctaatgggttttgttctctttgtttttgtttcaatttacttaaaacaaaacgcacgcctcctgcattggccacctgctgcggcaccaaccccttcatgcattgcccttttcttgctgctgtgttgggatggtgcgcgcaccaccctcactcaccctccatttcttgatcactctccatgttcttgcacctctgccttccacttcctggtcatagacgagctgtacgctcagaaactgaagtacaaagccatcagcgaggagctggaccacgctctcaacgatatgacttccatgtaaacgttcatccactctgcctgcttacaccctgccctcatgctaatgtaataaactcaccaccatgccttccttgctccctaatctccatctttgcactcttgtgttcaccctttttgtcataacctagaatagtcattgttttttcactttctgctaatataaaggccaattagattaagtctgtctatacaaaccattttcttttcagaatccgtttattttgtaaacgctgaactagagcagtgaactagaatgagtgaccttgagcactgtccttttgggaaattaagctaaactcaagtaaaactagaaggccatgccgtttgttgtacaggaacttctcaaaaaatatcaaaatttgtttcctgaaattcaactaagtacaacataatcattttcgttaaatataatttgaaggaacccttaaagtgtcaggttattgagaatctgaggataaggaaattggcatgatccaatacagctttaacagtggtactacaaaagatcatctcttttacttttaagaattctagagtaggccgggcacagtggctcacgcctgtaatcccagcactttgggaggccgaggcgggcggatcacgaggtcaggagattgagaccatcctggctaacacggtgaaaccctgtctctactaaaaatacaaaaaaaattagccgggcgtggtggtggatgcctgtagtcccagctactcaggaggctgaggcaggagaatggcatgaacccgggaggtggagcttgcagtcagccgagatcgcaccaccgcactccagcctggacgacagagcgagactctgtctcaagaaaaaaaagaatggtagagtaaaaagaaccctctgctgagtaaccaagcctttaattttgtgtttttatgaaaggaattaaaatacccacgataaatatttaccacaacctgtgtcaaataaatgggaaattaaacacagattgtacaatgtgagcttgggagttaatggcccagattttactgttaggcagtaagagttggagtaggtagtcttgttatcatgagaagaaccttgaacagatacaactaatttacatattactaaccaaacttaaacattaaactttttctactactttaaattctaacctggaatgtttcagagttcttcattctaatatcaccctgaattccattgaagctggaaatgtcattttccaagcccacctgtcattcatttacccatgcagaaaaaatggtaacttgaagagagtggcatgtgcctgctgccttagaggttatagaatccccacagtcaacaaaaaagcctctagagacatgactgttgccatggaaaccagagaaaatgtgtcttctcatccctcatttgtaaatgagggggtggagcagatcatctgtctctaaggtctttttcagtgctaaaatgtggtgattctttgggaaaaactttttgcatcaagtatgattaaatattctgaaagacgagtgtagcttaaaattttttttgtttttaaattctgttcatgggtcttcttaaaatggacccttgccgaaaggcggcctgtgacggcctcaggtgggaagatggatgtccttccaagggtgtggctggcagtggggtttgcatgactgcttcttgtctgtgtttcaagtgctctcatctattggtttggtttcctttcttttttttttttttctcattgtgccactttttttttcctcccacctttttatcttcacgcagataagtttctttgcttcacttctcccaagactccctcgtcgagctggatgtcccacctctctgagctctgcatttgtctattctccagctgaccctggttctctctcttagcatcctgccttagagccaggcacacactgtgctttctattgtacagaagctcttcgtttcagtgtcaaataaacactgtgtaagctatttctgtttgctattctttttacttcttatttattgacattttagtttcaacattgaataaaactacaaagctgcttcacacatatgagggttagtgtttggctgctgctttttctttttaaatactgaacactatacagaattatatcaggagtttctaaagcagtagttccttgttgaacttcaaaaaaatacccaggcctgcattccctctcagagttctgattttcaaaggttagaatgaggtctggacatctgggggggttttgggggaattgtgatggctctgctttgcagtctgggtcacacaggggacattgcttgttgagagttgaaaggtctggcttgatcagtgtcttcctttgctggaggtttagctcgggatgtagtgacccctctgtgttgattatttcggtggccttacttgggaggacctggctaactaatgaaaggctcatgatgaatggttctgtagctgtcccatattactaggaagttatacattgagaagggtgaaaaagaacttggattcaaacaatgtaagttttggttattgtcgatcatccttttatagcacaaagaaaagttcaagcttttttgaagtatattcatgactcagccacctttattttgatcatgaaaatgacatcttaggttttctaaatatgattactctgtttagtcgtgatttgttttgtgctttttagcacatactctttgggagggattgtacataatctttgtgttcaatggctgtgttttcatttgtggacatttttaaaatatagcaatgaaagtttctttttttttttcccaaaaagatagttggtggaaattgttcagaagacaattgtatttcatttgggcttctgttttatttcacaaacagcaattaagtgatttttttaaaaaaatacattgcaaaaaatagaactttaactaatatggactttagtgttataattcccaacatttctccttcctcaacaatctagctatatatttctcctgttttttttttaacatggatgatctgcatgttttgtatatagtttttttagcccgagagggctgatataccaccatactcaaataaatttggacaaactcagaagatagtgtcattctcactctacagagacttcaaagcatagaggaaatacttttttttaaagaaagctgtgaattaaagtattttagtcatagtatggtggaattttagaatctggacaatgtctctcccttgagtttataaagacttccatgatttcatgcttttcttttcttaaggctccttgggcctgcttctgactatgattccttcctcattcttttttaaattcagaataagagaagtgtacccttctctgagtaaatcctgcttcctgatgtagacaaaatgccaagtctgaaagttctgctgagcagatgttcatgtaattctggaggcacatctgtgttttggaaatccttccagagactttcgcactttctataagtacactctacaaggggaagtggggcactaatggactgggagggcaggtcaggagtagcccaaggtatgcatgtgcaagaggaaaacttgataaactcaagtttatcaagaaattgttgatttcttgttcaactgttgatttgaaccaggcttctggttcaaagggccaggccatagctacagctgctctggtgggccaaaccaaaagcatcactgagtttgggcacttgaagtttcagacagctgggagtctccatagaaccggaagggaaaacacttccaaggatatgagcatgtcttgtccctgcctttgggccacccatgcacaccagctccacagcagctgaagcagagcagatccagaggaggctgtcggagggaccactgtccttcctgctgaattcatactgaccctctggattctccagattttctccaaagttcttccattctagcctggccaaacatttgggctcagcaaactgagacaagctccccacccatggcgacacttcctatgtccatagtgtgaatgtagtaatgggatatatgtcttggaacccccaagcatatgtcacgtgcaaaacaccgtgggaagcagtgggggtgtggtaaagagatgggctggaaaggctctttgtcctcaataagctgggcatctgatggggagatagaggagtgaagcgagtccgaactaataggcatgtgtatttggaggcaacaaggaagagagaaccattctgactgggagctccctggaggaggtagcggacgtttgactggggtttggcatattcaaaaaatgtggatgagcaaagaggacagagcagcagatattccaagcgagaaaacataacgagcatagcatcctcccatgtcctaccatttataagagaatgttaatgtgagaactgctcagtctcctgacagacccgggggctgcaggcacattttccctaggggtaggtctgttagcttttcaagatcatgaagtatttttaggtccaagttgtcaccagcattcaaagccaccgtgcatcctccagctgttcccagtgcataccgggctcttgcttgtcatagcttggatgtcccctggatcatcagatacagactgactcctgcacttgttttcccccgtaagcagatcacgtgtcagtgtgtaaaatgtatatcacgctggtcttcatgtaggtgttgcaagtttcgttcattttatacacatccattagcaccacacatgaatgccatcctcttcaagaagtaagcagatagggctgggcgcggtggctcatgcctgtaatcccagcacttcgggaggctgaggcgggcggatcatgaggtcaggagattgagaccattctggctaacacggtgaaaccccatctctactaaaaaaaatacaaaaaaaattagccaggcgtggtggcgggcgcctgtagtcccagctactagggaggctgaggcaggagattggcatgaacccgggaggtggagcttgcagtgagctgagatcacgccactgcactccacgctgggggacagagcgagactaagtctcaaaaaacaaaaaaagcaagcagataaattctaaatcagtgttgagtggtgacaagtgcttgttcttttgctgtttgaatggataacactatcaaagctagacaggagtcagaatgtgtaccctgtattgtggtgactgggggaaggacagagacttaattccaaatttcaaaaaatttcagtgcagcaaaagcagtaacccccagttggtcctacctgaggggaaagcctgccctgtgaacggagaggaaaggggttctggaagaggtgggcagcactgggcaggttgatgtttcacttaagttcaacactgagccctagcaaggggtggatgtcacgctgggctcgcctccagccaggcctgcattcccaaatctattgccagaaaccatgtatggctcagctcacaaagtggtttagtgaggtataagaggaacattcactcttcttcctcctcttatcctgttgctcctcctcccctcctttcctcaccaagagagaaattctgacacttcctaagtctaccaagctttttagggtctacccttcctggatacaggacaggtgactatggggtaagagtaaactgctcagcaagtgaccagttgctgtcctgcttgaggtctctttgtgttctctattaactgcctctcaccaagtctgctaacctgtcttccttctgcctcttttctgctaacctgcttgctgacctgtacagatcaactctaccagcaacttgagcaaaatcgccgcctcactaatgaactaaagctggccctgaatgaggattaaacttaagagtgaaaaaacttgggctgaattctaggcgtggagcccatgtgcagaaaatctaagactgtcctaccttcaactaatagagttgaaaacagttgctttctgcagaaatgcaaatgcaaggaattggctgaaaggctggccttgcctgcttgtttctctatatggctggaataattacgttctctttaatcacaaaacagcttttatggtagaatacttatatcaattcagcactgctccttgaaatagcaggtcctcttgtttgaactgataaataatgaggagcccccccaaaaaatgttttctatttcctgacagccatgagtcctactttaagtatgtatatatatatatatatgtgtgtgtgtgtgtgtgtgtatatattcctatcagatactcatattcctaacttctaaatatctggtatagtgtttgaaatatgattaaatgtacctatgcttgggcaaaatagcttttgaaaacaggaactcatgccagaagcccctggttgtctgaaaggtatgctttactcagtctaatggtgctgttggagtctggggagaatgtcatgctaataaatagaacactataaaaatattaagagaatgtcctaatgaagtgtgcatgaaacatgttgacaattttttatgagcaacagaaataaatcattttaaaagttctcagaaaacctatttatgtcatctttgcttttgtgagtttgtgttaccgcacaactcccagacttttaactgcctgtaccttggaaatgtctgctgttcgtaacttcttcagtttgtataacagtgctgcagctgtatttggtttttacctctccctgttcccacggcacaccgtcagtgaaccttcaccaaaccccacgtgcattttatcctcagtgaattgttggtggaggtgcacctgactgctctgtgagaatccgtgccatggctcctttgggtcaaagatgccctcccctccgtcttaggttcttgtctagaaatgagtaatgtcttacaagcatgcctagttctaatcatctcatcctgtgtttgtgattgatgtttgcctgcctaaatgtacaaaccaccattgtgtccaaagcacagctattcatgacttaattttctaatctcaccacagagaaagtggctcatgccaaagaagaaaaccttagtatgcatcagatgctggatcagactttactggagttaaacaacatgtgaaaacctccttagctgcgaccacattctttcgttttgttttgttttgtttttaaacacctgcttaccccttaaatgcaatttatttacttttaccactgtcacagaaacatccacaagataccagctaggtcagggggtggggaaaacacatacaaaaaggcaagcccatgtcagggcgatcctggttcaaatgtgccatttcccgggttgatgctgccacactttgtagagagtttagcaacacagtgtgcttagtcagcgtaggaatcctcactaaagcagaagaagttccattcaaagtgccaatgatagagtcaacaggaaggttaatgttggaaacacaatcaggtgtggattggtgctactttgaacaaaaggtccccctgtggtcttttgttcaacattgtacaatgtagaactctgtccaacactaatttattttgtcttgagttttactacaagatgagactatggatcccgcatgcctgaattcactaaagccaagggtctgtaagccacgctgctcttccgagacttccattcctttctgattggcacacgtgcagctcatgacaatctgtaggataacaatcagtgtggatttccactcttttcagtccttcatgttaaagatttagacaccacatacaactggtaaaggacgttttcttgagagttttaactatatgtaaacattgtataatgatatggaataaaatgcacattgtaggacattttct

SEQ ID NO: 36841 - DNA, 29224 bp, Homo sapiens; identical to SEQ ID NO: 36840

SEQ ID NO: 36842 - DNA, 14268 bp, Homo sapiens
aaacagcctctaccttgcgagccgtcttccccaggcctgcgtccgagtctccgccgctgcgggcccgctccgacgcggaaggtgagggctgggggaggggcccggcgctgacggagccgcagtgcgggtcgggtctgtggcggacagagagggtagggagcggcgaggtggcgatggcggccgcactttggcctgcgcctctgctgcgtcaggcgggaagctcggctgctgccgccgcctcggacccgggtttctggcgcaccgctgtcggacgacacttctgtcctttcttcgtcctggaaagctgggtcgccgagcatgcgggtctttcggcgccacggccgcaccccaggccgcaggcttagggcagaggaggcccgcccgtgcgcccttggggccgaggccctgacgcttcgagggtcgcggaatgagggaccgagggtggatttggcgggaactcactggaaggagtccgtgtggtggggaaaggctcccggctgcggatgaaggggggatggggtgggtatagtcgtgcaggccatgtgctggggtcgtgcgcctggcgggccatgtgccaagggttttgggggccttagaaaagggttcttaggccgggcgcggtggctcacgcctgtaatcccagcactttgagagtcccaggcgggcggatcacgaggtcaggagttcgagaccagcctgaccaatatggtgaaagttggtctgtactaaaaataaaaaattagccgggcatggtggcgggcgcatgtagtcccagcagctcgggaggctggacaggagaatcgcgtgaaccccggaggccgaggttgtggtgagccgagatcgcgccactacactccagcatgggcaacagagagagactccgtcttaaaaaaacaaacaaacaaacaaacaaacaacaacaaagggttcctgaagaagcctttgtgtttggagtggcgagactgctggaagacttgggagcttttagagtttatactccctatccttgatagttttccgattcttgaatttttatcgtcatttaaatactaagttgcttgtgttacattaccattccaaaaggggctgatggggctcacattccaagagttaacactatttaagttgctgggatcctttaaaagcgccattaccagaaaaaacacgaatttgtcaaacctccaaaaccacagcagcgggcggtagtctgcatcatttcttggattaatgaaacagatgtaattacaaacgagacacgaaattcaactagctcccctccatctagatttttccatatcgtgagaacctgttttagaatggcataatggtccacatttgggtttaggtgttgattttattatgggtaaggcttgtgcttgttcccacatgttaaccatatggcctcagccacagggcacttccaaaggaagtgactgtttctggtcttgggggtcttgtaaaaagagaacattgctcagtaatcgtctgtgattttagctagtgtgtttcaggcattattcagaaggactcaggtgagataagccaaaactgaatttgttttttgtctttctcaaagtgaaggaggtctaatgaatatccccatcttgcttttaaattacatttttaaaagtagatttttccccctttcctattgtttgacccaattttggagtgaaacgtaaccagttactatttccattcgaatttaaattagcaattttatgttatttgtttgttcaagcagtataactggagtgtagagctttgagggtttcaaaaagataagagatatagtacttatctcctgggcttccccctcccccctcctaaatagttttaaatgcttctaatgagttactctggttaaggataatcaaacacctgtaaactgccaggatcctaggtacatgctgtttttagtttgttgagcctgattcttgtctacaagagttctttgtgtattggaatataaaaggaataatttattacattcccaagggcagaattaaagacttaagtttttccgatttcatctcttgataagtttttctttaaaaaaataacagtttgtgtttttctgaggaaccaaaggtcctcttttttttcatattggtaacaggagaggtaatgtatttcagatggtgcagtctgtaaaatattttgaaccaaatcagtggaagaccaggggtttttctttttttttttctgagacggagtctcactctgtcgcccaagctggagtgcagtggcgcgatctcggctcactgcgacctccgcctcccggattaagcgattctcctgcctcagcctccgaagtagctgggattacaggcgcccgccgccacacccagctagtttttgtattttagtacagacggggtttcaccatgttggccaggctggtctcgaactcctgaccttgtgatccgactccctcggcctctcaaagtgctaggattacaggcaggagccaccgcgcctggccaggtttttcttaaactggcatttgaacatctggaacaggcagggagatgtcttttttaaagtataaatgtgttttgttacatgatttatgacaattctacttgtctttttttttttttttttttttttttttgagacagagtctttctctgtcggccaggctggaatgcagtggcacagtctcggctcacagcagcctccatctcccgggctcaagcaattctcctgcctcagcctcccaagtagctgggattacaggcgtgtgccaccacgcccggctaatttttgtattttttgtagagacggggtttcaccatgttggccaggctggtcttgatctcctgacctcaggtaattcacccgcctcggcctcccaaagtgctgggattacaggcctgagccaccgtgccttgccaacaattctacttgtcttttaaagttcaataaaaatatgtggcacgtatatgggatagtaccaaactggtgcctaaaagcagtgaaaccaccattggactaattggaatgatttgtctattggctgaagatttgaccacagagagattctgcttttttttccttgcagggatgaaaaattaaaaaaaaaaaaaaagattggttcctttttctcttcctagcctcctgacagtaagtagagagccagaagaatgatgccaaggcatcctggcctgctatgtggagaacgctctttccttactgtctcacttaatagaactcctgttctggcagtgtcagatgctgcagcagcaagggaatgccattgagtgattgcagtaagctatgcagcattttcatgtttaaaactactgagataataaagtgagaacttgaggccaccaaattttaagttgtaattagaaggattttgttaattaggaatatgagagtgctacagtgatcacctggaatggctccataaatacaaatgaggtgttaactagtgaagcaagttgccagtgtttgtgtgtttggtgagactcctaagttctgccatgaagttaaagaaaatattttttaagattcaagaaagctgtgtgaatgaattcaaaattattatgactgtagatcttttaaaaagctatcagtattagttttactttgatttttatctaaagagaaatacagaatgaatacttacagcattacaattcaaatgtgcgtggcttttttttttcttagttactagatatatagtagtaatacctttatgtaatattttgaagtagagattgaattggtataattccctaccttaaaaatattacacaatagcatttttgtcatatattacgatagcatttttgtgtactttaccacttaactttttttttccttttcttttttttttggagacaaagtcttgctctgtcgcccaggcgggagtgcaatggcaggatctcagctcactgcaacctctgcctcctgggtttaagccattctcctgcctcagcctcctgagtagctgggactataggcgtgtgccaccacgcccggctaatttttgtttttttagttttttttggagacggagtctcgctttgtcacccacactggagtgcaaatggcatgatctcggctcactgcagcctccacctcctgggttcaagcgattctcttgcctcatgcaccaccacgcccagttaatttttgtatatttagtagagatggggtgtcactatgttggccaggctgccgacctcaagtgatcttccctcctcagcctcccaaagtgctgggattacaggcatgagccactgcccctggccagtgtcagatgtttagtttgtcattaaaatggagcaagaatacataactcgtgaggttgtaagattatagatatgtttactaatgactgactcatagatatccagctgttaaaactcttcaagaagtaatcagggcaggcggaaatggatgtaattaaccaaggtcaagcagtaagttcaggaaccaggataaaaatacagaattgctcccgagtaagtactctgttttccattattctggctggaatgcaggtaatacagaaagtatattgcttcctttcattgctttttttttcttctttttttcctttgaggtggagtttcgctcttgttgcccaggctggagtgcgatggcatgatctcggctcaccgcaacctctgcctcccgggttcaagcgattctcctgcctcagcctcctgagtatttggaactacaggcacgggccaccacacccggccaattttgtgtttttagtagagacgggatttctccatgttggtcaggctggtcctgagctcccgacctttggtgatccacccacctctgcctcccaaagtgctgggattacaggtgtgagccagcacacccggcccccatagttcgtttttattaaaagaatctgggccatcctggctaacacggtgaaacccccgtctctactaaaaatacaaaaaaaaagtagccaggcgtcgtggtgggcacctgtagtcccagctactcgagaggttgaggcaggagaatggggtgaacctgggaggtggagcttgcagtgagccgagatcgtgccactgcactccagcctgggcgaagcaagactccgtctcaaaaaaaaaaaaaatctgaagtgtttcagtaccatgttgggacagtaaactgacttaacggagcataataatgtgcatacttacatacattcagagggcaaaagctccagtatggtctaaatgcagttaagtgaacaacatgaatgagtcagggataaccctgagcttgcgaaaagtaagcatatatacaaatgtgaatgtgtacagctgtgttagaaaaccatataaaataataaagatagccagaatcataccctactttgctagtgtcatttttatctccaacttgcctgttgctactttattttaaatgtattttctaggacagagttatgaacattctatttattagaaccctagttgttagtcttgaccacatactgttagattttagtagtttactatatttgtttttagtatcaatagtatggtacaagtactgacattaaggaagacaaattagtatactaaccatttgtggtttctttaattccaagataagttcaaaatgtgtaaaatagttacacctcttagtttagcatacatggctcctcacagtaaatcttaagtcttgtcagaccttatttttttttttttttttttttgagacagagtcttgctctgttgcccaggctggagtgcagtggtgcgatcttggctcactgcaacctctgcctcctgggttcaagcaattcttgtgcgtcagcctcctgagtagctgggattacaggcatgcaccaccatgtccagctaatttttgtatttttagtagagacagggtttcaccatgttggctagctggtctcgaactcctgacctcaggtgatgcatctgcctcggcctcccaaaatgctgggattagaggtgtgggccaccccgcccggcccagaccttatcttgactatcttagtcatttcttctcttgcctgacatgccctgtgctcctaccaccctttaaagtggtttgtgtcataaacatttgatacacaaaaatggaaacttaggacaaatatcttgatgtctggtggttgaaaatgtgaactgatttggaaatcaccggtgtttctcctcttaatctcttctccattccattcaggaaatagactgtaaggtgggaaacaagtataagcagttagcctcactctaaacctgctatgtaatagacattggactgagttctgtctactctctgtaagcaatccaaggtaattggcgaaagtggaaggaatatgtactcagaagaccaaaactttggtttttaaattgaatatctattaagcacaaggtaacaattcttaccacacacatcagttttattatttcccttttacaaataagacacagatgggtagtcagatgtctttgaggtaacacagcaagtagttaaactgggttaagtgattaacccaggttgagtatggttccaaaatctcttacagtgtcaggcaggctacatcagtgcagtatacgtacatcaggtttcacgaaaaattttttccagagaaaacacaaacccaaggaaccttcagtaagtggtgccttatattagtggtttttagcaaaaggaagaaacttaagtgttttcctgctgcctgacaaaagtgaaaaacagtattttggtttttattgaagttagcatgtatgtttgtagcttgcataaaatagtactgaaatccaattgattatgaattcttggactaacagaacctggatgacaaattagaggttctggcctggttgctggcttttttagttgtcttgggtgtaaatttctcagccacacgtggggattgtgttagataatctgaaatctaattttcatggttttatgattcagcagctttcttcctttgatattttctagtatttgctttattatagattggaatcctcaaaataacattgacaagtagaagatacttctgttagtggatttaaaaaaaaattacattgggaatgtcctttgagtggttggccctaatccctgtcagaagctgaaagttgtggatcctaaattcatctgggcagaatctcacctatgatttcagaaagctgagagtttcagagagtgactgtagtcagtccttagtgagtacaaaattgagaatacatcattactttaaattaatggtgcagtaactcttgtgactgatagcaataatttaggtgctttgttgttagtacttgattagattggattgggtcagttagtttcaccaaattgctaaagacacctgtccccctagaattaaaatactgagttacataatggctactaaaaggataactatatggggtgttcgatgattcaaaggtgaattacttggtctctaccttcaaggaatatgatacaaggcaatatggtactgccattagacagatattaacaaagtgtcttgggacttaatagggagggtagttccaggctgggagatgtagtcagattcttttatagagttggcatttgagttggcccgtgaaggttggaaaaagttgtgacaggtggaaaaggagcaggggagaccaggacagtgcagtgaaattccagccaggagcagtcacaggcaatgagacagactcatggagccatgattctcagctgtcttaccttaccttagttttcctaaggaatatcatggaattctgtaaagacctttaaactaaataatgttcatatgagatgagtgctaggatggggacctgctgcctaatataagtagtgtgagtctaaaacattgtggaaagtggttagtttaataatgttattaaagagacaagtctatcacaagggaccagttaccagtgaaactgtagaccacctgattcactgcgatagggttagccaaagggaggagagggcagattgcatacatagtacctaaggccactcaaagacctcttttaaaatcacgtgtcatgttgatgacatttggaggctattaatgtttttcttcccttttaagacttagtgttttctttattagcattaatttactctagtaaacaaaattatgtgtgactaaaaatggcaaaacaggctgggcgcagtggctcacgcctgtaatcctaacactttgggaggccaaggcgggtggatcactaggtcaggagatcgagaccatcctggccaacatggtgaaaccccgtctctactaaaatacaaaaaattacctgggcgtggtggtgcacgcctgtagtcccagctatgtgggaggctgaggcaggggaatcgcttgaacccaggaggtgaaggttgcagtgagccaagatggcgccaccgcactccagcctggtgacagagcgagactgtctcaaaaaaaaaaaaaaaaaagcaaaacatctaaaacttctgttatattctagtgtgtaaagttctgcctttgccactgagatgcatatctgttttacagaatagttttttttctttctttctttctttgaagacggagtcttgctctgtcacccaggttggagtgtggtggcccagtctcagctcactgcaacctccacctcccgggttcaagcgattctcctgcctcagcctctcgagtagctaggactacaggcgcgttaccaccacgcctgggtaatttttttattttagtagatttggggtttcaccatgttggccaggatggtcttgatttcctgacctcatgatccgcctgcctcccaaagtgctgagattacaggcgtgagccaccacgcctgccctaattttgtgtttttagtagagatggagtttcactgtgttggtcaggctgatgtccaactcctgacctcaggtgatcctcctgccttggcgtcccaaagtgctgggattacaggtgtgagccactgtgcccatccttgttttgtattttctaaaagagatgtatcttgtttaaatattaaattataagatattcaggccttgcaaattgtctggattacactgtaaaagtaatcatttatgtgcaaataattccttgagatcaatagttaaatgagctcaagctgatctgactaaattggagaagatacaaaatgaagatggggaggaagtggtgccataagcagccttttttctttgaccattttatatgcctttttttttttttttttgagatggagtttcactcttgtaacccacgttggagtgcaattgcttggcttgcaacaacctccacctcccgggttcaagagattatcctgcctccgcctcctgagtagctgggattataggcatgagccaccaagcctggctaattttgcatttttagtagagacggggtttctccttcttggtgaggctggtctcgaactcccaacctcaggtgaaccatcctcgtcggcctcccaaagtgctgggattacaggtgtgagccaccgtgccctgcccgccattcgtttttttttttttttttttttttttaattctgactcttctgtggtggaaaccagcaaatacttcacataatttaggatgctaatactagtacagttaaaagaatgattacaaagcagatactatttcaaattctgtaaaaatctgtttttaatatccttcactggctgtttgttctgactagaaatgttttgtatatctgaaagcaccagtaactcatagccatataatttttttggtaatatgttcataggcaagtggcaagagttagtagaaagatttctctaagaatttatcctaaatcagattacacagagttggggtaagtgagtattgtgttattttcttttgtatatttgacaatgggaactttttgaaactcaacttcagtgtaattttaagtcactaaatttgtccacaagttaatgattaaacagttactgaaagtggagaaccttgccatttttcggactgcgttttgggtctttggcactgtggttaggttagctaattcgattatccactcaagttttactcagttggaaatatgtttttctagatgatggtgcctgtgcttaggtttgagaggatatttaaaatacgactttgtgtgccattgtttgacagtggaattaagggtaaaaatatttagatatggaagtgtgaaaatgtagttgcattgttttcattatgttctattccatttcattctattttaagaatagcctcaatttatttttagattgttacataagtacaaaatccatttgctttagtgggagttttatttttattttaaaatgataaccaattaaaggagtttattatgaaattctaagtagcattgtttaaaatgtaaaattacattacagaaacatttggaaaggggagaataaaagaaaacaaaacacaaatgttgccagtgctgtaggtgctattattagcgctttggtgtaactcatggtcgttttcctactatttttattatacagtcatctcttggtatctgtgaagtggttccacaaactccctcaaataccaaaatcctcctatgctcaagttcccaatataaaatagtgtagtacttgcattacaacctttgcacatcttcccatatactttaaaatcatctttagattacttataatacctaacacaatgtaaatgctgaataagtagttgttaacattgtattgtttagggaataatggcaagaaaagtctgcatgttcaatacagatgcaacttttccactgaatatttttattccaaggttggttgaagccatggatgcagaacccatggatatagagggcctactgtacttgtaccatctagagataagatttgtatcttgcatttgttttaacatatctgttctaaggaatatctcagtcaccaggcaagtgctgcagtataactaggtactacgtcaggtgctaaggttaagagagtattttccttcactgactcctcactccgagaatccattttacagcttcattggtttgggttattccaattttttgatgtgagtaaataaatgacttctatttgcccaaaataaagcttatataggccttataaccatgcaaatgtgtccattaagttggacttggaatgagtgaatgagtattactgccagtgtgtgtgtgtgtgtgtgtgtgtgtgtgtgtgtgtgtctgtctgtctgtctgtctgtctgtctgtctgtctgtctgcctgcctgcctgcctgcctgcctgcctgcctggctgcctgtctgcctgtctgcctgcctgcctgcctgcctgcctgcctgtctgtctcactttgtcccctaggctggagtgcagtggtatgatctcggctcactgcaacctccaccccccgggttcaagcgattcttctgcctcagcctcctgagtagctgggattacaggcgcatgccgccatgcccggctgttttttgtatttttagtagagacggggtttcgccatgttggccagactggtctcaaactcctgacctcagatggtccacccgcttcagcctcccaaagtgctaggattacaggcatgagccaccgtgcccagccactaccaattatttctcttaatggattttcattgaccctaaccctgtaaattccatcacttttatcaaggtgtatattataataagtctataatacccaatcatgtagttgtgtgattattttatttttttgagacagagtctcaatgttgcccaggctggagtacagtggcaccatctcagctcactgtaagctccgcctcctgggttcacaccattctcctgcctcagcctcccaagtagctgggattacaggcgcctgccacttcaccgggctaattttttgtatttttcgtagagacggggtttcaccatgttagccaagatggtctcgatctcatgatccacccacctcggcctcccaaagtgatgggattactggcgtgagccaccatgcccagctatttttttaaccaatatattagctagcttttttccccagaataattttccaaaaatacatttaatagagaataaaagttaaaagaactttcagtggtttaatgctgttacttttaatatttcaaagatctgactgcagccatgagcagcaatgagtgcttcaagtgtggacgatctggccactgggcccgggaatgtcctactggtggaggccgtggtcgtggaatgagaagccgtggcagaggtggttttacctcggatagaggtattttgtcgaatagaaaaatttgaagtacttcagtatttgttagtatcaagactggtctgactagccgaattctttgtttttgctcaaaacaggtttccagtttgtttcctcgtctcttccagacatttgttatcgctgtggtgagtctggtcatcttgccaaggattgtgatcttcaggaggatggtaagtatttaacacttccttttcatacccctctagagcttggagaggtgagcacatgcaactgtgtatagcatttccacctttgaggttttgtattgtataatttaaaacgtaacactttgtaaaggttttatagtcttggcctgtttcttttccttattgttgaagcctgctataactgcggtagaggtggccacattgccaaggactgcaaggagcccaagagagagcgagagcaatgctgctacaactgtggcaaaccaggccatctggctcgtgactgcgaccatgcagatgagcagaaatgctattcttgtggagaattcggacacattcaaaaagactgcaccaaagtgaagtgctataggtaaggtgtcagaatgttgttagaagaaaactcattgcagagattcttccagagatgaattagctataaatggaagggccttagtaaattcagtgaaacttagctgtgaccagataagaccaattttcagcatatgtaactggcagtctatctgtatataattctgtattctgccctgatatcctgtggcttatggtacctgggcagttttcacaactggacttttttaatatataaaagtaagagtgttataatttgaaacttccagagacttcatagaaagctctgtaatatacataaatcttttatcatgtaaccagaaatctttgcctgtttgtgacatgtaagtgtataatttgataaatgttgttgtgtacatatctgtgaaaccttaggggttaattgcatgaaaacaaagatcaggcgttttgttctgcatggtgactgttgctttggtagacagtttttttctgaggcccattgtgaaaacttttaatttcttttttaggtgtggtgaaactggtcatgtagccatcaactgcagcaagacaagtgaagtcaactgttaccgctgtggcgagtcagggcaccttgcacgggaatgcacaattgaggctacagcctaattattttcctttgtcgcccctcctttttctgattgatggttgtattattttctctgaatcctcttcactggccaaaggttggcagatagaggcaactcccaggccagtgagctttacttgccgtgtaaaaggaggaaaggggtggaaaaaaaccgactttctgcatttaactacaaaaaaagtttatgtttagtttggtagaggtgttatgtataatgctttgttaaagaaccccctttccgtgccactggtgaatagggattgatgaatgggaagagttgagtcagaccagtaagcccgtcctgggttccttgaacatgttcccatgtaggaggtaaaaccaattctggaagtgtctatgaacttccataaataactttaattttagtataatgatggtcttggattgtctgacctcagtagctattaaataacatcaagtaacatctgtatcaggccctacatagaacatacagttgagtgggagtaaacaaaaagataaacatgcgtgttaatggctgttcgagagaaatcggaataaaagcctaaacaggaacaacttcatcacagtgttgatgttggacacatagatggtgatggcaaaggtttagaacacattattttcaaagactaaatctaaaacccagagtaaacatcaatgctcagagttagcataatttggagctattcaggaattgcagagaaatgcattttcacagaaatcaagatgttatttttgtatactatatcacttagacaactgtgtttcatttgctgtaatcagtttttaaaagtcagatggaaagagcaactgaagtcctagaaaatagaaatgtaattttaaactattccaataaagctgga

SEQ ID NO: 36843 - DNA, 77945 bp, Homo sapiens
actcgcacaccatgtgtccctccgcgcgcagcacgggggacttttcggtggggattttgggcgccgaccagacgcggcattttcggaaaatagcgccctgtgcagctgaagcgctttgtgtgtagcggggccgcgtcagcccggccgggtacgaggcgcctcgggtccccgcaccacctcctgctgccttcccgtcgccgctcccgaagcttttccaggtcagtgcgggtctgtgtagggccctgttaccaccggatgtggaagttgatctcttcgctggtaaaaaataattccacttcccccggaacccagatcatccccgcgatttcctgtttattgcattaaggcgccgggtttccggggctcctggccccgcttattccgcgggggtcggcggggtcggcctgggcgcccgcgccgccgctgcgctttgtccgctgggcacactgcttctgggaggggcgggcagacatggtggcggccgccgccccctcctcggccctagcatgccgcggccgcctcgcggctacccggcttgccggtcccgagcggcagccccggggtggcgatggggtcgcgccgaggcagcggaggttctgcgggcgactggaggttggcagtgggcgggagaaagaggaaggcaggcgcggctgggcctcggcctctggcgccgcggtaccctttgtctcggcagcctgacggccccgccgggctctccggagaggggaacgggcggcgagggtggcgggtcctgggcgccctgtgctgcggggccgagaggcgctcgggtcgcggcgggatcggccggaccagacagggttaatggaagagcctggccagtcccgcgcggggcccccgcagcgacagccttggccgcggggactggagtcctgagggggagaagcctgccgttctgaaggctcgggacttctgccccaaagacttcgccgccgagaactgcgggtgcactgcctcagggaagaagttgagaattttgccaggtcatctctgccagggcacagttcatcactgtgtgtttagtgtgtttcggtgaagctctccaagtgtgttgaatcagcgtgcctagcctcaagggtgcatcgtgaaaactgaaaccaaaggaatgatacaggcctgctttgtgtgtgtcttcccactttaagcttgttttcagtacaaatactcttgctttaaacctgattggactgtggcgagcggacatctgttcaaaggaggggccgagaccacagtacttctgaagggggcttgataatgtggaaacattttaagttttctctccggactgttttgctctctcaattcaggcaagttactgaagtacgttttttatctagaaaaaggtttgatgtagtctgtaaatggtccttgtaaagtacattgccatctcagaattaaaagatccactctcatttattatgcagaagttagtggtcattctttcctgtagatagtttatctcatgtaaagacccacccagcttggtttaaatttttttctcactgacgtataaccatcagctttgatacttccattttcaggctcagactttgaatttaaggaaactaaagatgactttattttcttttctcttggttttttttttccaaaaacaaaaaataaatccattacatgttaacatagatgataagagtgacatcttgcatttttgcaaatctttttaatgcctggtttaatagaagattctcagatctacgtcagactgttgtggttagcacaccatgtaacctctggaacactccactgtacactcatacttttttaaaaaaaaaaccaaaaaacagaaatgtgtcattcttaccgtgctttcaccatacaagtcaaatcaagctgttatgcaagacacattttaacaagactgaataagattgattcccatactttttttactgggctctaacttttttaaaagttggaatttaggtgactaaacaaaatcacagatgaagactgcataatctgcctatgatctcggagactcaggaacattcgaagatattcttaagtgattaaaacatttaattctattacatatttataatgatttacacaagtaacacgtgaattccacatatgctatcaacacttgtgtaaatgttatctttaaagatagaacatgttgaaaattataggaggtacagattttacagaaaattaattctgcagtgaatcctttggtgaaacgaacagtttgcagagacatatccttagagttctttgtctctctgaatcattctgggttttctaggttgggagacaattatacttattgggagacaattatacttaattgattaatgcataaaaatttaaggccgtattttaatggctttgaaaggaagctaagtttgtttccagttgtttctgtgaactgtagtctgaatctgtcagtctatagttctctactgttccatcaacaggaagcatctggtcattcttcgtgtaattgttagaaaataccaggtgtacttttaatgtttgctgttcaaacgaaaatagattggatcttggttaagttcacttggtttggccaggcacagtggctcacgcctgcagtcccagcacttggggaggtggaggcgggccgatcacctgaggtcaagagtttgagaccagcctggctaacgcggtgaaaccccatttctactaaaaatacaaaaaattagctgggcgtggtggtgcgcgcttgtaatcccagctactcgggaggctgaggcaggagaatcgcttgagccagagaggcaaaggttgcaataagccaagatagcgccattgcattccagcttgggcaacaggagcgaaactctgtctcaaaaaaaaaaaaaaaagtatgcttggttttagtgtgttttttcccataacattgtgtcattgtaatggaccacatctcctgtaccatgaatttttttttacttttttcttttgcccctcagtaccagaaatattaacaggtaacaggtaaagtgcacgtcatgaggaattcagaaattcagaaattacatgaagttttgcatcatgaatttatttttgagggtgcacgaggcagttacccagtctctgtttgcaagtagcctgagttcagatgaactcactgatggcctccatctcttctgactttgcaaacgttgaaaaacaaacccacacaaaatcttgaagttgagagcaacttagtttccttagtgtcatccctctgctcccctctcctccccaacaactagtatggtttccagctagtaatcacaatgtttctatagctctgatgtgcctacattgggatagctacaattagtattatagttttctgaagatgtttgttccatcatgctttctagaaggtaaatctagcactagatgagatcagtattagggcctgtgttttttctcagtgttgacatcacagtgctctatacaaagaagatgctttggtgcaatcagctgtcagttcagttggtgggctagtgcacctttctgtctccctccctccctccctccctccctccctctttcctctctccttctccctctgtccctctccctctctctccttccctccctgttttcccctttgcacctcttctttctttgacagggtcttgctttctctgttacccaggcttagtgcagtggtgcgattatacttcactgcaagctccacctttcaggctcgagcgatcctgcctctgcctcagcctcctgagtagttgggactacaggtacctgccaacatgtctggctaattttttaattttttgtagagacgagatctcactgtgttgcccaggctggtctcaaacttctggactcaagtgatcctcccaccttggcctcccaagtgttgggattataggcgtcagccaacacacccatctgtgaataattctgaagttggtagaacagcttattgacagagcaaggtgttagccccactttactgtgtactagttatattatatttggggtattgtgttggctttttgggtagcatactatcataagtgagaccttgtattcattctcagactttatcagaatcatctggagagctaataaaaagccacacagaggcccaaacttaagtagggtaggaacggaccttaatttttctcatttccaaggtggtagacacctaagtgtcaaaatcacttatctgtagagcataaacgaggaccttgatcatgagagaaatggaaatgagaaaaagttgaaaaaatgggatgtttgacctaaagaagaggagcttcttttaagaagtaacagccacttttaaggatttggagttctgtcatgcagaaggatcagatttgacttgaccagaaggaactagggtcagtgggtggaagtttaaaagaagcagatttcaattctctttcaagataaatttcctcaaaattgtgaaaatagaatgagttgttttgggtggtaggctgttcctgttcactgacaaattggggattctagagtagaggaatcgtactgaaggagaatttgagctaggtgtcttcaagttacctataaactttgaggttttattaaatatgccgaggtttacaggtggaagaacaaaaagctaattgagtgaaacaaactggttaacttgataatagtttttgccttcctggataaagagaaatgagtattaagtgagaaggctatttaatgaagggctttaaaccacactgtaatttggtagattcagcagctttaaaaattggcataccttctgacatggaaattccctttaaagaattttttttttgatgtagtaaagatgtgtgtgaatatttaattgtgagcatactagatgcagtattgttgattataaaagctgtgtattaatgcctttaagccccacggtaatcatatgaagtgggtagtactatttctgcttttcagaagaaaaaacaggcatagagaaatgaggttgcttgctcaaggtacctgagttagttaagtgttagggccaggacttgaatccaaccagtgtgactctagagccagtactattgatcattatatggtaaaattgtaaacaacctaaatgtttcacagtgattgttagggtccatccctacagtggggtactgccttctcagccatgaaaatgatgatagaataatataaagacatgaaaggatgtcttggtatatgtaagtgagaaaaaataaatttaaaaacatgattccattttggtaaaaaaacccaaaaatatattatgtctggaaggatatgtgccaaattgttaaatggttatttctgagtgtagttttacaggtgattgttttctttttgcttatccaaattttctaacttctacaatgaatataaattatctatcatgttgtaattaagatattaagatgtaacttttcaataaaaaattaaatgtgttagcataagctgagaaatttgggttttatactctgcattttaagcaagtttgtagaaattgtacatgagaatttgtaaatgcatgtagtgttttgtaattttttgtttgattccttattctagaagtaatatcaattgagtagagaaacatatcactcctaccaccctaccataatcaattattttgttgtgtgttgttactcttatgtgtaatattttaaatattcatcccagtgtcatcccagttagtcatactctagctgtgtgattttaggcagtttacttaatctctccgtggctcagtttccttctttgtaaaatgtggattattataatacttagctcatgatgattggaaagattaaatgttatttcatataaagtgaacagaacagtacctgaaacataacagttaatagctcaataaatgttagcaattataggatcacagtccaccattcaaactcttagggtctaataggttatggaattaggaattttttttttatatgggcaaggtagtaatgtgtagccttccaatagagtccagtgcaatatcccccttcaaaagtgttactgtttctgcaacaaaatgtatgaatgttcgcactaaataggataaagactgtaaatagcttcatatcagtttgggtaaggtttaccacaagatgagttattttgggtttcagaagttttttggatttttggaattgaagataaggaacctataaaatattaattttgagtcctattttataatattaaaacatcttttcatggtattttatagttttatagtgcatggtaaattaaagtcaattaaaatgaaataatggaaaatgtccacctccatctcctttgatttaaaaaatactcagcatactgatactatgatttaaaaaaaattttttttttgagatggagtctcactctgtcgccaagctggaatgcagtggcacgatcttagctcagtgcaatctgcgcctcctgggttcaagcgattcttctgcctcagcctcccgagtagctgggactacaggtgcgcgccacgacgcccagctaatttttgcatttttagtagaaacgtggtttcaccatgttggtcaggatggtcttgatctcttgaccttgtgatctgcctgcctcggcctcccaaagtgcagcaattacaggtgtgagccactgtgcccagccaaaaagtttcaaagtttaaaaaaaaaaaaatggccgggctcagtgtctcatgcctgtaatcccagcactttgggaggccgaggcgggcggatcacttgaggtcaagaattcgagaccagcctggccaacatggtgaaacgccgtccctactaaaaatacaaaaattagccagacgtggtgtgtgcttgtgtctcggctactcgggaggccgaggtgggagtattcctttagtctgggaggcggaggttgtagtgagcggagattgtgccactgtactgcagcctgggtgacagagcaagattctgtctccaaaaaaaatttaaaaaactactcctgttggtcctgactgtgattctattttaaagaatatcttaaacccactaatgctgtgattatattacataatgtagaatctttttctgaaagaggcttgagcattcctataacccaattagcttgtttatgtctcattacacttgagggataagatacttttactatggtggtttactatagtagtgattctttttttttttttccagatggagtttcactctgtcacccaggctggagtgcagtggtgtgatctaggctcactgtaacctctgcctcccgggttcaagtgattctcccaagtagctgcagttacaggtgcccgccaccatgcccagctaatttttgtatttttagtagagacggggtttagccatgttggctaggctggtctccaacttctgacttcaagtgatctgcccaccttggcctcccaaagtgctgagattacaggtataagccactgcgcccagcctatagtagtgattctttaaaggaggtgggtagatgacactgtgatacctgtctttaatgcacccattctgtgcatgtagagactgaggtggttgtaaaattacagtactgaactttggaattaggtcaattcttctcattatgataacggttttggatgtatagccccttctgactcctggaatcctttatttccacagcacttcccatgtatccaaacagaggaaaaaataattagtagtatagtgcttgcttcagcagcacatatactaaaattggaacgatgcagagaagattttcatggtccctgcacaaggatgacacataaatttatgatgtgttccatatttattattatttttaataataaaaaataaaaaaaatttgtatggtgtgtaagtgaatgatctaaaaaatttcctttgtgccctaaatgacttgtgtgaactctgtgatctttgccaatgtgattattcttcctgtgttcctttacttgttccattcatagtgaccctcagtttcttgccctaagtgctatggtctaaaagcttgtgtctccccataattcatgttgaaatcttaacctccaagatgatggcattaggagatggggcctttgggaggtgattagctcaggtgggtagagccctcaggagtgggattagtgctcttaaaaaagagactccagaccgggtgcagtgggtcatgcttgtaatcccagcactttgggaggctgaggtgggtggatcaggaggtcaggagtacaagaccagtttggccaagatggtgaaaccccatctctactaaaaatacaaaaattagccgggcacagtggcaggtgcctgtaatcccagctactcaggaggtggaggcaggagaatcgcttgaacctggggggggcggaggttgcagtgagccgagatggcgccactgcactccagcctgggcgacagagtgagactctgtctcaaaaaaaaaaaaaaagactccagacagcttgttagctctttcttccacatgaggttacagcaaaaagacagatgtctagaagctggcccttaccagatactgaatctgccagtgccttattttggacttctcagcctcctgggctgggtgaggtggttcactaccagccttggcaccatagtgagactcccatctctacaaaaaaaaaaaaaaaaaaactttctgttgtttgtaagctacccagtttatggtattttgttacagcaacccaaacagtctgagacgtttagcttaactcctgtatgcactagatacagtctgcactttgacatcaatcacttattttatattttactggactcctgttgtcagatttttccaccatcgatttcttctgttttccctcacaggtcacagcatatttgtggaggaaggtgagtaattatgaagatttcttggccactataaatttacgctgaacaattccaaataggcccctcctacttcttggcaatcatcttattaattgcatttttctgttgtctcatattccttcttcctctttaactcttaatagatgccatttacttctatataagtgaaaaaggaaaacagggtacaagcttgcacatttttttttcattgtaaccatgacaaatcactgttctttcatcttattttgtaaattgaacggaagaagaatcctgctgccacagttaactttacctctctggtcactttgattgttatttgcaatgttttttcttccctaccttaaaatatgtacagacttctcaccgggcgtggtggctcatgcctgtaaacccagcactttgggaggccagggcgggtggatcacgaggtcaggagatcgagacgatcctggctaacacagtgaaaccccgtctctactaaaaataaaaaaaattagctgggcgtggtggcgagcgcctgtagttccagctactcgggaggctgaggcaggagaatggcgtgtacccgggaggcggagcttgcagtgagccgagatcgcaccactgcactccagactaggcgacagagcgagactccatctaaaaaaaaaacaaaaaaaaatgtacagacatctgtactttgggaggaaaaaaaatcaattttgatgaactgctgctactgttctttctagctatctgctgcatttctcttcatttcaaaaattttaagaattgaattacaattgctgccgtgagtttttacttttttttcgaagacagggtctcactgtgttgcccaggctggagtacaattgcagctcactgcagccttgacctccccaggctcaggtgatcctcctacctcagtttcccgagtagctgggactacacgcatgtgtcaccatgcctggctaatttttgtattttcctggtagagacaaggtctcactgtgttggccaggctagtcaactcctgagttcttttactactactttcctaacttacgcagttttggaatagcataattcagattgtcgcttcagaggacatcttttttgtcaataatattggcttcatcctgactcttttcagctagtatatatgtgttactatttccactgaggctttttaatgttctctccttgccgtttgtgttagtttgccatcctggttttcccttctgactattctgttttctttgttgtttcatgagcctcttagcactgttagtctcatcagtacttgattattcccctcttagatgttttatatgctgatgactcccaaatgtgtgtcccatccatgtttgatgctccagtagtttactggatatttctgttggaacgctcaaggaatttccatcacttttagatttattattattcagcctctcacctgctttcaccatttcttttaattttatcatacttaaattttgaagtagtctgcgatgcatacttttgctttatttatttattattttttgtttttttgagacggagtttcattcttgttgcccaagctggagtgcaatggcgcaatcttggctcactgcaacctctgcctcctaggttcaagcgattgtcctgcctcagcctcctgagtagctgggatttcaggcgtgcaccaccatgcctggctaattttgtatttttagtagagatgggatttctccatgttggtcaggctggtctcaaactcccaacctcaggtgccgccctcctcggcctcccaaagtgcaggcgttacaggcgtgagcacagttttttactctttattggctcccagtttgtcttggaattctgcattgcctattatttgcttcctttaaactttagattttccttccttgcatcctttttgcatatggctgccagaatgattttcctgaaaatattttgaacccattgctaaacatataagcctgaggagagaacatgtgctattgacctttgcactgtctattctgtcaaacaaagtgaattgaaccttgctgaataaatgtttgaaagggtcaccatttgctcaaaaatttgaatgactcccagttgtttacaagataaagtccaaattctactttctgactttcaaacctttttatattcttcttcagccttattccttactgtttaacattatcaagctggtgtttactctgtaatataccttgcttaagcacaactccatgcattcttcctttccttgcctgtcagagcctactcagggatgtttgccctgcggctggcactgttctaatctctgatgttatagtaatgaacaaaagagaagacaaagtcccgttttcttggagctgacgtttgtggggagggacacatagtaaacaaatacgtgatgttaggtggtaatgagtaaaatgaaaaggaataaaagtaggtaataaaagatgattgtttattctgacttccaataaaaaatatatcttacatggtaattatatatgttactatgtgcatgtgtggtaactacatttgattggccaggtgtggtggctcatgcctgtaatcccagcactttgggaggccgaggcgggcagatcatgaggtcaggagatcaagaccatcctggccgacatggtgaaacctcatctctactaaaaatacaaaaactagctaggcgtggtggtgtgtgcctgtagtcccagccactcgggaggctgaggcaggagaatcgcttgaacctgggaggtggaggctgcagtgagccgagatggcaccactgcacctccagcctggtgacagagcgagactccatctaaaaaaaaaagaggtgaggggatagattggtgggatgtggtagctatcttaggtggtctgggaaagctgctccctgggtgtcctagagtgcaggagcaagccatacagtatctaagtgaagagttctagacagcagaaccaacttgtgctagaccctaaagtgcgaacacatttgccttgttcaaagaattgctgacttttgtggctagagcacagtgactaagggggagaatgatagatgagctgagaagagatgatggggagattgatagatgagctgagaagagatgatggggagattgatagatgagctgagaagagatgatggggagacagattatgcttcaaatgttaagtcctgcggggcacggtggctcacgcctgtaatcccagcactttgggaggccgaggcgggtggatcacgaagtcaggagatcgagaccatcctggctaacatggtgaaaccccgtctctactaaaaatacaaaaaattagccgggtgtggtggtgggcgcctgtagtcccagctactcgggacgctgaggcaggagaatggcgtgaacccgggaggcggacttgcagtgagccaagatcgtgccactgcactccagcctgggcgacagagcgagactccatctcaaaacaaacaaacaaacaaacaaaaacaaatgttaagtccttcattgaagaggccttctttgactactacaacttgttaatataaaccttgaaacctatctaacaactatagaagtagctctcagatgattgtttattctgactcccaataaaaaatatatcttacatggtaattatctatatatgttactatgtgcatgtgtgataactacatttgatatatgctgatattttcaaaaacattggctttaacctactaaagtgatttcacagtctgttaataggtcatgaccaacagtttgaagagcactgatctatggtgtctatacccacttaaacaaaacactgaactacaaactacttttgttataatctacaaattttttcagtttgtgaaatatttttggttaaagatcttgcctttaatttttgtgtgtaggtttacagtgtttataataatgctgaatagaaaggacttgtttaatttagcaaacatctgttgagtggtatattagaagctgctagatactaaaatacacataagaataagataaaccattagcctttactcctataagggttaaaaaaaaaaaagagatcaatccttgtctgaattcctaaggcttatgggagaggaaagcttataaataaatcatttgtaatgtgatggaatctatctaataatggaagtgtgttaaggccacaatgagagaataaagaagtgattaattcattttgctgaggtcaagggaaacttatcggaggaggtaatgtctgaactgcgtttggagggagaataggactacttaggtaagttcgggaggggaagacgtcttaggctggataacatataaaggagtagaatcatgagacagaatagcacatgagggtattgtaaataaccctgtattaaaatataaatccaaggggtaagtggtgagtgatgaggctgcagtgaggcacaggtcatatccttaaaggtctgagacgcgttggagttaccacttatttaatgattatgcatattaggggaaaatactgtatagtcagaattaacttgtaggaagttgccatttgggaagtaaggtaccatctctcaataattccaaaacagtcagtttttcctctagtgatgaaatatatcactgtttcctcaattgtgccctagaggaagacggtttacatttgtgggctatgttgtacaaaataaaatcttataaaacgttaacttatccattgcaatgagaagttcattccataagatgcatttgagaactgagacctactgaggaaatagattcatatttcaggctcatgctgggacttatgtttattaagtagaatggtgagtagccaactgtttaaatcattttctttttttttttgagatggggtttcactcttgttgcccaggctggagtgcaatggcgcgatctcggctcactgcaaccttcacctcccaggttcaagtgattctcctgcctcagcctcccggggtagctggaattacaggcatgcaccgccatgcctggctaattttgtatttttagtagagacggggtttctccatgttggtcaggctcgtctcgaactccgacctcaggtgatccacctgctttggcctcccaaagtgctgggattacaggtgtgagccaccgtgcctggcctaaatcattttcaagttaaatatacatatggtcagtgccactgtattctgtaggtgattggaatgcataattatatctatattcattttggaaagatattttgataaatttggccaaaccacaatttaagactttatgacaacattaacatttaaaatatacaaattttaaagaaaaaaatatatacaaatttaaaacagactgagaggagtatgtaataaaccatatgtaatatgtaataaaccatatgtaatatgtaatattacatatggtaataaaccatatgtaatatgtaatattacatatggtaataaaccatatgtaatatgtaatattacatatggtaataaaccatatgtaatatgtaatattacatatggtaataaaccatatgtaataaaccagaaatatacatattgcactcctacaaagagaatgaaatggtaaaataggtaaagaatatgaataggcagtttcggaagaggaaacatagtggccaacaaacatttgataaagatgcatggtctcattaggagtttgagaaatgcatattaaaacacaataatagcatactatgcagctgtataaaaaaatgaggaagttctttctgtgaactaataggaaaagatctcatgtgttaagcaagaaaagcaagtggagagcagtgttatgtggtaatgttttttttttttttttttttttttggtgattatagaaatactggaaggatactcatgaaactagtaaaggtaataacttgttggggttgtgggtccagggtgggccaaggaggagcagtgagcagtgtaaatacttccattgaggattttcaatgtatacatttctgtgtttgggcttttgagctatatgaaagtattgcctattgaaaaaggaaaaatatgtgaagaagacttcatagaacttgaccaactgtcttagtccatttggggtactataacaaaatataaactagtgacttataaacaatagaaatttatttctcagagttctggacgctgggaagttcaagatcaaggtggtggcagattccatggctggtgagggcccatttcctgctttatagatggagccaccttgctgtgccctcatatggtgaagggacaaagcagttatctggcaataattccatccatgaaattatgaatggaatgataaggtttgccctcatgagctaatcatcactcaaagtccccatctactaataccatcaccttggggttaggatttcaacatgttaattttgtggggacacaaacattgagaccagctgtgtatagaagatgaggcagagggaagagtggaagataactcccagatttctaaattgggaagtaaagagggtgataatattatcaggtaatgcagaaggaagattaggttttgtcatgtgcctgggaagttctggacatgctaactgacaaatccttactacttcttagtttagtgtgtatgggtataatttatgtactttagatatggaactttcgagcttatcttaaacatgaatattaagtagtcatcaataaatattttttatctgtagacatttatattctgagttaatttttagaaaattatgactaattttatagtcataatagggacactgataagcacagatagaatgtagatagagaaatagagaatgtatatctgataaatatatagcttaggtggaaagtaagaattttatttattaacatggtttcaagaagtttttttttttttttccaaggtggagtcttactctgttgcccaggctggagtgcagtggcacagtcttgactcactgcaacctctgcttcccaggttcaagtgattctcccgcctcagcctaccagatagctgggattacaggtgccttccaccatacctggttaattactggttatttatttgtttttttgttttttgagatggagtctcactttgttgcccagactggagtgcagcagtgtgatcttggctcactgcaacctctgcctaccaggctcaagcagtgctcccacctcagcctcctgagtaactgggactacaggcacgcaccaccatgcctggctagttttgtatttttagtacagacagggtttcaccatgttgaccagactggtttcgaactcctgaccctgaggtcagggtcacctgagtgatctgcccgtcttggcctcccaaagtgctgggattacaggtgggaaacaccacaaccagctgctggttaatttttgtgtttttagtagagatggggtttcactatgttggctaggctggtcttgaactccagacctcaggtgatctgcccgccttggcctcccaaagtgagacatgagccactgtgtttggcctatggttccaatttaatgacatcttttgatgtctgaaattcaaagaaacaaaaatagatttgaataaggaagtgatcgtggtagatagcttatactgtaatatttaaaacggaggtttaggccgggtgtggtggctcacgcctgtaatcctggcacttttcaaggcccgggtggatcacttaagtccaggagttcaagaccagcctgtgtaacatggtgaagccccgtctctacaaaaaatagaaaaattagttgggcatggtggtgtttgcctgtagccccagctactcgggaggctgaggtgggaggatctcttgagcccaggaggtgtaggttgcagtgagctgacattgcaccactacactccagcctgggagacagagctctgaaacaaaaacaaatctctttgaagtttagggaagtttataacagcacagaaatatttttttatgtagtatgtttgggagtaactgtatataagacaaagaagtttaacctaatggagacaaggagtcataacatgttgggtgctacttaaaacaagctcttggccgggtgtggtggctcatacctgtaatcccagcactttgggaggtcgaggtgggcagatcgcctgaggttaggagttcgagaccagcctgaccaacatggtgaaaccccgtctgtactaaaaatacaaaaattagctgggtgtggtggcacgtgcctgtaatcccagctactcgggaggctgaggcaggagaatcacttgaacctgggaggcagaggttgcagtgagccaagatctcaccactacattacatcctgggccacagagtgagactctgtctcaaaacacaaaaaccaaaaaaactaagcttttgctatataatttagagtttaaatttttttttgaatgaattatatttcagaatctgatttttgaggttctcatttatccatactacttttacctgagttttatttggccagagtctaaaattaagtaaaagaggagcacagataaagcacatacttgcaaataaatgtagtagtttttttctggatttaagttagtaaggatttgggtatggaacagtaatgaaaaagaactaagtaattctttttttttctttttcagttgagacggggtctgtctctgacacccaggctggagtgcagtggggcaatctcagctcactgcaggcctctacttcttgggctctggtgatcctctcacttcagcctcccaagtagctgggaccacatgatcgcaccaccacacctggctaattttttgtattttttggtggagatgaggttccttcatgttgtccaggctggtcttgaactcctgagctcaagtgatctgcttgcctcagcctcccaaagtgctgggattactacaggcgtgaaccactgcactcagccagtactttttgcttgagattcaaaacttttaaccatttatgtctgaagagaagagagtttactagtaaaagtttactttttaagattcttttattgctggcttagtctttcaaaaaatgctttaaaaattacaaataatattacagaatctcataacagttggaggtggtcttgtttatgtgagagtgaaaagggtctgaaacttgctgttctgtcacctccaacgtgtgcttacctctttagccactgtccttcttgctactgaagtctggagctttgggaaacacaaattgagaaatgctggattgggctgggctagagttttggatgggctctgacctcttcatattatatatatatatatatatatatatatatatatatatatatatatatatatatacacacacatatacatgtaattttttctttttgaggcaaggtctcactcttttgtccaggctggagtgcagtggtgcgatcatggccccctgcagcctcaacctcttgggctcaagtgatcctcccacttcagcttcctgagtagctgggactacaggcacacaccaccatgcctggctggcctgaagctcctgagcttaagagatccccctgcctcatcctctcagtcatgtaccaccatgcctggctacatttaacttcttataatagatttgtgtatatttaatggtagtaaaccataaaatagaccaatatcgatatatattttatgcattcttgacatacctaactttttcttaagtttttaaatatgcagtttgtgagttttgcttttgagacagtgtcttgttctgttgcccaggatggagtgcagtggcatgaacatggctcactgcaactttgacctcctgggctcaagtgatcctccttcttcagcctcctgagtagctgggaccacagctgtgtgccaccatgcctggctaattaaaaaaatttttttaaatttttttgtagagatggagtcttaagctcctgggcttaagcaatccgcctgcctcggcttcctgaagtgctgggattacaggtgtgagacactgtacctaggcttgtgaggttttttttaattgtcaaagatctcaaaataatttttttttttttttttttgggacagagtctcgctctgttgcccacgctggagtgcagtggtgtgatcttggcttactgcaacctctgcctcctgggttcaagcagttctccctgcctcagcctcccgagtagctagaattacaggcacttgcccccatgcctggctaatttttgtgttattttaatagagatgggttttcgccatattggccagacttgtcttgagctcctgacctcaggtgatccacctgccttggcctcccaaagtgctgggattacaggcgtgagccaccatgccaagcctcaaaatcattttctaatatattaaaaaaagtgtgtgagtggactgtgcaattcaaatctgggttgttaaagggtcagctgtacatcaggaaggtcacttccaaatatatcttgtttctggataatagtggcctagattagaccagtcttcttttttttttttttttttttttgagtcggagtcttgctgtctcacccaggctggagtgcagcaccatgatctcggctcactgcaacctctgcttcttgggttcaagtgattctcctgcctcagccttctgagtagctgggattacaggcgcatgccaccacgcctggctaattttgtatttttaatagagatggggtttcaccatgttggccaggctgatcttgaactcctgacctcatgatccacccgccttggcctcccaaagtgctgggattacaggtgtgagccactgcacccggccgaccagtcttctttttgaagacaattgaaaatgttggataaaatatatagaacattaccttagtagctttgaagaactgggaagaaaagggaatctgttaagccaaattctggaagaaagcctaaagcaggaagttaacagactatctggcgaactgaagccacttttgctttcaatatgtttgccaatatcaagaaatttaggtttctgttcatcagtcttatggggtgaggtggacagaaattaagatgcagagcccacccaacatgtggacatgtaaagtcttatgagatattcttgcctaattaggcttgggctccatatatctacagctgagaggtaaggatgaaccagaactaaccgcttttcatcacctacctcccaatcaaatatcaaggaatttcaagacaagttgtgttggtactgagcagagcaggaggaaaaaagagaaaggaaacaagcaaacaaaagtctttacaaagcataggtgggaaagggaaccgtaagccatacttaatttaggttggttcctgactccaggtgcttgtcagaagcaaatgcaaatgttcttcaaaggaaggctccttcatcttaggcctccccacaattttttaaggacagtaatcagcacatagtcaaagataactagacgtacgaggagacaaggaaccataggcatgaaccagtagaaacaacagacagcagaaaaagataaacatcatataatagaattaaaagatatataataaaacaaccaagcttactgtgtttacagaaataagtgacaaatttgagaatagggaacaggaaatgattgtttttaagtggcattatagttttgaaaaaaccaaatcgaatttttggaataaaaactgactcaggagtttgaggccagcctgggcaacatggtgaaaccttgtctgtacagaaaatacaaaaaaattagctgggtgtagtggcatgcacctgtagtcccagctactccggaggctgatgtgggaggatcacttgagtccaggaagtcaaagttatagtgagccaaggttgtaccaccatgctgcagcctgggtgacagaatgagactgtctcaaaaaaaaaaaaaaaaaaaaaaggaaaaaaagaaaaagataaagtaactgaattaaaaacttaatgatgcaatttgcagcagattggacacatcagaaaaattatcaaactggaatatagatcagataaaaccatccagaatgtagcatagatgatggctagaggcaaaaagttgggaaatatagaagacagtgtaagagatatggggatagagtgagagagtcttaattggaattccagaaggaaaggaagagagaatgggacatttgaagagatgatggctgatattttccagaaccaaggaaagataccaaaccagaattcaagaatttcaatgaatcctaattaggataatagtaagtccacacctaaacacattgtaataaagtcacagaaaaccaaaagtagctggagaaaaagaaaaccatcaaacgagcaagaattagagtaatagatgacttttcttttctttttttctttttcttttttttttttttgagatcgagtttcactcttgttgcccaggctggagtgcaatggtgcaatctgggctcactgcaacctccgccttctgggttcaagcaattctcctgcctcagcctccctaatagctgagattacaggtgcccaccaccaaatgcagctaattttttgtatttttagtagagatggggttttactatgttggccaggctggtctcgaactcctgacctcaggtgatccatatgcctcagcctcccaaagtgttggcattacaggcgtgagccaccacgcctggctagatgacttttcagcagcaacagtggaaatcagcagacagtgaaatgtctactatatggaatgaaaactacctgtcaatctagaattttatgcccagtgaaaatatatttaaagaatgatggtaaaataaggatattttcagataaaaacaacttgtcacgaacatctcacctatgaaagatcatttaaagcagcagtgttcaatggaagtttctgtggaattgggaatgttatttatttttttcttgagacaggtctcactctgtcacccaggctggagtgtggtgcaatcatggctcactgagctaaaaataatatatttatggatgaagtaatgtgataatataatgataatgtgatcactcaggcaatcctcccacctcagcctcctgagtacctgggaccacagatgcacacaacctcgacctgtctaatttttaaaattatttgtagagacgaggtctcgctgtgttgctcaggctcaaactcctgtgctcaagtgattctcccacctcagtcctacagactgctgggattgtaggtgtgagccaccatgtttggcctggaaatgttctttttctgtgctgtccaatattgtagtcataagctacatagggctattgagtacttgaaaattcaataaactgaatttttaagtttattggcttaataagttattaagttattaataagttattaagccaataaacttaatttttattaaatatccacatgcaccatattggacagtatgtttttaaaggatatacttaggacaggatgaaattgatctcaaatcacaaaatgaaatgtatgaagagtaaattaaaggtaaagaaaatgatacatatttagagaatgaaaatgaatatggattgcattaaacatagtaaaaatgtctaatggattaaaaacaagggtataacaagtaggataggtagagtctaggatttaaggtccttgtcttacctagaaggatagtaatttaaaaaaaacctcttatggaaaattttaaatatgtaaaagagaagagtataatgaatccttatgtatttattacccaccttcaacagttatgaattcatgactaaagtgtttttatatatatcccaagtattttaaagtaagtcctaacaatcacattatttaacccataaatatattgttcttataaaagatatgggcttaaagtataataccagtatcatatacagaaaaaaatcaataatttcttagcattatgtagttagtattcacattttcccaattatctaaaaaaagatttaaaaaattatatttggtttcttcaaactggaatccaaacagggtctacatattgcattttgttgatgtgttgcttatgtcttttaaaatctatagattttttgggaaaagagagaataaagattttgattagactttactgcatggtataatttctagaaaaccaacaaaagaacagaaacagagggtataacttccaaatcagtagaggaaataaatagaatgctaaaaagaattgaggggaaagaaggcagcaacaacaaaggagagaaaagaaactggacagggggctgggcacggtggctcatacctataatctcagcactttgggaggccgaggcaggtggattgcttgaggtcaggagttcgagaccagcatgatcaacatggtgaaaccccgtctctactaaaaatacaaaaatcagcagagtgtgatggtgcatgcctgtaatcccagctacttgggagactgagacgggagaatcgcttgaacccaggaggtggaggttgcagtgagcagagatcatgcaactgcactccagcctgggcgacagagcgagactctatttcaaaaaaaacaaaaaacaaaaaacaaaaaaaaaaactgaacgggacaaatggaaagcataaaatatgatgttagatttaacttaaatatatagcaattaaaggtaaattgtctaataaccacacaggtatcatccaggcctgaggtgccagcagctcttgcctggaataattttctaactagtacgcttgtttcagttcttgctttccactatgtattaaccaaatgataacaggagtagcctcttaacaatgtaaatcacatcacaacactctcctgtttaaaactttctgacaacttgctagtaatctcaataaaattcactctttctagtgcctataaggttctatgtgatccagcccatttgtatttctatgattgcatttcctgttatacttcttcactgtagctcagggcgcttaacatatgctgttccatttccctggatcaccagggtcagccagaattcttagttctaagtagtcaaataatctctggttaatttaacagaaaaggaatttatcacaggaggaagctgctaccactactgttattggaatctgctgccacgtttgccactaagggttctacacactctcggctttttaaatgcactatcttctacattaaggtccagcacagatgcttctcttgtggagtggaggtcatatgactgtacccttgccttatgggaagcaaggaaagcaaatattcagtagtaggcagaggtttctgccttctttcaagatgcatatggaagggaattccccaaggacaagaaggtgttttgatgctaagcaaccaagagaatgacttgtgcatcatgatgcttcctttggatcctccctaggtttgctttccctttcattcctgtttctactcagttgtcacctcctcagagaggccttttgtaatcactttctccaaaatggcaattccctatccctaatctagtactctgtttcttactctgccttactttttcttcataccgtttatcactgccacaaccaccactactactactacttatttacttctttattgtgaagttcttatcccagaacataagctctttgctcttcatttactcagtaaacatttgtttgttgaatgaagagaaacatagagattatgctatatattgctgaggaaatttaagagctcatcttagaaagttttgttggagaaaagatcttttaaaaatgggctttgattgaagtatagcatttggagagaaaggatgtaaccattctaaactgggaaaatagcatgaggggagacattgggtctggaataaggtaagtgtgtatgggatgaggaaggagaattgggtctggaataaggtaagtgtgtatgagatgaggaaggagaattgtttaaaatcggatgactgtcagggccctatattcagagaaaaatggatgaagtaaatgtgtgaggcagttgatagagggactcaaattgcaaggtgagatcttgtgattgctagagtaagagataactagtttttttttaattaaaagtatacaatggtattttcacatagccgagtactatgcagctgtaaaacagaatgagaaaaatctctatgcagtattttccaggatatatattaaatgggaaaaaaagcaaagtacagaacaatgtgtgtttagtatgttcctttggtgtgagaagtagggaatggtggctgggcatggtgactcatgcctgtaatccctgcactttgggaggctgaggtgggaggattgcttgagccccggagtttgagaccagcctgggcaacatgtcaaaacctcgtctctccaaaaattagaattagtcaggtgtggtgatgcgtgcctgtagtcccagctacttcggaggctgaggtgggaggatcacctgaatctgagaggtcgaggctgcagtgagccatgatcacgccactgcattccagcctgggtgacagaatgagaccctgccttcagggaaaaaaaaaaaaagtaagagtggaagggtggagaataagaatatgaatatatgcaaatttgtttatgttgcaaagagaaacacttaaaagacaaattagaaactaataaaattgttaccctatggtagaaggtatgggaaatacatgaagtagggatggaaatgtgatttctgagtgtgtctttttattatttagctctgacttttgaattatgtaaatacacattcaaaaattatagtaaatttttttaaatccttaaaattgaagacaaacttgaacaatggtatccatgtttatatcaaaatagttatttaaatacatggagaaaaactatttcaggtgactttggagcttaatactaaatggcatatacgctaaggataaaagaactgcaaaaaaacccccacctttattcattttattgctagttgtaatattggtattttaattttgacaccatatgatatgtattgtaggataaaggcagtaagtctttatgtgaatgattacgaatcaatagagatacaagtataaaatcaaagaagctaagcacaaaacctataattttgaacctgaattataaatgtcaatatgaattcatcatttataatatacatttcttaattcaatccatataaatttgttccttagctctgtccactgagaggacctagaaacactttgtcatcttggtagatgtgagctcttctaaaaccctaattttggtctttaaatacttgtacttgaaagaatccaggactccttgaagaaatgactgattctgggtctggagcaggggacatgcgtaacctggaacattcttgtgccaaaaccaagaaagctttcaaagatggaaaagccaaatcgaaaaggctctccttggccaaaattgggacaatttgaacatcagaagaaataaggagaataatttcttgagaaaatgattatataacaataaatagaacaaatggaggtggctaggtggctattattctttactctgaaaattggtaatgaaaaacgataatatatttgaactgccttttgagtgggcaccattttatatttagtgagggatgccaagtaatgtagaaggaaataaagaatttgaaagtgacaatttgttacaacctgttatgaataattgatttgggccaggatcattaatgggtgctaaaactgtcagacaaaaatgtttgggaattggatattcccatggagccaaagtatgatgccacagatttctagttggcctcaagctaaaagaatataactttacattggaaggattagactatcactaacctagctattattcttagtatcattaaaagtgatccaaaaaagatgtgcttcctgatgtgcttcaatatcaagcatgttgctattgacattttttgtctaaaatattaaatccgaattttaattaacttcagagacttagtttgtaagacatatggaagatcaagaaattacatgctatcttgaggaagcaataaaaaaaactcagtatgaggtacagatgaaccgaccattcttttcaacaaatcaatgtcatgagggagaaaaacgggagaggtagatgggagaaagggaaagtgtcctagaataaacttgatttagagatagagtaaccaaatacaacatgtgtaagctgtaaagtacaattttttttttttttagaaaggaataggatgaagcaagatgaccagcttttaatttagaatgtcaatgatgggtatataggtatgtgtataatcaaacacacaaacacacatatacagtatatattatatatatgcatgtatattttctatatttgaaaatttgtataatgaaaatttaattttttcgtttatagacacttaggttatttggaatttcttttttttttcctgttacaataatgtttttataaacatatttctttccttgtttatgtgtttaagagtataccaagatagggtagctagcagtggaatccctaggtcaaagagtaggcgcatcttttttttttcttttgagatggagtctcgctctgttgccagactggagtataatgccacgatctcggctcactgcaacctccacctcccgggttcaagcgattctcctgcctcagcctcccaagtagctgggattacaggcatgcaccaccacgcccagctaattttgtatttttagtagagatggggtttctccatgttggtcaggctagtctcaaactcctgacctcaatctgcccacctaggcctcccaaagtgctgggattacaggcatgagccaccacgcccggtcatcccatcttaaactctactagaagttgataaattgttcttcagaatgattgtattggtggggattttggacaagggaatcatgagacgtatgtcttccctaccagatggtgaattctttaagggcaggtactatgtagaggttcaaatatagaaatgtttgattgaatacaattgtattttagggggattgcctggcagcaggatggagaaactagagttaaatcagctgagagaccattgtgatgtgtaaggtatgaggcaatgagtgtgtaagaccagaggtagtagagaggaggggatgtgtatgagaacttctgagaagaaaggatcagaatgtatgcattctttttttgagcagaatattgatggttcatttttgtgacttacaagaaccagcagtttattggcttcattttgtaggaagcaggtaagttatacttccctgattaaatcaaaggcatctactggctaattccagtagagttctaaaaagccttttctttatcttctacttgcactcttttcaagcctccatttttttcctgggatacattcatgtgatttaaaaacaactggtagttgaattgggcaaaggcatagtcagtggcaaagatgaggaggatttagtaaaatccatgggcccccttcattgtcaaatgaatttgtgaaatcttacaaggataaaggctgtctcctcgtatggtttttagaaggaaagcgtattcagcaccataacaggggcaattcatcatgtgcagtttttctttctttcttttttttttttaaagacgggggtcttgctcttttgcctaggctggcgtgtaggagtgtgatcatggctcagtgcagccttgacctcccaggctcaagcagtcctcccacctcagcgtcctgagtagctggaccacaggagcatgccaccaaccctggctaatttttgtttttcatttttttttttgagacggagtctcactctgttgcccaggctggagtgcaatggcgccgtctcagctcactgcaacctctgccttccgggttctagcgattctcctgcctcagcctccccagcagctgggactataggcgcatgccaccatgcccagctaattgtttttttattgtttagtagagacggggtttcaccatgttggccaggctggtctcaaactcctgacctcaggtgatccacccacctcagcctcccaaagtgctgggattacaggcgtgagccaccatacctggctcttggctaatttttaaaaatttttggagagattagggtttcaccatgttgttcagtctggtctcaaactcctgggcttgaacgatcttcccaccttggctttccaaaatgctgggattatgggcatgaaccaccatgtctggcctagatgaagtttttctaaaagaatccacttggctaggcatggtggctcatgccttttggcactttgggaggccgaggtgggtggatcacctgatgtcaggggttcgagactagcctggccaacatggtgaaacgctgcctctactaaaaatacaaaattagctgggcgtggtggtgggcgcctatattcccagctacttgagaggctgaggcaggagaatcgcttgaacctgggaggcagaggttgcagtgagctgagatcgtgccattgcactccagcctgggcgacagagccagactctgtcttaaaaaaaaaaaaacaaaaaaaacccttatatcttattttaaaatgttatgacttcttgcatattctgaagttagtggcttcaagaagtttgaccaggccgggcgcagtggctcacgcctgtaatcccagcactttgggaggccgaggcaggcagatcacgaggttaggagatcgagaccatcctggctaacagggtgataccccatctctactaaaaatacaaaaaattagctgggcgtgctggtgtgcacctgtaatcccagctactcaggaggctgaggcaggagaatggtgtgaaccccggaggcggagcttgcagtgagccaagatcgtgccactgcactccagcttgggcgacagagcgagactccatctcaagaaaaaaaaacaaaaaaaaaagtttgaccagtgattctagaacagctctctccagtagaaatatagtgaaccacagatgatgatgattttttttttttgtcattgattgctccattctacatcagcagaaacagaaccagacagggagtgacgagatttgcacctgggtcacacagctgatctgtggcagaggtggggtctcaacttctggcttttagccgtgccttttttttttttttttttggcataacatcatattgccttagtgccctcaaaatattatttgtccagtttgtagttactgactattggaggccaagtcttgatctaggcccacttaccatggggtacacttgtccctcttcctcatggaaacaatttcatcctgacactctcaaagcacatttcatcctgtactgacttcaccttttttaaatcacaaaatttacttagaaaggacctgacatttagagtcagaaaggaacacacattactgaacaccttccttgggcatggtattttcagggagctatgcatgtctggtggggccagccctctaaaaagtggagacaagaaacaacctactcataatcccacagtctccccaaggagccagagattcttgggtctagctaacctcctttattttcttaacagcaagtactataaccttaacttgtgcccatagaaagaactacagaggccaggcggggtggctcacacctgtaatcctagcactttgggaggccaaggcgggcgaattgcctgaggtcaggagtttgagaccagtctagccaacatggtgaaaccccatctctactaaaaatacaaaaaaattagctgggcgtggtggcatgcgcctgtaatccgagctacttgggaggctgaggcaggggaattgcttgaactcgggaggcggaggttgcagtgagccgagattgccccactgcactccagcctgggcgacagagtgagactctgtctcaaaaaaaaaaaaaaaaaaaaaagccacggagacattgggagcattcagggcattggatcactggaggggcttcaaagccaggggagcccacctttgaggctgaatttctcacctactagctttgggaccttggtcaggtgacttttccaaaccttggttttcccatctgtaaagtgagtataggcagtacagcccctctctaggactgtgtgtagggagatggtgcttggtcacacagcactcaacgaatgcaggtcgttaacagtgggagacaatagtaactcagatttattgagcacttactgttggcctggcgcttgccatcaatgaactcattaaaaaaaattttttttttttttgagatgaggtcttattctgtagtctagactggaatgcagtggtgcaatcacagctcactgcagccttgacctcgctgggctcaggtgatcctcccatctcagccttctgagtagctgggaccacaggtgtgtgccacccgcccagctaatttttatgtattttttgtagagatagagttttgccatgttgcctaggcaggtctccaactccagggttcgagcaatccacccatcttggcttcccaaagtgctaggattacaggcatgagcaccacacccagccatttttttaaatttaaattttatttatttatttatgaattaattaattaatgacaggatctgactctgttgcccaggctggagtgcagtggcacagtcatggctcactgaagcctcaaacttctgggcttaagcgatcctcccgccccagcctcctgagtagctgtagctgggactacaggaagacaggaccacatacagctaattttttattttattttagggaaaggtgctatctctctgtgtgttgcccaggctggtcttgagcttctgggctcaagggatgctcctgcctcagcctccccaaatactggaagcaactgtgcctggctaattgcctctaatcctcagaacaaccctgtgagagaggttgtgctattactctcattttacaggtgtgtaaactgaggcgtagaaaggctgagtgacctctccctgcctcactctgggtcctcagccacttcttgcctctgcacgtgttttttttctttcccttaggcagggataaataaagggcatgtatgttgtcttctggggcctgtagtgagagtagtgcattctattaattatgattggttttgttgtcatggctcctaaaaatgatgggctagcaggaactactgcagtaccaaggtttcccatttcccccatgggcctgatcctagggtagcagcttcccattcctctgcagtggtgcctgcagccacagatttaatttaaaaatttctagtagccgctgtgcagtacagtctcaaactcctaggttcaagtgacctccctgccttagcctcccaagtagctggtactgcaggtgcacaccactgtgcccagcaaaattaattttcgtaatagagtttaatcccttacatccaaaatattatgattatttttggagacagggtctcactcctgttgcccagacaggagtgcagtggtgcgatcatggctcactgtagccttgacttcctaggctcaggttattctgtcatcttagcctccgaagtagttgggactacaggcatgtgccaccatgcttggttgatttttttgtattttttgtagagaccaggttttgccatgttgcccagggtggtcttgaactcctggtctcaagcaatccacccgcctcagcctcccaaagtgttggaattacaggcatgagccaccgtgcctggcccttccaaaatattgtttcaacaggtaatcagtataaaagttattaatgaaatattttacattccttcttgatagcaagtcttcaaaatctggtatgttatatttatagcacatctcaatttggactagccacatttcaatgcccagtatccttgtataactagtggttactgtactggacacatcagttctttttttttgagatggagtcttgctctgtcacccaagctggagtgcagtggcgcaatcttgggtcactgcaacctccatctccttgattcaagtgattctcctgccttagcctcctgagtagctgggactacaggcatgcaccaccatgcccggctaatttttttttttttgtatttttcaccatgttggccagggtggtcttaaactcctgacctcaagttatcctctggcattggcttcccaaagggctgggattacaggtatgagtcactgtgcccagcctggacacctcagttttagaatatacccatttgaaacctttgaactcagtttggtgtactgatttgatctactgtcattgagggtggtcctgagctgattttgctttgtaatattattgctagttattagacaagttctggcttcctgcctagatttttctatgctaactgggcaggtccaagagtaattctgagggtctcagacaaagccaatatctacatttattatgttcacaattttttcttttgactagaaaaccgaattgacctcagattttttttttttttttggtcacatctgttaatttgagttgctgccaataaaaagataatatccaggcaagttccagccttgtttagttataagaaattttgttacaacaaggctgacttaggaattcagtaagcattctattatgatatttcctagggtttgtgaaatttagattacatttaaaaaaggcaaacattatgacgattttggttccaagtatttctggagtttctactgtgtgccaaatattgttcattcaatggattaatatttattgagctttttttttttttttctgagacggagtcttgctctattgcccaggctggagtgcaatggcggaatctcggctcgctgcaacctctgcctcctgagttcaagtgattctcctgcctcagcctcctgagtagctgggactacaggtgccagccaccatgcctggctaacagaatgcccttttaatgcagactttaaaagcgataaaagggttgccgcatcttttacttcttaagtctttctctccttatgtggtgggatgtcctcaggttatggttactgaaagaaagttatcctagaaggaagtttttcatcagctttgtgagtatgatttcactggaagtggtcttgacttttggaagatctagctctgagatcaaggttctctctgtggggagtggagaccttatggagaagcagttattcttgtacactgatagtgggagtataagttgctacaatcttttggtagataatttggcagtgtctaattacaactaaaatgtgattttaaacaagtctagcaatcctgcttctcaccataatttctagaacaatgctaactcgtgtgtattgcagcactatttgtaaaggtgaaaaattaaaacaggatcatataattagtatactgtgtgtatttgtttcctattcctatcgtgtaataatttcctatttgctataacaaattactacaaccttagtgccttaaaacaacataaatttattattttatagttctggaagtccgaagacctaaaattaggatttcggcaggactgttccttctggaagctttaggagataatctgttttctttccttttctagcttctaaagaaggcatgcatttcttgacctgtgaccccttcctccatctttaaggccaacagcatagtatcttcaaatctctctcattctctctctgatctctgcttccttctccctgactgtgaccttctgctcccaatgtcacatctcctgttctgatcctcctgtctccctcttataagaagtcttgtgattacatcatacttggataatccaggataaccaccctagtcaggatccttaatttaatcatttctgcagagttccttttgccatgtaaggtagcatattcacaggatctgagaattagtatctagacatctttgggggagcattattcagcctgtcacactccatagtactgtgcagccactaaaaagactgtgtgtacagagacaggaagatttcactgaaaaaacaagaggattgcctttgagtggtggctcacgcctgtaatcccagcactttgggaggccaaggcaggtggatcacctgaggtcaggagtttgagaccagcctgaccaaaatgccgaaaccccatctctactaaaaatgcaaaaattagccgggcctggtggtgcatgcctgtaatcccagctacttgggaggctgaggcagaagaattgcttgaaccagggaggcggaggttgcagtgagccaagattgtgctattgcactctagcctgggcaacaagagcgaaactccatctcaaaaaagtaaaatgaaaaaaagaggattgcttgtgaatggggaaaaaggcaagttgccaaacaatttagtatgatcccctttttgtgtgttttttaattttaattttttatttttgcccacccgcctgacccctttgtgtgtttttgtttaaaaagaagtaagcattgtgtgtatgtgtttctaatatgcatagaaaagatctggaaggatgcacactaaacatttagatagtggttacttctgagaacacaaggatgtgttgagatgactttaaactgtataattcttatgtacagtaaacatgtgtttgtttattgtgattttatttatttatttatttatttttgagacggagtctcactctgtcgcctgggctggagtgcagtggtgtgatctcggctcactgcaacctctgcctcctgggttcaaaacgattctcctgcctcagcttcccgagtagctgggattacaggcgcctgccactatgcctagataattttttgtatttttagtagagacggggtttcatcatgttggccaggctggtctcgaactcctgacctcgtgatttgcccgcctcagcctcccaaagtgctgggattataggcatgagccactgtgcccagccctgtaatttttatgaaagtatacatgcacagttctgacttatacgtgggagctaaacagtggttatacatggacatacggagggggataatagacactagggagtccaaaagcggggagggtggcagaggggcaagggttgaaaaattccctgttgggtacagtgttcactattcaggtgatggacacattgaaagcccagacttcaccacgatgcaatatatacgtgtaacaaactgcacctgtacctgctgaatctataaaaataaaaactttttttaaggaagaaaaaattatatgtgcacatagttgaaaaagtaaaaaaataagccttcttatgaaaatcctacactcagttgtgttatttcttcccaccccagaaccctctttcccagaggtctccattttatgattagctcttcatatttctaaataacaaatgtgtgctatttcttgatttttttccacattagataccttttgactttctacttaggaagatgaggcttcagctgttttaagctattcctatgcatattttccctcaccatttatcttttcaataggattacactgaaaattttgctttacattacaccccaggaactattattcttagctaatccacgcctataccacaaaggaaatgcgtgtgcatatctctgtgtgtgtgtgtgtaaaggaaaaactgtacaagagacatgtatacctttatggtatagtttttttctcccttctgaaaaatagtctagttttttcttttcttagttttcttgtatccgtcattaacgcatcccaaactctccactgacattcattctcttcttaggagacttaccagcctgtcttttccttggagacctccttcctggaactctgttctctggctcccatctgggtttgccttctaggtctgtgtcacagctgttgtcttggggtctcccttcaccatcattttgggtactctctcctattctatgttggatctttatttcctgaagcccttgattattctttctagtttacttttggttttggtggaacacgtcatctagtggttttctgaaaaaggggtatatgggagatacatatatggatataatatttgaaaatatcatttattttaaaaataaaggggaaaaaaactccattaggtaaaatgggcatggaggaaaaaatccaaatataccagagttcatgtgatgatttttcgtttcaaaggaattacactgggagacactaaacttaaatccttggaggacatgccctttatatcccagcagattcctagtgttcttcaacttagaacacaggaagaattgagaataagggtctgattttaagatcaaaactagtgttctttggtaaatctttttactttttacttgcttcctctgcaaagtggagacaataatgatcttgttaaggccctttagataaaatgagacaatgtagataaagagcaagatgctagggactgtttttattattattgaaattgttttcttatgagactgtaggcaactaaatttggaatattttcatacacgtacacatgattatagtatgctaaattttacttggagtcatattttacatacttttactatgaaaaatgctttcaataactaattttttttttttttttgatacggagtcttgctctgtcgcccaggctggagtgcggtggcgcgatctcggctcactgcaagctccgcctcccgggttcgcgccattctcctgcctcagcctcccgagtagctgggactgcaggcacccatcaccacgctcagctaattttttgtattttcagtagagacggggtttcaccatgttagccaggatggtgtcaatctcctgacctcgtgatccacccgcctcggcctcccaaagtgctgggattacaggcgtgagccaccgcgcccagcctcaatatctaatgtggtgcattaaaggctttattaagcttatctgtaacctaattttgaaaaaaagcttttaaataaaagttttaatattatattagtaatatatgcttgctataaaaaaattaaaacttagaaaaaagtagaaaaaagggaaaattcatagttttcattacaatggtgtattgtttccaagtggtttttttttttctttcttttttttttttgagacggagttttgctcttgttgcccaggctggagtgcaatggcagaatctcggctcactgcaacctctgcctcccgggttcaagcgattctctgcctcagcctccggagtagctgggattacaggcgtcagccaccacacccagctaattcttttaatttttttatttttagtaaaggtgggatttcactgtgttggcgaggctggtcttgaactcctgacctcaggtgatccacctgcctcggcctcccaaagtgctgggattacaggcatgagccactacactcggctccaagtgtttttctattaagatcatggtatatatacaacttagagtcctgattcttaaactgttacatactgtttgtaaatattttcaaatgaatatatatagtattattttaaaaatatttttatcttttagagatctgtactgaaatattagagataatattatataatgtctaacacttgattgaaaacaatgggtggagttgggaaatgagtcagccattaattgataatattaaactaaatggctatgtgggagtttattatatgactgtctagtttatatatactacaaattgttcataatgtaaaagaaataaatcactacagtattccattatgacatatcttaatttctttaatcattgtttgtggttgtttttttccttattttaaataacattagtattgatatatttagatttttgaatagtttccttatgatgggtttatttgagtagaattactaggtcaaagagtatgaacattttaaagactgggtgtgtgtagggatgtgtgtgtaatacaaaattggagtggagaaaatctttaggagatttatattggatttataattgtactcattgagcataagaattatatagcaagtttattttaaatttttaatgtgagtaaaggcttattaaatataataggtgtaaacattttaaaaattcatattcttatttaagagtgctagtaaccattcacgtggaactagtactttatgcttttatagagttttcctgtctagtacatgccataatcctcacaacaactctataagctgtaaattacggaaattcaaaacaaaatagactaagctttaacatgtaattattggtagtaattcctgttaccactagatggccatcttggcatgtactttgagcaaaagtagctagtttgtataatagatttattattaacatacattttaattggagtaaagaacttatttgccacagcagaaaagcaatatatttttgttgttaaactaaatgattttttaaaaatctagcactttatgtctgaggatttttgtttgtttttgagacagtcttgctctgttgcccaggctggagtgcagtggagcaatcttggctcactacagcctctgcctcctgggttcagggattctcctgcttcagccacctgagtagctgggaccacacccagctaatttttgtattttttagcagagatgggcggggtttcaccatgttggctaggctggtctcaaactcctggcctcaagtgatcttcccttctcggcctcccaaagtgctaggattacaggcttgagtcactgcacccgtccagaattttaatatatagatattgaactgagtaaattagtgacttgacctggagctatgctccccttggtcaatgtagttgtcttattacaactgagttcttctaagggtcaaaaactacgatgagtgtgtgtggtccctgtcaggtgagaatcagaagtgaaaatgctacgattttgttttcattatttaaaactttactaattatcttgacaagaaaatcagaggacctttgatttttgtcttgcttgatctcatgtgtattttcttccattgatttcaatcttattagccccattgccacctttttatgataaatattttgtattgccccttccgctaactttaaatgaaaatcatagttgctgggtgcagtggctcatgcctatagtcccagcactttgggaggctgcagtaggcagattgcttgagcacaggagttcaagaccagcctgggcaacatggcaaaaacccatttctacaaaaaatacaaaaatcagccgggtttagtggtgtactcttgtagttgcagctactcgggagactgaggcgggaggatcggttgagcctgggaggtcgaggctgtggtgaactatgatctcaccgctgtactccagcctgggctacagagagagactctatctcaaaagaaaagaaagaaaatcatagttaatgttactgatctgcataatttcaaaaaaatcatgttttgattataatataaaggataatttgaaaataagcaatttataataaattgtgtattaaaatatgtaaatacttgagcacactacattagatgtcacagtgaggtagtaaaatacttataccagcacataaaatcactgtgaatgtgatagctggacaagctgattgatacgtgatattggtgatgcagatgccaaagtggcattgacatgatttccaaaatggtaaacaactcttagtaaatttctgaacaaaacaaaatagatttatagtatggctgcattctagaatatttggaatacattaacactgtggaaaaatacgttttgtttacatgttatattccagccgtagatatattttcaatggaatctttgaaaattatctagaacatgtgacaattctttgtcctacaggattattccctcctttgctggacctctagtatccatggcacttgcccattaaatgctagcagagcatcctcaccttcagtctccaaaatgcctctataaacatacaaagggccctgaagggggcagtgctgctaccaatgagaaccactgatttccaagaatccatctacattaatctaccatatggcggccgggcgcggtggctcacgcctgtaatcccagcactatgggaggccgaggcgggcagatcacgaggtgaggagatcgagaccatcctggctaacacggtgaaaccctgtctctactaaaaatacaaaaaattagccgggcgtggtggctggcgcctgtactcccagctactcgggaggctgaggcaggagaatggtgtgaacctgggaggtggagcttgcagtgagccgagatcacgccactgcactccagcctgggcaacagagcgagactccgtctcaaaaaataaataaataaataaataaataaatctaccgtatggctgtattgctcatggaattttaaaaccagagtaacttaagtatattaggtcctaaactgtgatatgttttgaataattaagacaattgaataattatggtaaaagtcgatttgttcaaatgcttcatgattttattataattcatgtaagcagatctatgattgatattttaagttcccaacattatacattttctttgttttttccgctcatcctctctagtaagtcaggaacataaaactttccttaatgttatcatttgcttagttgacagtcatacaatgtaatttgtccctttgaaaaaaaattttttaaattaggtaatatagtaacattagaaactttgtaaaatgacaaaatttcccataatcataccatcctaaacaattgttaatatttttcagtattttatactttatatgcatattttgacgttaaaaagatttatatcttttcataatgtggcataaattttttgttgtttatatagcttcaaaactattaggttaaattactgcatttttttcctttagattctacaattcaatcattttcttacctttagattggtcacattagaagagttatatataatatatatgtgtatgcatatataatctttactgataaatctgtttcaatatatttttcctttagaatagattcttagaagtgggatcacttattgggtcaatggacttggatatttttgtaacttgttaaatttgcccagttgactaaaaaataaagctgatccacttatattactatcagcatatctgagttgtcaatatatcaaagcatcagtttcacttaattcttggctgcatcaggaattactttaaaattatttactttatgttaacctgattaacagtgacactgagcattttttgcccttgtgaattatttctattttcttttctgtaaaacatatggtcctgtcttttaactattgatgtgttgggtccttgctgtttacttttcccccaccttttcattttgagtcagaccttttaaataagtaaaacatgaatgtttcttctagtcatttttgtggtaaatatatttctttgccatttcttattttgattattttaatatgtagaagttgcacatttttatgagactcaacagttatctacccatagaaaatactatgtgttatcaaagaaagaacataagacagtcaaaattcagggttctggacagagatatttataatacttgttatatttgacaaaggactcatatccagaacatatgtcagaacgcttacaaatcaataaaaaaaagacagacaacccagtttcaaaaggtggggaaaagccctaaactctcacttcacaaaagatactcagatatctaaaccatttggcagtatgtatgctgaatgaatgcaaactgattttatattacctgtgtaaaacctatttaaaaatgtagatttttggaaagataaatttcatcgtaaagccaaatttatatcattcagagtataaatgctgtatttgttagtgtgaccagtttagattttaccgtacttctgtaggagagaggtcggtttctttttgctttatcctgcctttaataggaaattatttttgcaggtttcttccctgttgaatatgatgttaatttttactgtccagcagttacatattatctaggaaaaaatgcctcattggagatcagtaatctctatagatcttagcgtctttaagcaggattgaggagtatcttggctttcagtgactccatcaaggtatgagagaataggagaaaaaaaggaaaggaaatcagaaattcaaggatgaaaatgttgcgagtgtcacagagaagtgtatttaaaaaacccatataaatcccacaagtacatgtggttgtttttcctattctttactacaggatataatatagattattttttttttttgagatggagtctcactcttgcccaggctggattgaatttttagtagagacagggtttcaccctgttggccgggctggtctcgaacacctgacctcaagtgattcacccacctcggcctcccagagtggtgggattacaggtgtaagctgctgcgccttgccataatatagattatttttatccttacaaatgaaacaattctaagaaattctttcttgccttgtgacgaaggcctgtttgggatatgtatatctcacctaattattgtgcaagcctccaagtattagtatctgtccctggttacctcttctgtgcttggttattcccatcgtagctaatctactaaaaattataggcataattctgtttattttcatggacagcttttcttataattaccccttttagatttcttatcccttttaatgatgtagaacattttgtttctttctggcagaaataactttttcaagccccatttgccaacttccttctcacacatacgctcctttctcttccttattgagtgcaagttgagtatcccttatctgaaatacttaggtccataatgtttccgattttgggttttttcagattttggaatatttgcattaatacttactggttcagcatccctaatgcaaaaatgcaaaatctgaaatgctctaatgagtatttcctttgatgcttaaaaagtttcagatttcagatttttggattagggatactcaacctgtaatagttgttcataccaggtagagatacactaatcaacctgccattactctctttataatttattttctcttgactacttacctaaccctcagagtatatactttttttgagataaatttataccccaggcacattttttcattgtaaatctcagggattccatatattcccttccccatgggcctaaaattctgcttttccttacttaggatactgtatgacataattgagtaatcttccagctggatagtctttctgggtttggaaactttcttctcagaactgtcatcccttgaatttgaatgtttgtgatacattcaaatcttaatttacctatattctactgtcataatcttttttctgacatatatttcaatatttcttattcaagaagacacaaatacatacacacccatgcacacctcacatcccaggctgggacattagccttttcagatatattaaattcaaggcacaagatattctttcctggtttttttttttttttttgagacagagtttactttgttgcccaggctagagtgcagtggcatgatctcggctcactgcaacctccgcctcctgggttcaagtgattcttgtgcctcagcctcctgagtagctgggaccctaggtgtgagcccccatgcccagccaattttttatttttagtagagatagggtttcaccatgttgtccaggctggtctcgaactcctggcctcaaggatccacctgcctcagcctcccagactgctgggattacagggatgtgccatcgcacctggcctctagcctctaatgagacagtctattcgtaatactattactgtttttagtattttcatagaatgtgaattgtttactttctgcaagaacttaaatatacattgcatgtaggagggcagaaaatttgttttttaaaattttgaacacatttactattgcaaaaaaatttatgctaagtttagtttaatttgcaccaacaacagatgacaatatcttgcactttatttacttttatgaaaaattttattgctgcaaaccctccagtaaaaacaattagttgccagttttaaattttagaccagcttggctgggtggggtggctcatgcctgtaatcccatcactttgggaggccaaggcgggcagatcatttgaggtcaggagtttgagaccagcctggctaacatggtgaaaccctgtctctactgaaaatagaaaaattagctgggtgtggtggtgcatgcctgtagtccaagctacttgggaggctgaggcaggagaatcacatgaacccaggaggcggaggttgcagtgagccaacatcgtgccactgcactccagcctgggtgacaggccgagactctgtgtcaagaaaaaaataaataaataaaaatttaggccagcttttctctgctacttacctcttctatcttttaccagatgtatttggagaatttaaactacttttattctaagtaaaaacttaatgagaaaggaaaatggattctaaaatccaaatataaattgcttttgtatgatctgtaattttaaattaaccatagcacactcttttgaagggataattgagaactgacttattaataaagacaggaagggaaaatgtcatgtcatagtgtataaatggagattttgatgttcagttcatctatgttttgtttagatgtccctggtagatttgggaaagaagcttttagaagcggcacgagcaggtcaagatgatgaagttcgtattttgatggcaaatggagctccctttactacagactgggtaaagaatgattttaatattgtgtgttctttttccttctcatttttgagtttttgcagagaaaaatgtagtcagtattgtgtttataagtggtaaaaagttattatttttgcaaatgtgtttattattttagaattataactgtcctaaaagaagtggtttatattattttctttgatattggacaaccttatccaaatatttcatccacaaagagtttttctttcaaactgtggagtgcattaatgtggcatgaatataaaaatgtatctgcttgggatttaatttaaaggccttataaatagcacaggtagaatttataattcagaaagatactgataaagattggagttagtgttaatagtcactcctaaaagaaaaacaagtttatgtttcaattattacttgtaaaactgttgcagacatgacgaaagaggaagaaaggaatgggaatgagatcttgacaactatggaaagaaggtagttgtggggaaggcaaaaaaaaataactctttaattctgggggcaaataaaaaagtattgtcttgtggatatggaatgctaggaatctgaattaacctgcccattggtaacaactaaaaattccagatttttgattttgccgtttttgcctttctttctctttttacatttttcatgaaaaaacaaaattttttattatagaaaatttcaaatatatatcaacgatatccctgtaataccctttacccaacttcaaaaattatcaaatcatgatgaatattgtttcctctataactctgtctactgtattattttttgttctgtattattttaaagcaaattccagggaccatatcattttatccataaatgtttctttaaagaataaataaatctttaaagaataaagactttttgatgaaatattttaaagaaagtcttcttaagtacactgctgaattagaaagaaagagattatcaacctgaaaaactaagtgaaggcaagaacccagagaaattttaccctaaagaacattaggtgaactcacacttgtctggtggtttttccacctcactggcttggggtactaaagctaaagacctgagagtgttcatggagagaagtctgataggagatcttatctcataattctggaatcccaaagagctgcaccttcagtgtagggataaagcaggaataccctgtccctcctcctgtctgctcctgcccttgcccctgttgccgtgatgctgcaaagataataagctgatgtgaaccaagacatcaaatggagagaggaaaacaatctgatggtgagaatttggaatcacaaggcatcctttttacacacttgcagcctgaactcataaatacttgtgtagtctaaaaaactgtaaactgagaaatgaatttgaagtgatctttggactagggattaccccaggctcttgacagaagcaaatgaatatctgctctggaggaacctgccttcatcccaggcttcatatccacaaatgaaattcaaaggaaagtgagcagtcagaaataactaaacacatgaacacatgccaatttggacagtaatctgctaaaacaactgtcaacagaagcagacctataaggacttgagataaaattttagtaacagattagaaacagctaaagagaaaattagtaaactgaaaggtatgaaaaaaaaaatgatccagactatgtcacagataaaaatagatagaaaatgtaaaagagatgttaggaatcatgaaggatcatgtgagaaagtctaacatctgatcatagatccacaaaaagagcaaaaatagggatgaaataattcaaagaggtaattgctgagaattttccagaactgatgaaagatggcagcccacagatttgagtagcctaacaaatctccagcaggatcaatttaaaaactaatctatatctagatatatcatagtgatgctgtagtacctcaagacaaaaagatctttttttttttttttgagatggagtctcacactgttgcctgggctggagtgcaatggttcagtctcggctcactgcaacctccgcctgccgggttcaagtgattctcctgcctcagcctcccaagtagctgagattacaggcacccaccaccaagcccagctaatgttttgtatttttagtagagatggggtttcaatatgttggccagctggtcttgaactcctgaccccgtgatcagcccgcctcggcctcccaaagacagaaagatcttaagaaggattagtatccataatacataaggaattcccatgggttagcaataaaaagacaaggcaatagaagactgactggatatggtgctttaccaaggagaaagtttgatcaataaacatgaaaagatactcaactacattaaaattggggcaaatgcaaagtaaaatcatgaaatactattatatatccaccagattagcaaaaacagttgagcagtaccaaggcttggtgaggagatggtgggaactctcaaatatttttggtggaagtatggaattggtataatcgttatggaagacagtttggcagcacatagtaaatttggagatgtgcatagtatatgatgtagcagttgggcttctaagactattcccgagagaagacttgttcatgtgcctgaaacatatacaagactactgtatttagcagcaacattattcataataacacaaaaactggaaacaatctaaatgttcatcagtagattggttaaattaattgtggtttactcattcaatggaatattatagaacacagaaaattagtaagctatacttacagttattaacatggtgaatctcatgaatacagtgtcaagcaaaagaaggcaagtcacagagaaatacatgcagtataattctgtttaaataaaactcaaaacaggcaaaaccaaagtatattttttagggataagtgatacaaagaaaactaagtaatgcttgtcacaaaattcaaaatattagttacctctggggctgggggaggggcttgtgatcagggagtggcatgtgggaagatttttttttttttttttttgagacagagtttcgctctgttgcccaggctggagtgcagtggcatgatcttggctcactgaagcctctgcctcccgggttcaagtgattctcctgcctcaggcaccgaagtagctgggataacaggcgcccaccctcacacccagctaattttttatttttagtagatgaggtttcaccatgttggccaggctggtctcgaactcctgacctcaggcaatccacctgccttggccacccaaagtgttgggattacaggcgtgagccactgcgcctggccagattttaaattactggcagtgttttatttctagactatggtgttgattcacaggtgtttgccttaaactacatatattggctgagcacagtggcttacgcttgtaatcccagcactttgggagactgaggtggcagattatttgaggccagaagttcaagaccagcatgggcaacatagaccccatctcaaacaaaaagaaaaaaattagtcaggcatggtggctcagcctgtagtcctagctactctggaggctgagatgggaggattgcttgagcctaggagttagaggttacagtgagctacgatagctccactgcattctagcctgggcgacagagcaagaagctgactctaaaaaaatgaataaaaaaaaacccaaaaagctacaaaaactacatggccaggtgtggtggctcatatccataatcccagcacttcgggaggctgagggaggaggatcgcttgagctcagaagtttgaaggtacagtgagctgtgatcaccccattggactccagcctgagtgacagagtgagaccctgtctcagaaaaaaacaaaaaaccctgcatatatgtatatatattttgtgtcaataaccaagaagggaaagtctcagaagacaaaaataaaaaagtagatcctaatgtcaaactgagcaaagctcctggttgctaaatgggctgttgagatattttcattaaatactgaaatttaagagtatagaaaaggctagttaaagaaaaattgacaaagcatggagaaagaaaggattgtttaaggatcttctttgatctgctgggatgaccttctcttaaaaatgtaaggtttagctgggtttgttggtgtgtgcctgtagtcccagctactctggaggctgaggtggacagattgcttgagcccagcagttcaaagctgtagtgtgtgataattgtacctatgaatatccattgcaccccagcctgggcaacacagtgaggccctgtctctaattaaacaaacaacaattaaacaaacaaacaaacaaaaaatatatctatctctctatctatagatagatagatagagagataggactaaggacctttatacatatatctcacttaatctcttcataacataataaactgtttatatgtgtaaatttccttagtccaaatatcttagttctttggaatatcaagtgatgtggtaatcagagggttatagggattttctgtgcctttaaatgcatgtgatagaacttaatcttccttccctcacattttagtactccctctgtgtattgtggatgtcaatttaatgactagaccacatggaaccaatttcaggagaattgggctctgttttggttttgtcctgattcaactttggcaaatgcacctaagatttttcctttgaaaaaaatccctttaaaaagatcactgagatgtttcaatacgtgaattttttaagacctacaaaacaattttgatccacttaaagtaaaaatgtacactgttacatttatttgagatgaattttacagacgaagttaacttagcaagttttgtgtgattggtatgaggaatacattctaatacacagaaaaatttctcaaactctatctctgatttcttttttttttttttttctttagaccaaaatctcgctgtgtcacccaggctggagtgcagtggcgcgatctcggctcactgcaacctctgcctcctgggttcaagcgattctcctgccttagcctcctgagtagctgggattacaggcacatgccaccacgcctggctaatttctgtatttttagtagagatggggtttcaccatgttggccagggtggtcttgaattcctgacctcaagtgatccacccgccttggcttcccaaagtgctgggattacaggcgtgagccaccacgttcggcctctatatcttaatttctaatgaaattaattttgttcaggcagtttatctgataaaaaataatgaagaaagaaagtttgaattaaaggaaatactggattttcttcttcattgagagtgtttgggaattcttcaagatgtctatgaagaggatgtgataagcatgaatctaggcatttcttttgagttttgagttgctatgtaaacagataatgtaaagaaaatctgtttactatataaacagaagtgtagtaacaataatgtaaatgtggatttttttttttttctgtggtacagctgggaacttctccacttcatctagcagcacagtatggtcattattccaccacagaggtactgctgcgagctggtgtgagcagagatgccagaaccaaagtggaccgaacaccattacatatggcagcttctgagggccatgccagcatagtagaggttttacttaaggtatgtgttctctttttgcactttgcttttaaaatactttacggttttataagaaggagagggaactagtttttgttaaatgcctacttagtattttatctatagtatttcattttttgtgtgtataagcccattaaatgaaaattgtcttatagctttcatttcatgagggacaaaacttcatttaggtatattcttagttaaatcagctaattgatttcttggaccttggtctatcttatgatgagggactacagcattttttctttttgttttttttttttttttgagacagaatctctgtcacccaggctgcagtgcagtggcacgatctcagctcactgcaacctccacctcctgggttcaagtgattctcctgcctcagcctcccgagtagctgggactacaggcgcccaccaccatgcccagctaatttttgtatttttagtagagatggggtttcaccatattggcttgactggtctcgaactcctgaccttgtgatccgcctgccttgggctcccaaagtgctgggattacaggtgtgagccaccatgtccggcccttaattttttgtattgtagagatggggttttgccatattgcccaggctagtttcaaacccctgagctcagctgatccaaccgcctcggcctcccaaagtgctgggattacaggcgtgagccactgcacctggcctggaacatctatttaacatatacatataaataattgactacattatttgttcttgctttaaagcacagaactaataatttcatatcaggaattttttatgtgatatttcatattttagtaaactctttgaaatatttttgtagcatggtgctgatgtcaatgcaaaggacatgttaaagatgacagctctccattgggccacagaacacaatcatcaagaggtggtggaacttttaatcaaatatggtgctgatgtacacacgcaaagtaaattttgtaaaactgcatttgatatttcaatagacaatggaaatgaagatttagcagagatattacaggtaacttttggcttttaatttaagaaaataaagaaaaagaagccttatcagtagagggatctcttatattgtgcatgatttaaactattgtttgtagcctttcattttggacttagttattttggataggcctttttctctttcacttcctctttgtttattactattcattttcttgattataaggccagtctcttcattaacattagataaggtgattactttctgttttttaagtttctgaatttccctttagaccttttttttttttttttttttttttttgagccagagtcttgatctgtcccccaggctggagtgtagtggcacgatcttggctcactgcaacttctgcctcctgggttcaagcaattctcctgccccagcctctcaaatagctgggactacaggtgcatgctgccatgcctggctaattttttgtgttttaagtagagatggtgtttcatcatgttgcccaggctggtgttgaactcttgagctcaggcgatctgcctgcctcggcctcccaaagtgctgggattacaggcgtgagccactgcgcctggccctagacattttattctattatttttgttgcattttgatactatatggtttttccaagtctactataaatgactttataaaaattaaaaaacatatatattagcaaccataatatcattccttgagtgagtgatgcagtttgatttgtttcttttatctttcagcatcctcaaaaatatctgttgtttttggcttttgggaagatttttctagtaaccaacattacttctcttattttcagccagatgacataatataaattatcttctttaattactgcctcttcttgcctgtttgttcccaatcccagcagtagaactcttcttttctaagactatctgactcctttgagcttccactagttacttaaaagatgttttatgttcaggaaaatgaattctaccatgcctcttttcattccttttactcctaagagtgcagtttgggggttggagttgaagatggggaacaattaattgagaaggacatgctttatatatgtggtattatgtattgccaaacgtagaagaaataattaaattcctatagctacagggcagaaatattttttgtttgttttgtttttgtttttgttttttgagatgggggtctcactatgttgcccatgctggtcttgaactcctgggcttaaccactccttctgcctcagccccctgaatagctgggattacaggcacctgccacctcagccagcttaatgtccagttgttctgtgttctgttaaaaaccttttagatactcgtttctcctctcccaggattttgctgctttacctaagagggggacttgggatataaatatatacccatgatgtgcccctacactgtcagtggaccttagacaaatatttccacttgtactatgtgattcttcttagagaatactcctttatatgtgtttgtattatatggagaatttgtgctatatgttctggttataattctgaaaacactgtggtcattttttccctagattgctatgcagaaccaaatcaacacaaacccagagagtcctgacactgtgacaatacatgctgcaacaccacagtttatcattggacctggaggggtggtgaacctaacaggtctggtatcttcagaaaattcatccaaggcaacaggtattgagatgcatataggataggctttgggattttatgctttagtaggtattcatccttgtaagaaaggacggttggagaatgagggtaagattctatcagccacctttgttttctttggtataactggcaaaaagatttttatgagacaaaacaatctgaagaaaggtgatattacaaaatttactgcagtattacctttcaaaagctaatgctatccaagctttgtttaagagtcagtaagataaatagaatatcagaaatatgcattggattaagctccttagaaattcaaatctattttcttttttcttacagatgaaacgggtgtatctgctgttcagtttggaaactcttctacatcagtattagctacattagctgccttagctgaagcatctgctccattgtccaattcttcagaaactccaggttagaaaaacgagtctaatgtgtacattaaaattgcagattcaggctgggtgccgtggctcacacctgtaatcctagcactttgggagggcgaggcgggtggattgcctgagctcaggagtttgagaccagcctggacaacatagtgaaactctgtttctactaaaaatacagaaaattagccaggcgtggtggcacatggcctgtaatcccagctactcgggaggctgaggcaggaggattgcttgaacccgggaggtgaaggctgcagtgagctgagtttgtgccactgcactccagcctgggtgatagagcaagactctgtctcaaaaaaaaaaaaaaaaaaaaaaaaccaaaaacagttgcagattcaaatatttacaaaggccaggaagacaataaaaggctaaagtgggcaggattgagattacacccggctgaagaatggggcaagggcagggaggcatctgtgactcaactctagctgattatagtcatcagtccagtattcccaaattctgttttttaataggaagctgtgaatctggattttaaaagaacattaaatcttggtaactaattgaaaaacaaaacttgtgtggctcacagaaaaaaatgtccctgtctctaatttggctcttgatttactagtttgtgactttttgtttaaacaactcactttggctgggcatggtagctcacacctgtaatcctaacactttgagaggccaagataggtggattgcttgagcccagaaccctgggcaacatggtgaaaccctatctctaccaaaaaatataaaaattagtcaggtgtggtggtccactcctgtggtcccagctgctcaggaggctgaggtcagaggatcgcttgaacctgggaggcagaggttgccatgagccaagatcatgccactgcattccagcctaggcgactgaatgagaccctgcctcaaaaaaaaaacccaaaaccaaaaaacacttttttcataaattttaatttttagcagctctactagagtgttataaaatcttaatgactgatagaactaggaaatagtatacagaaaccactgttaaagggttacctggctgggtgcggtggcttgctcctgtaagcccagcactttgggaggctgaggcgggtggatcacctgaggtcaggagttcgagaccagcctgaccaatatggagaaatcccgtctctgctaaaaatacaaaattagccaggcgtagtggcccatgcctgtaatcccagctactcgggaggctgaggcaggagaatggcttgaacccgggaggtggaggttgcggtgagccgagatcacgccattgcactccagcctgggcaacaagagcaaaactctgtctcaaaaagaaatgaaagggttacctgttgttaaatgatgacaaacagtattcatgaacatttggtttatacaagatttacctttatacttaaccaaaatacttcttgatgtaattattatgtcggtaaaatttaattaggaaattttttaaattccaagaaaatatttttctgtagcttaagccattatatttggttcagtgcttataaaagcaaagaataatttgtcattcattttttaaattagtgttttttcaaaatttgatcaataataacaacatttcatcaaatgcttactctctctgctaggcactgtgataaatattttacttataatctcatttattcctcaccagaaagctttaaggtggatattactgtaatattcttgacttggaggagttgggggaatgctacctttttcttttctctttttcttttcttttctctttctttttttttttttttgacatggagtctcattttgtcacacaggctggagtacagtggtacagttttggctcactgcagcctccatctcccaggttcaagcagttctcctgcctcagcctccccagtagctgggattacaggcatgcaccaccacacccagctattttttgtatttttagtagggacggggtttcaccatgttggccaagctggtctcgaactcctcacctcagtgatctgccttcctcggcctcccaaggtgctaggattacaggcatgagccactgtgcccagcctctttttgaaaataacatttatccattctttagcttctgtagcattataatctaagtttgaatccaagcctttatatttgggagtcttaagatttgtatgaatcacttttggccattagcagttatatgcatcatcatactaacatgctgcttttataacctatgcctggatctatttaatacttatgtaattgcagaagcatagcaaagaaaactgatttcattggtggtttctatttggttaaacttgtaaatttcttttctttaattaaataacttacctctggccgggtgtggtggctcatgcctataattctagtactttgggaggctaagggtggcagatcacttgagttcagaagttcaaaaccagcctggacaacgtggcaaaatcctgtctctacagaaaaaattagctgggcatggtggcaggtgcctgtgttcacagctacttgggaggctgaggtgggaggatcacttgagccttggaagcagaggtagcagtgagctgtgatcgcgccactatactccagcgtgggtgacagaccaagaccttgtctcaaaaacaaaaaaacaaaaacgaaaacaaaaacacatatatctgaaagtaaaacggcttttcttctaagtcagctggaaattttgacatttaaatgtgtgactccatgaaatggccacaccaatttctctaacttctcttaacctttgaaaatgttttggtctagtctgagagaattagtaatttcagttagtttttattgcatgtgacttaaaatcttctatgagcacaataatttttcatttcaatatgacatcacagtggaatctttttttggagacagggtctcactctgtcaccccaggctggagtgcagtgacgtgatcttggctcactgaagcctccgcctcctgggttcaagcgattctcctgcctcagcctcctgagtagctgggattacaggcacacgccaccactctcagccaatttttgtatttttagtagagatggggtttcgccatgttggccaggctggcctcgaacttctgatctgtccatctcggcctctcagagtgctgaggttacaggtgtgagccactgcacccggcccatagtggaatctttttgaagatattttaaaagcttacttaaaaagaagtgccgggagcgcaggctcactcctgtaataccagtactttgggaggctgaggtgggcaggttacgaggtcaggagttcaagaccagcttggccaacatgtttctgaaaccctgtctctactaaaaacacaaaaattagctgggtgtggtggtgtgcccctgtaatcccagctactggggaggctgaggcaggagaatggcttgaacctgggaggcagaggttgcagtgagccgagattgtgccactgcaccccagcctgggtgacagagcaagactccatctcaaaaaaaaaaaagaagtaatgggtgggctcagtggctcacacctgtaatcccagcactttgggaggccgaggtgggtggatcatttggggtcaggagttcaagacaagcctggccaacatggtgaaactccatctctactaaaaatacaaacattagccggatgtggtggcgtatgcctgtaatcccagctactcgggaggctgagacaggagaatcgcttgaacctcagaggtggaggttgcagtgagccaagattgtgccactgtgctccagcctgggcaacacagggagactctgtctcaaaaaaaaaaaaaaaaaaaaaaagaattaagttaaagtttaagtatgttaccaccagagtaaacaacttaaagctcaatttgcacatactcaggcaaagctaaatctaccacagattatttctctgatttctggctgtccagtttctttaaaatctatcgtcagactcatcctgattctcgaaatgtttatatatatcttttcaagggcttgttagaatctggaaaatacattagtgggacctccattttatatataatgaaacaggttgaattggaggttgtggaggttgaataattttatcaaagggcatatggctattaagtagagaaaggaggatttggtcagtctgactgattcccaaggtatatgtctgtgacctctataatgtaccatctctcctatgcagtttattcacatgatctctgggctcttttagaacgtttataatttggtttgagatatttgaattacacaatattgaattatttgtgtaattttcattttatcttattttaagcaagagcgtcgctattacttttgggatgtatctgtttctatagctttttctagtaataggtagtctgttgaaataagtgttctgctacttttttgacctttttaaatgatgttgaccaaaatatagtgtaagctccatcagtacactcattgttcctgctcatattcttttcttttactagctaagtggtacaatacacatttttcctggttacaaaacagccagaatgtagcagcagatggactatattttaaatggaaactagctggttggcatggtcctatatataaagagaaggcaattgtgatagtccagggtaccatgccatttcactcaggaattatggctttaaatagcaccttcatgtctaatggaattgactttccattagaaaatggaaatgacgttagtaccatttttgacatataccacacattttaatggtagtcctatgagaaccttacaatgtctattataatattttcattgagaaatcaaatgatacctctgtcttttcttgatgttataagcaaatataacagcaggttgtcagtgcttgatgattaaaatagctcattgaattactgttattgttcactggaaagagattacttttagctggagttgggggtgggtgtggtggaggggaatgtgttgagttgtgccctaaagaatgggtaagatttagattttttggaactcattccaactcataccattttgtgtgattttcattttgaaagtcattccaaaatgaatagacaaaaaagtgaaagctttttttttttttgggaattacagatatgtattttcttatgaggaaaactaccaccatgtagtacattatttattagtatacagaagcaatcacattttcctgtctttcttctaaggtttacaggccactctagtgtcatggaatcttcctagaggaagaaacatttaaactgaaaattaaagtaggcgttagtagggaaaagtttggggaagaacattttagcaagagggacatgtgaagcttttgaggcaggaaagagcttgactttttaggggacccagaggccagtgcatctaaacccagtaagtggaagagtcactcaaggtggttgaaggtgagattatataggactttaaaaatgatcactttggcaggtttagaagaatgctttggaagggagttttgtttggaatctaatgcagtcaaccagggaagagttatcataatgatagcatgaatgaagatttgacagagacaataattgaatagattcgagggttatttgggatatagaattagaagctgtgattggttaagatgtaggccttacatctgtagtgtagttatctggccctttaaaaatattttttcatacgtctcttattttgtagctctagcctgtagtcctatagcaactttcctttgcttagctttattcttccttgtggtacaactgtataataccttgattaaatacacatcagtgaccacccttcttttttgtctttagagcaacttctggtaattactaataaagtggtttttccaaaggtgtaatgcatctggtggctttaaaagttccctcttttcttatgtgtcaaaacaggggttaaaaaaagaaaaacaataaaaataaaaaagttccttctttttctccctaaaagtgaaatttgaaccaggtctgttttgcacattgttttttggtctatatcaaaaatagggtgatacaactcaattggctttaaggggtatgtatggggcctcatgaggttgttttgttttgtttttgcttttttgtttttaatttcaggttaaactgccaccataataccttcgaaaagtttattttttcttcaatgaatatagtttccattttattttatttatttatttttgaggcggagtcttgctctgttgcccaggctggagtgcagtggcatgatctcggctcactgcaagctctgcctcctcccaggttcacaccattctcctgcctcagcctcctgagtagctgggactacaggcacgtgccaccacgcccagctaatttttgtatttttagtagagacggggtttcaccatcttggccaggatggtctcgatctcttgaccttgtgatccacctgccttggcctcctgaagtgctgagattacaggcatgagcactgctcccggtccatagtttctattttattatttaaatgtttctatgtagaattttcaatcttttaggacatttcaaagacagttttcttcccttatttcatttgtatggcatctgaattcagaattcttattgaacaagagatctcagatgtcgtcaaaggtgctgcagattatctaggttttctttaaatattacaacttgacttttgaatcagatcaatgaatatttatgttatagttattttttatccagggagctttatgttttggaatataaatctattttttaaaatcaataatcttttaagagtttttaggctttctcttttagtgtttcaacattttactgttagattgttcttaaggcttctggggggcactttgtcttacgtaatttgtttccttttaatttttcttaaatatcttaccatagcacaacttaaaaagaaagctttttagatgaaaggcaagaactctattattttaataacagtcattgcaaatagtgcaaagatgaaagttcttgaattgtgccttgtgtgtgatcttagaaatttcttacatatgattatgctttaaaatatttactatctgtagttagcattcagttcaagtgaatatttctttttcatatggatagtttttgaaaaaatcaaagcaatacttaatgcgtttgaaaatcctagtagtagctctgttgaatatattactattttatgtcctacatttcattttgtaattatcttcctgaaattttcttaagtgcttggtgataaaacctaattatagtttaaggtaaacaaaaattacaagagagctcaaaacaaaggttgtttgcattttgagtgttctgtggtttgtattgtgatccttgattactaagtaacacagtaacagagttgaagccaggcctgttgagtacatcttgaaaactagtttcctagtatttttcctgccttaaaaaaaaagcagttcctatatttatggcctttctgtcttagtaaatcctgtgatcactgatatccatgatgccatactgtgagttgatagaaactcagcatatttcagagcaactgtgtatatggatggtagcttgattttagtagagagtggttttatttaattacactttttgtaaaattacactttttgtaattgcacttttgtaatgtgtaaatacattaaaaaccatgccatttagaaataatttttaatgtcattcctctttttgaactagttataattttttttttatatgtagacagttttcaaacccacagaaaaattggaggatgaacctgtataactttcacctgtattcaccagctgttaacatcttggcatgcccatatgttctctgacacatgtgtgcatgtacacacacacacacacacacacatatacacacttttattttgctaagttatatgaaagtaggctggagacatcatgatacttcacctttactttggcatgtatctctcaagaataaggatggccttctacatatccacagctccattttattttctaaaaacatcaacattaattaaaaaaaattatctgacatatggtccattttcaagttgtcctccaaatgtcgtgtatagtcagatttagttcagacatttccaggaagaacaccagtgaatttttgtaacctcccagtgtatcacgtaaggaggctcataatatcagcccatcctgataatgaccacttggtagaatgatgactgccgggtcttttcaggtagattttcccctttgcaactaatagtaatctttggtgggatactttgagaacatttgaatatcctgtttccccaaaagattttatcaatgcttttagcacccactaccgatccttgcttgaatgaattattacattagaagttacaatgatttatctttttttttttttttttttttttgagatggagtctcactctgtcgcccaggctggagtgcaatggcgtgatctcagctcacttgcaagctccgcctcccgggttcacaccgttctcctgcctcagcctcccgagtagctgggactagaggcgcccaccaccgcgcccggctaattttttgtattttcagtagagacggggtttcaatgtggtctcgatctcctgacccgcccgccttggcctcccaaagtgctgggattacaggcatgagccaccgcgcccggccgcaatgatttatcttaacttgtcattttttaaatgttaactagatgtctttctatcaggaatatctttcccatttcctcctttctctcctttttatgaggtattattatagatagaattttttttttttttttttgagacagagtctcactctgtcacccaggctggagtgcagtgatgtgatcactgctcactgcagcctcaacctcccaggctcaagggatcttcccaccctagcctcccaagtagctgagactacaggtgtaaaacaccaaacctggctaatttttaaattttttgtagacagtttttcactgtgttacccaggctggtcttgaactcctgggctcaagtgatcatcctgcctcggcctcctggagtgctggtattataggcatgagccagatagaaagattttttaaaattcaggctgggcgtggtggcttacgcctgtaatcctagcactttgggaggccaaggcaggcggatcacaaggtcaggagttcaagaccagcctggccaatatggtgtaacccgtctctactaaaaatacaaaaaaaaaaaaaaaattaccaggcgtggtggcacacacctgtattcccagttacttgggaggctgaggcagaagaatcgcttgaactcgggaggcggatgttgcagtgagctgagatcacgccactgctctccaacctgggtgacagagtgagatttcgtctcaaaaaaaaaaaaaattcaatggatagtaatccattactatcattccttttgatgctttcttattgaagtgaggtttaatgtacagaaatgtttatagattataagtgtacagtttgaggaattatcacaaagggtttacataggataattgtaaacattgtgtaaacattgctcagttcataaatggaaggtagacagtacatattcttttgtgtctggtttacatcactcagttttgttttttgtcaggttcatccatgttttgcatatagtcaaattgctgtgtttgactctaccattgttaatttattatcaaagaatatctgcgttgtttgtagttttttactagtatgaataaagctaccatgtatattcttctacatgtcttttgggatcagtagttgggtgtaggattgcctgtgagaaaggattttggcagtattaacttgtgatttctctacccagacaaggccacaggtgctgcttgagctgccagaatcctctctaaggctttcataaattattaagagcatatttggggattttatttgtggaaatgttaacatacactatttactatcacatagtaccacatctgtatgccacttattatcaaggcaaatccttgctcacttaatccaaaaagagaatactctttattctgtatgtcaactcacacataaatgtaaatggagtataatcatattcaaattcatcttatgaattgtggatttttttttttttttgagacagggtcttgttttgttgcccagtgtagagggcagtggcatgatctcttctcattgcaacctctgcctcctgggttcaaataattctcctgcctcagcctcctgagtagctggggttataggcatgcaccaccagtcccagctaatttttgtatttttagtagagacagggttttgccatgttggccaggctagtcccgaactcctgacctcaagtgatcctcccgcctcagcctctcaaagtgctgggattacagacctgagccaccagcacccgactgaattgtgaggttttacgaaacagatataacctttgtcatgatattagatctaaattttgtacctcatacaaccaaatgagaaattgtttaaccactcacatgtaaagatagttggaactgatgtattgtaaattatgagagacttgtaatcaactggttacatagatatctccaacacctctggcgactgagttttaaaaccatgtacaagttttcctgggtaagaaagaagcaggggaccaggtgtggtggctcatgtttgtaattctcagcactttgggaggtcaaggcaggaggcttgcttgaggccaggagtttgagaccagcctggccaacatagcaagaccccatccctaaaaaaaataaaactagtcaggtatggtggtacatacctgcagtctcagctacttgggaggctgattcaagaggattacgtgagtgcaggagttaaggatgcagtgagccatgattgtgccactaccctccagcctgggcatcagagtgagaccctatctctatttaaaaaagaaaaaagaaaagaaagaagcatagaaagcaaaagtagcagacaaagcaaaaataggtttctattcataccgttacatatgtttgctgagttttcttttttttttttccagtagtggccacagaagaagtagttactgcagaatctgtggatggtgccattcagcaagtagttagttcagggggtcagcaagtcatcacaatagttacagatggaattcagcttggaaatttgcactctattccaaccagtggaattggtcagcccatcattgtgaccatgccagatggacaacaaggttagtagtagacatttatataaagtttgtatgttttttttttttaatttttattttctttaagtcttccctgcagtccaaaaagattgtgtttatttttaattctcaggaaattgtggtatgtgttccaaagaatgtatttttgccttgagttatatttgtataaccctttgcaatagacttaattacctaattttatttgcttaggctaattaaaattcaaattagcttgctttctctgagtatatactggtggaaagagaaattggccccaaagtattctggttgaaaaatgagcttaaatgtcaacacaaataatatccaaaataaataattcaaatcagcattggacagtagtttcctagatcatttaatgcaattcaattaccatgtgagcttttaaaaataccatataagaaaaagctacttaaaaagaagttggagcctgggcaacatagtgagaccccatgtctaaaaaaaatattcaaaattagctaggcatggtgacatttgctgatagtcgcagctacttgggagcctggagtgggagaattgctagagcccaggaggttgaagctgcagtgagccattatcatgccactgcattccagcctgggcaacagagagaaactctttctcagaaaaagaaaaaaaaaaaggtggacttaggacttgtagtaggaatatggtagcacattttagcagctttattgtgaattctaacatttttctccttttggaaaccacaaaggctaacaagatgaaacaaaagtctcagctacattttcagtgaaactaaaaggctgagaaaaacctcagaattccacatttttaagtgccgccaaaagcatctgaagccattacagccagggcaagaggactctcatagaaatccacactggtgcatcaaggaaagaaaaggggttaagctcagcaataaacatgctctctcagaaggatagggccccagactcagtaggaagtgctgcatgcaggactgagatagaatagggcatgaatactgaggcagagagaagctgtagaaagtgcctaagtaagcattgccctgtaccttgtctccccctaaaagaagtgtccacacataatctttgagaaaatgactagggctagtagtatggtggctcatgcccataatcccagcactttggaatgctaaggtgggatgattgcttgaggccaggagttcaagaccagtcttagcaacacaatgatactcatctctacaaaaataaaaatgacgaaattagccaggtatgatagtgtgagcctgtagtcccagctacttggaaggctgaggcaggaagatcgcttggacccaggagtttgaggctgcagtgaactatgattgcaccattgcactccagtgtggatgacagagcgagaccctgtctccataaaaataaagaaagaaagaaaatgagtaggattgtagagcgtgtgcctttcatggccagtgaagggcagggcttgaggtagaacttcgcctaaaccaggtttggttttgagtgacagaggaggcatggcattgaacagagaccagatttcaagaaaggagtttgttgctgtagcagtaggagaggaaacccttgacctctgaagcctggaggccattctgtcccactctgctgaaatcttctgctgatagctggtctgaaatttggattagggtcagatgctttcacaaagcattaaagaactaattctaattttcagaaaagaagaaaactttaaaaatatttgtatcaagcagacataacattgtttccaaaacccgtatcattatacagactaatgatttctcacagctctgaaggctaaaagtgcgagatcaaggtgttgggcaggtttggtttcttctgaggctgctctccttggtttgcagatggccgtcttgtggcctgtcctcacatggtctacctcagtatttgtgttatctgtgtcctaatctcctcttcctgtaaggacaccagtagtactggattagggcctatctcattttaccttaattatctgtttaaggaccctatctccaaatagagtcacactttgaggtactgggggttaggacttcaacatgtgaatttggggagtgggagtgccattcagcccataacaaataccaagtttttttctgtaattagccaaatggcttctaaagtttatgttgatggggcagagggaagaagaataaggaaaactctggaaaagaataaccatgagaaagttctactgaatatttaaaaaaaacttctaaagccttcctgaattaaaaatatatagtttacatgtgaattatgtagactttacagacagtctaataaacagatttaaattctcattttttcctgaggtaatttatgtcatgaataaaaaagaagtaaaacccaaattctcaatatttctaatgttttaaattacattgtactaaataaatattagttttactatttttaaatttttatttacatttataactgtcactaagagagtttttcatgttttggcaaaaaattttaaaggccgtggaacaattataattttccccattgtgattattaaaatggcttcgcatggtttcagcttgcacagtcatttttatgttcctgtagtgctgtgcaaagcaaggacagcctctctatataattgcatttatataaagagctactaaaaattgagaaaaagcccaacagtacaatacaaaaacaagcaatgtttatgaactatcagtgctcataatggaatatgcacttagtggatattatgcagctaaataaacagaagctctctatgtagtgatgtaagatattataagtatttggagtgaaaaaagcagatgcagaacaatatatctattgtatagatgctaccttttatgtaagaaaggaaaatgagaatgtatactaatttttaaacaaattaatataaggataatacataataaattaataaaatgatcatctgttagcaggggtgggcatgaggcctctcaaaatatgctcgttaaatattttgatgttttgagtcatgaatgaatatattatctatataattaaaaaaatatttgtaggtactttaataagtagatttcagtaaaaaagcaagaaggtaataaaaaagacaaatatggatagtctcataaaaagcaaatcaatgatttggaattattgttttggaatgtagttattttagatgagtagcatcaacaatgtcaagactagttttatttctaataaatctctctgaaaatgaagtaatacataatttttttttcattttagtattaacagtaccagcaacagacattgctgaagaaactgttataagtgaagaaccaccagctaagagacaatgtatcgaaataattgaaaaccgggtggaatctgcagaaatagaagtaaggagtcttttacccggtgtgctttgccgcagtcatccaaaataaattcaattttttttgtcttttatatttattactgacagtattgttttgatacagaatgaaagtgcgtagtattttcattttgtttatttttgccttatacatatagcaagccctcaataaataaatattgaatgaatgaatgagtgagtgaagaatttgtttataacagtctgtcatcttgataacactggaatgtctttggttcttccacttcatcctttatgttttaaacttacacacaccattcttacacgtcactaaaggaaaataccagtatatattggctaaaattttttttttgttgttcaaaactgaaactcaaatgcctaattgggctaggggtcctcttaaaggaggttgatgtttgtcaaatgggttattttttaaaagcagtagataattgcttatttcaaggcaagtaaatgaatttagactagctgttcataggattcatcattttttcccctctcccaaagtaatttgtaagcgtaaaccagtttgtaggtgtaacaaaaccatagttgcttcacaggtttttttcttgactgactgtaaataaattttgttccatgaacttgataataagttatatcaaatgaaaacaaagttatacttgaataactttgaaagaacaactgcagccactgaacttgaaatcaaatgaactgagttggaatcccacctcttgctctgttagcattgaggcaaggaatcttatctttctgagtttcagttttattgtgtcccaaactggaatttagaataataataatgtctccattttcgggtttttgtgagaattgaaaaagtcagcatagtcatacaatatttatatctgatacgtgtttgtagtaaacttggtgaatatttagtaattttttgtaaaggttcttgttatagaaaggagatttttaaaataagtcactaaaagacaacataagtcaaactaaagacaatgagaaaatacccttcctaaattcatgtaaatataagactggtacatctttcaccacaccacaaatatattattgagtttaaaaaatctggttattggttaaaccggaatatttggtaaaattatgactttaaatattgatgttgggttgttttatttcttcaagatttaaagtgatgtgtaggatgttgaagttcttattcacaaactaacaatttttccattgaatagtatcagtatacttattatttaataatttttgttgtttttctgatatgtcagatgatctttttcagacacataaggtaaaaaaattgtcatgtacttcgctttaactatctaataaagtattattttaaaattacttgaatttttattaaatgtaagcttatttaattcaacagattatatttttaaacagtgaatgtgcagcctatacctttatttacctaatgaccagtaagcattgctgtttccctcaaagttcagcctgatttctttcttacagtcttttgagagaccagggaaaataattgcaaataacagggaagtatgaattgagaggtatataaagtaactagggccaaggagatggagctttagggagattcagttttagcttggtatgaagaacagtgatttttgtttgcttgctttgttttgattttagtaattagagctttctggtaatggaaatcttattctccatcactagaaatgttcaagccaaggttgcatgacctcttagggctatttcagagaaacctggaagcatacagtgagtatacaggtagtggtaggctggagatatagaatgaagagatgacctccaatgttttcaccaaaccaggtaataatttccttataatacatgaagtcgttattttgcatttattttcttaggtggccaatggggttatcttggggggagacttttatactcctaagggacagcttggccattaactttcaaagtttctctaaagcagcgtcaggagatatatttggttgtcatgactagtggcattccactgacatgtaatgggtagaggctgggtagacatcctacgatgcacaagacagcctcccacaataaagaactgtgtggcccaaaaatatcagtgatgctgagattgagaaacttaaagaaatttaaaaattaactctatacaaaatctaatgtttgagttttctccatgtatctgtgactgcaatgaccagagtgactgtccataaagaaagtgctaagagttggctgggtgcggtggcctacacctgtaatcccagcactttgggaggccaaggtgggtggatcacctgaggtcaggagttcgagaccagcctggccaacatggcaaaaccccatctctactaaaaaatacaaaaattagctgggtgtggtggcacgcacctgtagtcacagctactcaggaggttgaggcaggagagttgcttgaacccgggagatggaggttgcagtgagccgagattatgccattgcactccagcctgggtgacagagtgagacaaaagaaaaaaaaaaaacaataaggtgctaaaaatttatgtttacagtttcccaactaacaatggagaggtttgccaagagtctctggaaaaattactttaaattgtagaaagtgtattgtaaattttgtggggctttacatctgcatatggcaatataggaaataaaataggtttttttttttggagggaaaggtatgaataaaataccaaattgcaataatgtatataattttatcttccatttattaccgcattgaagatatttttggaggaagagtgttatttacagatttccaaaaataaacgttagactattctgaattgaaattaatctttgtacatgtgtaagaaatgtatttagtgtattaggagtaacagatttctattacttactttattgtgtgacttcaggaaatacctttatgttttctttgccatggaggttagagataaatgtttattagtaaattttattttatttttttagatagagtccctgttgctcaggctggaatgcagtgctgcgatctcagctcactgcaacctccgcctcctaggttcaagtgattctcctgcctcagtctcctaagtagctgggattacaggcatgcatcaccatgcctgggtaattcttgtatttttggtagagacggggttttaccgggttggccaggctgatctcgaactcctgacctcaggtgatccatccgcttcagccccccagagtgctgggattataggcatgagccactgcgcacggctgtaaattttatttttatgaaatatttgtgtccttaactggtggtagatttgagatccttagtgctctcttaaaaactgatttctgtaaactttataaaatgttttatttgatgcaaagcttttcaatcttttttttttatggctatctttcctgatctgccacaatttaaaaatgtttatagtcacatccgtctctgtttttttttttttttcttttttaaggcagggtctcactttgtcacccaggcagaagtgcagtggtgcaatcatggctcactgcaacctcaaactcctgggctcaagcaagcttcccacctcagcctcccaagcagctgggaccgctatacccggctaagtttatttttatttttattttcatagagagggtgtcttgctatgttgcccaggctggtcttggactcctggcctcaagtgatcctcccacctcagcctcctgaagagttgagattactggcataagtcaccatatccaggtcatatctcttctctctctttttttaaattagtgtttttatgtatgtatgtatgtttgtatttatttatttattttttgagacagggtctcactgtgttgcctaggctggagtgcagtggtgcaatcacagttcactgcagccttgacctccctgggctcaagcaatcctcccacctcacagcctcttgagtagctgggactacaggctacaccaccatgcccagccaatttttgtatttttttgtagagataaggttttgtggctgggcatggtaattcatgcctgtaatcccagcactttgggagactgaagtgggaggatcacttgaggtcaggattttgagatgaggttttgccctgttgcccaggctagtctctcactcctaggctcaagcaatccacctgccttggccttccaaaatactaggattacaggcatgagccactgcatgcccagcacccagtctatatctcttttttctaaggctggagaaggcaaagttttttttcataaatggccaggtaccaaatatttttggctttgtgggccctacagtctgtcaactactcaattctgccattgtagtgaaagcagccatagacaatttgaaaatgggtgggtgtggctgtatttcaataaaactttatttataaaaacaaaatcatacttgtcatatttggctcagggcagttagaaaattgatgtttacacacaagcaaatagctcacatatcctgcccagtttctctcttttaaaaaacatttaggccgggcgcagtggctcacgcctgtaatcctagcactttgggaggccaaggcgggcagatcacgaggtcaggagattgagaccatcctggctaacatggtgaaaccccgtctctactaaaaatacaaaaaattagctgagcatggtggcgtgcgcctatagtcccagctactcaggaggctgatgcaggagaattgcttgaatccgggaggtggaggttgcagtgagctgagataatgccactgcactccagcctgggcaacagagcaagactccgtctcaaaaagaaaaaaaaattatagtgttaattatactttcaatcttaaagattaaatgtattcagcatgcagtgctaatgatctttgtcttctaggttttatagaattagccaaaaaatgctgtgaaaatgagttttttatttcacctggtaggcagaaggaaactatcttttcatttttatcaagataaattgtacttcttgaagttaaaatatgcagtatggaaaataggattaggttcttttcactgttagactacctcactcggtttgctttcatcttctgcaataattgtgaatcctttcctgactctaaatgttaataaataggtaatactagaagatgctttagagttaacctcttccaatatttcctgctaaatcaaggtaaatttatacccatattcaaaactttggctaccaaaggattgctcttatttttcacataatgtaagtttttgtttgttttctcttttttcttttttttttcttttgagacaaggtcttgctctgtcacccaggctggagtgcggtggagttgctcactgcagcctcaacctcctgggctcaagtgatcctcctgcctcagcttcccaagtagctgggactacaggcgcataccaccatgcccatctaagttttgtattttttgtaggggttttgccatgttgcccaggcttgtctcaaattcctgggcttaagtgatctgcctgccttggcctctcaaagtgctggcattaaggtgtgagtcactgtgcccagccacacgtaaaattttaaaacacgtgcatggctgtggacactcctgccagagctgtggtctagctcctgggaagtaacatccaaccttccacccctcaccccttccattggtgtccttaaagtcctgcacagtttgtagccagggtactggcattgattgcttaccttggactcatcctaggttgtcttttctgacttgttcctatcttggctggatttaggataagaggaggggagaagaagtgttgggaggcagcaggatagggcctgggcattgcttaaactgggagtaagggacattcctttcttctacttgtacattttgtgtaattggaagatttggagatcttttgtctccaaatgaatcactcccacatctggtgggcccatgagaaaaagaaatgttggatctagcttcattcccattgtggggaaggaagtggaatcacagaaaggcaggaggattatacatgctcctgcttgtggaccaaccatatgaatagagaaggtgaggaatcctttggtgttcacaatgggcaggagtcaaggaggcagaggatatacataataggatatatagaaagagaatctcatactgtgcctccccagtggtcggccaaccacttacctttagttctctctggccaagtgtcttgtccactgtggacctatcattcttgtgatagtccgacccctggccttcaccccactcagaggtcctgggcatctgtgatgaggttgcctcattcctaagacctggaaactacccttgagctttggtctgtggaggttgagcttttgtccttgtgctcacttagaggtgtgggaatgggttcgttgaaatgtttctccttgtttttcctgcaataactgaatggggcagagtgaggaggaagaggagaaacaataccgttttcattggattggatttgtgtttcagctctcaatttgttgaggaatttaatgcatatattttatacctatataatttaatcattgataatttagtattttattggtttatgaaatagtataatttaggaaatactgatcttgatcagcactcttcattttaaaggtgaattatcttgcttgctattgtaaatgaaaatagttttaaaagcagtaatgttagaaccctataaatccaacttcttactatgtgaccttgggagagctacatcatccctgagcatcatttttctcatctttaacttgtgcataatatctgtcttagatgcttattgttggaaatcaccctgtttactcatatagtgggtgctcagtaaaattgttttataattattaccttttggtaagagcaccacaaatggaaatataaagaggtatggttgtatatttccctcttaaaaactcttcactagtttttgtagtacatataaaagtacaggtgcccagtttggagtctttctgttagtcttatttctaaataggaaaataatttccttgcagtcagaaattaatccatatctcataatgtggagcacaaaattagggacttaaatgttagtgaattgattgaaaaggcaagatgtctaggaaatttcaataggtggctgcttttagctactacggtttttttttttaatttgaaggatgcatgcttatatgtattaataatgtatttttgcaaaaattaaaaaaaaaaccctcttcttttaattaggagagagaagctcttcagaaacagctggatgaagcaaatcgagaagcacaaaaatatcgacagcagctcctaaagaaagaacaggaagcagaggcctacagacagaagttggaagctatgactcgtcttcagactaataaagaagctgtttaattgaaatgaacatgtagtttgattttacttttggtcaagaaagaatacaatcttgaactgtacacaacaaaggtacagccatgggaatacagaatgatagaagagactacagatggataattggacttaagccatgagctctgagttcttgtaacataaaactttactttagaagttgtgaaatgtatttaaaactgaattctgtaaatagtttttttttttttacagttccaaatgagttgataaagattgttgaagagatccaaaaccagaataagccactgtttttgtgaattctttttgattttagtacaaaccttaatttctcagaaacggaacagttttaagggtgatcgttgttggttaggccaaatgttgtgtaataattatggtggactgatgctggaattactcctgtaggtataaacctctgtatgaagagaagatttctcccaggaaatctttgtacagctttaagttgtgtcagattctctgaaaacattttttagaaagcaaaatttttatatttgttcaatttcagctatacccaagtagatttacatgtatatgaagcaaatatttttaaaaatttctgtttgtacatattctgcatgttttataatttcaaaatgcatcacttacataggtatttctcccacagaaatgatgaaagtgaccagaaaaaaacaaaaacaaaacccctttactctgtaggtcattgaaacgaagtaagctggcagctggttttattggaatgacagtgttctcggaaggagcagcctacaagataacttgaatttgccaattctgcaaaatctgtgcttttttgaaaatttaagagtggggacgtgaaactgtattctgtgccttccatcatgatttccacatgaaagcactttaaggcactgattttaagataatgtttttggaaaacccaatgcatatgggtttctgaaatattttatggacttatttctccccaggaaatgattcttacggaaaaaaattgcttttgtatgtagaacaggaactttttgtattacagtgatgcaatagacatgtctaatgtaacttctacttttccttttgaaagctcagtgtctgtgctatgacttgctctcatcacaatattgttgaattccacaatgtatggacattaaacactggcagactgttcactttttcttttttttttttggtaaaatattacttcaaacccctttttcttgctttatttttcagtgttttattgctttatgaactgtttaaccctgaaatccctctaggttatctatactgtataaaaaagcaattacccttaaaactgtactctggcctacttttctattttgcaattaaatatctttttcacat

SEQ ID NO: 36844 - DNA, 4667 bp, Homo sapiens
ggagctgcgggctgcgtggccgggatgagcgccagcacgggcggtggtggggacagcggcggcagcggcggcagtagcagcaggtagggctcggctggggcacccggagcccctggcgtctctcatgcccactgccactcaccccacccgcagctcacaggcctcctgcgggcccgagtcctcgggctccgaactagccctggccacaccggtgcctcagatgctgcagggccttctgggctccgacgacgaggaacaggaagaccccaaagactactgcaagggtgagacttggccttggggacatgcggcctcacggccactgcagggacccagggcagtcctgggcccacatgggccagatggtcaatggggccgaggtgttcgggggcccaggggagtgagaaccccctccaccccaatctacatctcccctgggcaggcggctaccaccctgtgaagatcggcgacgtgttcaatgggcggtaccacgtggtgcgcaaactgggctggggccacttctccaccgtctggctctgctgggacatccagtgagtgcctccttcgcctccggggcccagcactggctgggatcctgtccctgggcttgcttggggccaccctgatccccgccgtgggtcctgccagggccacagcctacaagggtctcggtattgcaggcgcaagcgctttgtggccctcaaagtggtgaagagtgcggggcattacacggagacagctgtggatgagatcaagctcctgaaatgtgtgaggcacctccctaccccactcccagctcccctggagctgcctggggcctggcaatgcgggtgcaaggcctgccggggctctgtggggcagggcggggctccctgaggggcagcctccagctggctgtgcccaagggggaggatctggaggaacaggcgagggacaggaggggttggcggcctttcttccagcagggcccagctggagcaggagaagggtacactgaagggagctgtgggcttcagggcagggtggaaccatctgtggccccttggcttttgctccaggtccgggacagcgaccccagtgaccccaaaagagagaccattgtccagctcattgatgacttcaggatctcaggagtcaatggagtccgtatcctttgcaggaagagcaaagcagtgtggcagccaagggccggcaaatgggggggccctcgctgctagagcctgtctgcagacccgcacaatgggcttgcatccctcccagtaacgggagcctctggcacgaccccgcccccaggtaactgtgtttacgtggaggcagtaacaagctagcgttgattgtccatggacgttgctattatccccaaacggcaggtgctgtctctgtggcactgccttccctttgggggactgccaagaggccctatggcataactagcatgggagtgggctggcccgagaggcctctgtgcctgctcctccagcgccacctctaggatgaccacaaaatgcaccatcccaactggcatacctgttgagactgacagggacactatcgatgatgacaccagcataatggtgaccaggactgcccaggggaggccctgcctccccacctccacacggcccaagccttgctgctcccctagctgagggtgggtggggcctgtgccgcagctggtgtccactggccgcccttcactcccagcccagatgtgtgcatggtgctggaggtgctgggccaccagctcctcaaatggatcatcaagtccaactaccagggcctgcccgtgccctgcgtgaagagcatcgtgaggcaggtgagtgccacccactgggctgcccagcctggcctgggcgggagttggaggaggtcaggtgcgactctctgcaggtgctgcacggcctggactacctccacaccaagtgcaagatcatccacacggacatcaagcccgagaacatcttgctgtgtgtgggggacgcttacatcaggcgcctggctgccgaggccacggagtggcaacaggcaggggcgccgcccccctcccgctccataggtaccaagggcccacatggggctgggtcggggcctctgggcctgaacccctgcctgagtctctgttcctccctgtccccccccaccgctccccacctgcactcccagtcagcactgccccccaggaggtcttggtaagttggggggcccctctctcccatgcctcctctcccatctgagccaactggaggccatctctggagccacagtggctccaccccccaccttcacgcactcccacggtggtaatcccgaaaggctgggtggctgggctgacggtaattcccggggggggtcaagtgccccaaactgctcttggtgaaaggatgctgtcttccccgaatggccacttccgcctgccttagcttgggctgagaggggacagagagcaccctgaggcgggccggccaggtcttcccactcctaatggagctgtggggagtggggccacaggcggggaggcagggagagtagtgagtagctggtgccaaggggcgctggcgccacattctggtgtccatgggagccctggggcccggagaggcctcttccctggcggctgtgcagggaaacctccacttcatgctgactggggcgggcgacaggaaccctggggtgaccctggctctgacagcagaccggtaagctgtccaaaaacaagaggaagaagatgaggcgcaaacggaaacagcagaagcggctgctggaggagcggctgcgggacctgcagaggctggaggccatggaggctgccacccaggctgagggtgaggggccacagagggtgatgggccgtggagcgcagcaaaggctgcaagacatctgctcagcagctgcctccaccccgtctccccagactctggcttgagactagacgggggcagcggctccacatcctcttcaggctgtcaccccgggggcgccagagcaggtccctccccagcctcttcctcccccgccccagggggcggccgtagcctcagcgcgggctcacagacctcaggcttctccggctccctcttctctcctgcctcctgctccatcctctccggctcgtccaatcagcgagagaccgggggcctcctgtcgcctagcagtaagttgggtggcaagtggtgggcaggcagggctggcagtagtcggaccacttcagtctccctgctctgccttccccagcaccattcggtgcctcgaacctcctggtgaaccccctggagccccaaaatgcagataagatcaagatcaagatcgcagacctgggcaacgcctgctgggtggtatgagcaagtgtgggagagcagagtggggggccctgctccaagggtggaggcacagggccgctcttggggagccctaccccagtctgcagtgcacgtgaaccgtcggctgggtgggcactggtcctgcccagtcaacagcactggggccatggccaagggcaggggccactaggaagggatcagcctcagcctcacatcactgggcctgtccctcttggaggacctggggaccccgaggctcacagcaaaccccactgagctcctcgggtaggcggatcggggtggggcaggagtccgtgggggcaggacagccttggccccagcccgtccccagggctccccttgcttccagcacaagcacttcacggaagacatccagactcggcagtaccgggccgtcgaggtgctgatcggcgccgaatacggccccccggcagacatctggagcacagcctgcatggtacgcccgcccgggctgccctgtgcccagggccagcagcccaccagccagcagcctcacctcctcccccttccaggccttcgagctggccactggtgactacctgttcgagccgcattctggagaagactacagtcgtgatgagggtaaggggtgagggctctgggctcagcctcccggcctcccggcctgcctgcccccaacctcctctttctgcccacagaccacatcgctcacatagtggagcttctgggggacatccccccagccttcgccctctcaggccgctattcccgggagttcttcaaccggagaggtgagggcccgggcagcctcaggccatgtggctgcagggagggtgggacggggaccttggattctgcaacagagggaacactgggtcccaggagccagggcctaagcagaaggcaggtccagagacagggacagagcctgacgcccgctggcctgcccgcaggagagctgcggcacatccacaatctcaagcactggggcctgtacgaggtactcatggaaaagtacgagtggcccctagagcaggccacacagttcagcgcctttctgctgcccatgatggagtacatccccgaaaagcgggccagtgccgctgactgcctccagcacccctggctcaacccctaggcccggctgtggctccacctccagctctccgtgccttaagggaaaagcgggacagctcccaccaccctgctgggcgccagttctccacaaccacagggcagagagacgctggagccaggcccggctctcagagcgtgttctgcctgagacccccgtgagggctctcggagaaagtgtgtgtattcctttcttaataaagtgtggactga

SEQ ID NO: 36845 - DNA, 24085 bp, Homo sapiens
agtgacagccagccgggcccggtggcggagaggaagtgcggtccgcgccaagcccgtccccgccgacgccggctcccccgcggctcgggtgacagcgtcgcggccgccggacgcagcgcggggcaggcgcgggcagagccgagcgcagcggaggctccggcggaggcgcggggaaaatggctgatgactttggcttcttctcgtcgtcggagagcggtgccccggaggcggcggaggaggacccggcggccgccttcctggcccagcaggagagcgagattgcaggcatagagaacgacgagggcttcggggcacctgccggcagccatgcggcccccgcgcagccgggccccacgagtgggggtgagtcagcgcggggcctggagaggggctcagggcgcgcacccgggggaccccggccggggcccaggggcacagggaagagagcctgctctaggccacccggggcaggagctgggagacgtggggaagaatcttcttggagatctccatgtaggacttccgagctggggatgaggcctcgcctggggctgtggatctggtgactcccgggacaggaattcggtcatgacatttcatccccaggccagcttccccactgcccggctctggaatccaaccccacctcagttttgagagtccctcctgagcctcctaatagcctgggtgtcccaggctcccagctaagtgtgcaggtgtgggcagaacacagccctcctggcccctcaggcttagctctctcctgcagctgggaaaaaagaggatcctgggtgctccaggaactcactaaccttccccggtgaccgcctggcattcggcagtcgctgggctaagcgccttggttacatttaatcacttcatacacgtgattgaacccatttcagagatggtaaaactgaggctcaagggagtatgctattgaaataactagtaagtggcagatcaagaatttaaacctgtttctttttcttttacatatatattttttcttttcctttttttgagatggggtctcgctatgttgcccagactggtcttgagctcctgggctcaagcaatcctcccacctctgcctcctaaagtgttgggattacaggtgtgagtcaccacacctggccgtgaatttaaacctgttcctgtcggacttgaagccctctccacctgaccacactgcctaccaagtgtctggctctgagttagacaccggagtgtgggccacaaagaggcatcagtcagatgcggtagggcccttcagggttttgtagttgtcgacttaatggttttccaaaggtggtccggggctattatgatttactgtgattggcttcagacctcagtgttcagggcctagtccctgtgaaatcatctttatcaatgatgtttctgccctggttctggctagcaagaatgattttgtaaaatatttagtaaaaaagtagatatcaccttcatgggtacatccaaaacaggttttacttcctgttgatgtcattttggaaaggtttatgggcctgttgtagtaagtgctaacatatatacatatagacatattttggttaatgatgtttacaaggctcttcacagtcatgtttgtatccattcaacgtttactgagcacctactgtgtgtcaggacgctggggatacagaaatgaataagacagttcctgtggctgaggagtttgaagcaactctgtatctccttgatatgagaaatgtaaccaggcttttgtaacatgcaagaaaccggtggcccagagaatctgagtatcttgcccagagtcacacagccaggaatgaccaatctaggacttgatcccacgcctcccaactctgggctccatgctctttcaaatgctgtggagcctgggcaacatggtgaaaccccatctctacaaaacatacaaaaattagccaggcatggtggcatgtagctgtagttgtagttccagctgctcgggaaggctgaggcaggagcatagcttgagcccgggaggtgtaggtaggtcgccgtgtgctgtgatcacgtctctgtactccagcctgggcagcagagtgagaccctgtctcaaaaaaaaaaaaaaaaagattctatagcagtcacctccctggcaggagataggatgtggggtgagaagcatggggtcttttgccacctatctgagacagcaatggagggcttctgaagtggaagcttccagcacctcaatacagaatctgccgtgtcccagggaattcctaagaaatgcctgccccagttaatgcaccagtattcactggaccacacctctgtgagaccacccttttcctcagtctggctcactggggcctgttggggtcggggtgcagggaagaggagggaggccttgtggggaggtcctgctgaggggagccattgtgagaacctcaggagagaaaagatgggattcaggctgagggcagccagatgcctgagggagctgagcaggttgtggcctctcccaggatggtggggctccagggacttacagtctggatggcaagttctgtccttggcaggggtggggcacaaattggcctcagaccagaggtgacagggagagaaacaatgacacgctcgcttcttccagggaggtgccggggatacagccttctgagggtctcccaggcgcatacctgctgactctgcaaaggctcagctgccctccttagttggatcggggagcagggaggtgttgagggatggcggctcagtggatggccagatgggctagaattgatctgaccttctcagcctatgcagtgctgaacaggtaatcttcccctgaccagggatgtgtgccaggagcctggatggggcagagaaaaagcgccctggcctgctgagagctgggcaaaagctggcttagcagcggccgccagtcagtacctctgaggcaccttctcttagatgttggggtcctcagattagcaatctctgtgctgacactgggctcagttgcccctggggaaagaggtatctggtgtaggcctgtgctggagccacagggagcccctcctctctggctggatctgtggccctgggtgatctggatgatggacactttgtttccattcatcagccttgggtaggtttccattttcacacccagttttctgagcaccaggcctggctctgacttgcctgtcagttctgggcaagcccatttcccccgctgggcctcgtaagctcacaggaatgttctggaccctctctgcccttgttccaaaatgggtcaggcagctgagggaagcaaaccctcaggggtttatccctgggacgtgtctctgtctcagtcctgttctgctggcctgtgagtgtggactcccggtggtagatgggcagtgggtgggtggagagcactgtgggaacaggtacttggaatgctgtgtaggtgtgtgtggactcttaaggaggccgaaactgcatgtccagaggaacactctcgaggctgaggcagagagactttctgaaggtcagggtagaccccaggcagctgtgtgtagatgtggggtctgagactggggttggtcagggcggagtagggtggtgcaaattctcgagaaggccaaatgtacagaccggcatcacagggaatagaccctggtaacgtgaggccctgctagaggagacaccccagcagaagaagcccctttgcagaagatgctgccactgaaatgctattggtcccactgtgatttaggggccaggacacccatgcaggagaagccttatctgaaggaatgggagtgacagctgacagagttggttggaatcaatcactggttgactctgaaagcaaagtcaattatgatttatgtcacccggggattatttccatgggattaagtacccttcccttgagtccccaggccaaacacactgtcgctgctcacagccctgtctggctggtgaagggctatttgtccatctgcctattaacctcatgtggcctccatggctttttgctaggaggcacagcagtttctgagagccttgcagataacagcaggcctcaaaacaacaattcaacttccatttagccaatagttactgctcacccattccgtgctggagccctgaggagctgaataggacacggagcctggtaagggggtacacacggaccctgggggtcatgagtaattgcacaagagggtgcaggatactgtatgatatcctgggataccccggaagtgagaccttccgtaagtgcctagggaagtaaaggaagcagaggagggcttcccagaggaggtgacttatgagctggaccttggagaataaatggagccaaaaaagcattctttttttttttttttttttgagatgagtctcactctgtcgcccaggctggagtgcagtggcgggatctcggctcactgcaagctccgcctcccgggttcacaccattctcctgcctcagcctcccgagtggctgggactacaggcgcctgccaccacgcctggctaattttttgtatttttagtagagacggggtttcaccgtgttagccaggatggtctcgatctcctgacttcgtgatctgcccacctcagcctcccaaagtgctgggattacaggcataagccaccacgcccggcccaaaaaagcattctttagagagggaagcaggaagaaagcatggggatgagggtggtgtgtttggagaaggaggaaaccagaatttagggtttgtgggatgggctggtgggaagtgagtcaggaatgggcagggccagattgtagagatcctcatgttccagggttagatgtacttatctggcaaatatttattgagtccttgttatgttccagggactgttgtaggtgggcctcatcatggatgaaaccaagtccacaccctcatggagggtctgtttgttgggggaagacagataataaacacatacacaaataaacacagcaggctgtagtaagtgcgcttaatactgcaggaggaataggaaggggtgcccaaggggtggatgggggtgtggtcagggaggcctttaattaggcagcatttgagcagaagctgaagggagtgagggagcagccttccaggcagagggaacagcacctgcaaagtccccaaggcaggagtaggcgctataggccactgtggtccatgggaagtggatttctttggagtttgttttcatgacattttgagtcagaggagaggcacaggtaagtgcatgttttacagactgtcagccctggcaattggtttgaaagagggatgggagaggctggagtcaagggggcctgtgaatgggcaaaagccatgcagtcgttgtctttctttcatgcatgtatttacttgtttattcaacaaataattattgagcacctgcaaagtcacaggtgcatgcaagtctctgggaaagacacaggagaagagaaagagacacagttatgtcttcccaggtgtttgcccctagcgggcaaagcagttgtgcaggtgcaaggtggtgaggtcctgggctggggctgagctgcgggagagagtggagggcaactgtgaatgtcagtgttgtagcagaagccccaggaatttgtgactaatcaaatgtcaaggaaagggacagggaggagtcactgctgagggcaaacttaattccttctgggaggggcacaaagagaaaaaatatgccaggtgcttctggtgggaactgcaactcctgctcacccaggaggagcagttgctcaaggcgcctcagggacaggcagagacgcgtaggcccctctcttccttatccagtgtagcccctgccctgagcttacagcagctcagcctactcaccaggcacaggcttcacaggtaatctggccattcccagccatggccaggggtcagtgatttcaggtaggtaaggagctattactggctgggtgattttgagcatggcctctctgagcctcagcttgagtatctgtaaaatgggttgacaacaatttcattgcagggctgtggtgaacataaaatgtactaatggctgtgagaggctttataaacagtcaggggtgggattgagcctaagttatatatatatccattatgtctgtttgcatgtgggtcgatatatacatgggtatacacagagtttgggttgaggggctaatgtaggaccatttcctgcttgctataagctaaacagtgagtaatgctatctccttgttctctttccagctggttctgaggacatggggaccacagtcaatggagatgtgtttcaggtaagcaaggctctgtctcagcagtggtaaggaccaacagccctggtctcagtaacctaaagcctcattgttgtaggcttacagctccaggttctcctgttcattatgtctgatgcattggggtggaaacatagagaaaggtttttggaattttttttgtcatgtagagggcagggaagaagaataaggaccactagagatcgagattgatgggcagtagcctcaggttgcccatggtgatgtctggttttgggagggagaggtcaagtggcccacagcagcatgagatgaaggcagcgcaaggccttccctcaccactgacgggaggcagaacccaggccatctccacacacagggcgggccctttgatccagagattccacttccagaattttcccaaaggaaataattggacaaggccacccagattctttgcagggttatttataatggcagacaatttggagacaacctaagtgtccagcatcagggaactgaatagatagattagaaaaccaggctgttgttaaaaagggcaatcagggccgggtgcagtggctgacgcctgtaatcccagcactttgggaggctgaggtgggtggatcacgtgaggtcagagttcaagaccagcctggccaacatagtgaaaccccgtctttactaaaaatacagaaaattagccagtcattgtggcaggtgcctgtaattccagctactcgggaggctaaggcaggagaatcacttgaacccagaaggtggaggttgcagtgagctgagattgtgccattgctctccagcctgggagatgagagtgaaactctgtctgaaaaaaaaaaaaaaaaaaaaaaaagggcaatcagatcttcctgtattgacgtgaaaagatgtccacaatatattaagtggaaaaagcagcttgcagaataatatacacagtatggtcctttttttttttttttttttcaattttaaaaatatgtttgggctgggcgtggtggctcatgcctgtaaccctagcactttgggaggccaaggcaggtggatcatgaggttggaagattgagaccatcctggctaacacggtgaaaccgcacctctactaaaaatacaaaattagctgggtgtggtggcacaagcctataatcctaactacttgggaggctgaggcaggagaatagcttgaatccgggagtgggaggttgcggtgagccgagatcacgccactgcactccagcctgggcaacaagagcaaaactctatctcaaaaaaataaaactaaaggtttgcactacatatctgaaaggatgtgtaccagctgttaacaatggttagccccaagggtggggtgggatggggataagaaaggggcattcactttcactgggttgtttacaaattctttaagtgtttttatcctgcaaaaaacgaggaaaacccagccgggcacggcggcttacgcctgtaatcccagattttgggaggccaaagtgagaagatcatgtgaatccaggagtttgagaccaaactgggcaacatagtaagaccccatttctgcaaaaaatgaaaaattagctggggcaatagtgtgtgcctatagtcccagctactcagtagtcttaggtgggaggattacagcttgagctggggaggtccaggctgcagtgactatgattacactactacacttagcctgggtgagtcttttttttttttttttcctgagatggagttttgctcttattgcccaggctggagtgcaatggcacgatctcggctccctgcagcctccgcctcctgagttcaagtgattctcctgcctcagcctcctgagtagctgggattacaggcacccgccaccacgcctagctaatcttttgtatttttagtagagatggtgtttcatcatgttggccaggctggtctcgaactcctgaccttcaagtgatccacccacctcggcctcccaaagtgctgggattacaggcacgagccaccgtgcccggcatgacagtcttaaaaaaaaaaaaaagaggaaaaccctagtaagtgtatttctagttaagactgcttctgtccgcacccacctaactctcttccccttgcatacacacaaatccattttagtactctgagggaactcagaccacagaggcatgcaatagtcctcacctcggccccccagccagatgcctggtggggctaaacctcccctcagagccttcattcccactcagactgggccaaagagccttgatcctggggtctttggctgtgggatcttctgagccccgccctggaggagctggcttcttgaatcctctgggggagtaaacaatacttattttcttatgtaagagggatgggctggtaccttatgcagggagactggccaagtcctgtttctggaaaattactcaactatcagcaagctggaaaagtccatctctaggacttcagcagcttcatgtctagttgggcccgagggagtcaaagaatgaggatttgcttctgtgcagcttggtagatcattaagacttaggctgcccaggctctctggccacattcagaaggactttgcttgaccccacagttctgtgtcctaaagtgcacctggagctggagatatgcttggaaccacagaagtatgtagaacatggccgggcacagtggctcacgcctgtaatcccagcagtgggaggctgaggtgggtagatcatttgaggtcaggagttcaagaccagcctggccaacatggagaaaccctgtctctactaaaaatacaaaaattggctaggcagggtagtggttgcctgtaatcccagctactcaggaggctgaggcaggagaactgcttgaacccagaggcagaggttgcagtgagctgagatcgcacactgcactccagcctggacgacagagcgagactttgtctcaaaaaagaaagtacctagaacactctgagctggatcatttacctttcctaaagattagcatcacgaagctcagagaggtgaagtggtgaatgcaaagtcacccaggaaatcagccacttctggagtgcaccccatttgacttggccccccgccttctccctcccgacctgtcagccgtgggtgagctgtgggtgaatctgaggagcccggggcctcctttccaatctgagtgagaactcttattctcactgttactaagaatcacagcaggtgtgtttatttgtaaatcatatcacatcagtgccatccgagaatccttacaggcagggcagggtcacagatgagctgaatcactcagaagcttagtggcaaagccccagcttgcctacatctcctgggctccgacccggtgtgctttgcattacgactctgttgctggaactggctggccacagcgcctgggtcacaggtggaaagccccagctctttaggattgagcatagcaggtctggcctgcacctgcagggggaggagaaaccttggcctgtgcacacccaacactttcaaggatcccagacagagcttttgtgcttcctttcttcctcttttctgcagcccgtgcaccaccagcgggtccagctacaaacccagttgccaatacagcctaaggacgagcctgcccacaactattccagttccatttggcacagccaggggcagggacagaagggccctgcaggactccgcctccccacctctgcacagatcctctctcctttcccctaatactcccatcatcctccttttagcttcttagaggaatcagcagctcagcttagcttagatttagctgatcaatcccaaagaaggatgtggctcatcctcttggccatccctggagtcgcagcacacgcttggctggtgtgggtccacagaggttctcatgggtgggcccagcagaggggcccctcaggagagggattctagggagctagactgagacaagcctggccctgactgtcgcctcctgccttctggtcctggccattcctgcccctttctctctccagagcttgggaggagtcagaacattgctctagccgctggtgatctctcctggttgccaaccctcctggccatgactgatctccccactgagatgctcaggtgattaaacgagagcccagttgtggcccgtgacactgtcactggcaagggtaggggtggggacaggggcaggaaaataagttctgagcagcccggaaataatgagtggtgactgcttctcggggctttgcctgccagcagcaccactgtgctctcctggtcatggtgcacggagggccagcaggtgtggggccctgccacaccggaacagcaggccacagcagccatgctgtccctcatacgcacacgccctctatgggctgcagagtgttaccatagcatctcgtaagcctcacttcccaccggtagtaggatattgtcactcatttaacaggtttgaaagccaagctgcccagggaagggacttctcaaaggtcgcgagtccagtgagtggcagaagggggatgtaaagcccagcccctctgatggagtgtccagcgctcgtcccgtgccctccacgcccctgtgtacccagctacttgtttattcatttggtttatacgtttggtcgttcattcatttggtcagtgcacattcttttatggccacacacctgctagggcagtgaataaacggatatggaggcaaatccactggatagtttgtctccaaagagctctcttttttttctttttctttttctttttctttttttttttttttttttgagagacagggtcttgctctgtagttgagactggagtgcagtggtgtgatcatggctcactgcagccttgagtcttgggcttaagtgatcctcctgcctcagcctcctgaatagctgggactacagggagggccaccatgcctggctaattttttaatttttttatggagatgtggtctcgctatattggccaggctggtctcgagctcctgggctcaagcagtcctcctgctcagcctcccaaagtgctgggattacaggtgtgagccgctgcacctggtcccaaactcgcttctaatagaagacagggaaagaagtgaaagaagtgaatgggagcccaggaaggtgagggcttggctttggggaagcattaggagctaacagattgagttcttctctgtgtaggcaccagccaagggctttacgtgcttgatctccctgagtcctcccaactccctgtgatgttggttgtcattattcctgttttatacaggaggtttaacagctcgctcgagttgtgtagctagtaagaggtaaaacttgaatccaggatcaggcgccagagcctgcactaaagttagggaatgcaactgtgaggggacactggcagggggttctgaggctgcccagggggatgtgggtggccttggccaaggccaagggaagagcatgtgcaaagccacagagggtcggtcactcattccggggttcaccggagcccgggacctgctgcacaaagggacgtgccaggagaggccaaaggtttcgggtgagccctgcatagcccccactagagtgcatcagtgggccttgcagctggtggcaggtggcggagatgtgggcccagtttggccaggcttggcaccttgggactggggcaggacaccgtgggggctgagtttccttaaggctgttcccacacccagactgcaggctgcagcggaggtttagatggagtcagaagacctggacttcactttctgctttttcccagctggctggctgtgggctagtcacttaactactctgagcctggcttctcatttgtaaaatgcgaattagaggctccgctccgctgccccaaagggctgtggaaaaaagtgctctgcagccccggacgcttctcacaaactcctgacccagcccctaggcgagctgagggtggtgtgtgggggtgcgtcccagaggaaggcgggccatgagacctgggggcaaccggagctggggacccagtctctagtcttgtcttgagaggaagacaagcaggcacacaaactatgcgtcacagaagtgactttgggccctattagctactatgtggcgagtcacacccagcaattcagtttgaatcctggttctgccacttcctggctgggtgaccttggctctttggagatagagtttacctacctgtgaaacaaaaagaataaaacttggctgggtgtggtggctcatgcctgtaatcccagcactttgggaggctgaggcaggcagaggaggccaggagtttgagaccagcctggacaacatgatgaaaccctgtctctactaaaaataaaacattagtcgggtgtggtggtgcccacctgtaatcccagctacctgtgaggctgagacaggagaatctctcaaacccggaaaggcggaggtttcagcgagcagagatcacgccactgtactccagcctggacaacagagcgagactctgtctcaaaacaaacacacacacacaaaaacaggccgggcaccgtggctcacgcctgtaatcccagcactttgggaggctgaggtgggtggatcacaaggtcaggagttcaagaccagcctggacaagatggtgaagccctgtctctactaaaaatacaaaaattaaccaggcgtggtcgtgggcgcctgtaatctcagcaactggggaggctgaggaggagaattgcttgaacccgggaggcggaggttgcagtgggccgagatcacgtcactgcactccagcctgggtgacagagcgagactccatctcaaaaaagaaaaaaaacaaaacaaaaaaacaccaaaaaacaaaaaaccaaccatgtagggttgcgaagattaaagaaagccctttaaatgcaagttctctggagtcttaatttagggcaggcttggccaggcgcagtagctcacgcctgtaatcccagcactttgggaggccgaggtgggtggatcacctgagatcaggagttcgacacaagtctggccaacatggcaaaaccccgtctctactaaaaataaaaaaagtagccaggtgtggtggcagatgcctgtaatcccacctacttgggaggcagaggcaggagaatcgcttgaacccaggaggccaaggttgcagtgagccgagatcctgacactgcactccagcctgggcgacagagcgagactccgcctcaaaaaaaaaaaaaaaaaattagggcaggctttatggagatggcgggccctgaaggatacagatgaaaagagactcctgttcagggcccctcaccactcctctcctcccacatctggcagcatctgtgtatccatttcccaaaggctccaggcccacgtgattcttacacgtgctggctcttggcctgaaatgcccttccccatctctcctactgtactctgtccccaggcgagaatggtgccctcccttccccactctctttatctgaactgtgttccagcaaggttcacgtttccccagccatggttctcatttgtgagggactccctgtcccaacttcctggaaggtgtcttgctcgtccctgtccccaagcctgaacatctatgaattcattcagtattcttgaaaggttcctgcagccaggccctcccggtgctgggtgctgtatggaaacaggcagcctctgccctcatggcagggagggaagggggaggacacagaaaataaacaggtaaacaagccaaggcctcaatcaggaggcaggggaagccctaggaagctgtagaccctcgattctaggggaagaatgttccagacagagtctctgaggggatacaagatgagcttgcatgaaggccagtgtggcaagagtgcacgaatagaggacagaaatcagaggcccagggagagaccagatcacttgaattttgttctagccataatagggagccttcagatgttttattttatttttatttatttattttttgagacagagtctcgctctgttacctaggctggagtacagtggcacgatctcggctcactgcaacctccatctcccgggttcaattctcctgcctcagcctcctgagtagctgggattacaggcgtccgccaccacacctggctaatttttgtattttagtagagatggggttttaccacgttgcccagggtggtctcgaactcctgagctcaggcaatctgcctgcctcagcctcccaaagtgctaggattataggcgcgagccaccgtgcccggctgcctttggatattttaaagtgtgacatgataaatcggatttagactccgaataggtcattcgggcattttgtggagatggggctgcaggaagcagagaccagcagtggtccaggccaggggcggtgagggcaggagggagagttttagagattgtgatgacaggccctgctgatgacttgcacgggggatgggaaggaaggagaaatcaaggacgaacaggaggctggggcctcagcaccctcgggaaattgttcagtgtcgctgttttcattttaacatctggaacaaaaatccaagaaagcaaaggaggttttgtgaaaatgctgtgcaacacaaggcgagcgagtgagtgacgattgcaggaggcagcccccactgccctttctgatagacctaaaggctgaggtctcgatgccatgtggatgtcaccctaaagacagtgctcagatatgaccctctcttcccttcctcctcccctacaagggcactgtggtgcctttttctcagacggagggtggggcaagtttggggaatgaaaagtgaagtgacgttcaggattcctgtcaaaacacccacatgggctggcacagagaaagggctcagtacatgtttgctcaaggagtggggattgggtggtggtcagatggatgccttcattgtatttttatttttatttccaacttctctgacctctcaagtcatttcagatagaggtaagtgctgggaagaaaataaaatagggcacctggataaacccatatacacaaagtaacagtgcagttgtctgcagatggaaggctcggtaggtttgggcagcggtgctgggaggagtccctggtatcctggcctcagagaagcattgttcccagaaaggagcagcagtgaacttgtgttctccggagaagggccccagaagggcccactgggatgttgggagagagtctctgaattgcaatgcagtgttgtgctggagaggagtaagggtggcgcccagctgccccgatgatcccaggagccaggctgcacccctgtcctggcctgccctggcctgcccttccctcactccccaggcagctggagactgtagccctgatgttccatctatgtgttccctctcccagagctcctccttgaaccgggtgcctgctggctccaggggtctttgctcattcagccactgcttactgagcacctgccaggcactaaggataggtgggcgccgtaggacagagagtgtgccagacactcctgtgtggagaagatgtcaaacaacgcgggcagtcatggaagttttgataagtgcttgaaggaggagggaggggagactattgctgggaggggagacagaagcgccaggagacaaaggccgggtagctggagtgggatgcctgcagacaggaatgcggagggcgtgggtgccagagcgggtgtggctggacctggattggaaaggctttgccagaccagagggtgccacacccttgtgagcagagctcacggtgctcagcgctttgggtccccagctctggcaaggggtggggagacgtgagcagagcccctgcctgggagtcagggacctggactctagtcctggctctgccactacgttgtgccatgtctctgggcctcagtttcctcccttgtaaaatgggaatgaataataatagtagtaattctagctactattcactgagccatcactccacaccaagcactcttctaaatatctcacaaatattatagtattaaatcataacagctcttagaggtgttcttaatattattcctttttttctttctttctttctttctttttttttttgagatagagtctcacttttattgcccaggctggagtgcaatggtgtgatcttggctcactgcagcctcccctgccccgccccggattcaagtgattcttgtgcctcagcctcccgagtaggtgggattacaggtgcgggccaccacacccagctaattttgtgtttttagtagagatggggtttcaccatgttggtcaggctggtctcgaactcctgacctcatgtgatgcacccaccttggcctcccaaagtgctgggattacaggtgtgagtcactgtgcccggtctattcccatttttctttcttttttttttttttgagaccaagtctcactctgtggcccaggctggagtgcagtggcacgatctctgctcactgcaatcttcgcctcccaggctcaagcgattctcccaagtcccagactcctaagcagccattacacctggctaattttttgtatttttagtagagacggggtttcgccatgttggccaggctggtctcaaactcctggcctcaagtgatctgcccgcttcggcctcccaaagtgctggaattacaggcgtgagccaccgtgcctggcctttttttccataattaaaaaaacttttttgaaaatagtgacagactcttgctgtgttgcccaggctggtcttaaactcctggcctcaagtgatcctcctgccttggcctcccgaagtgctgggattataggcatgagctaccatgcccagccccatttttcaaatgagaaaacaaaagtcaggcaaggttaagcaatttctcccaggccttacaaacatttcatagtatcagaggtggcatctgaaccgagacagcctggctgcagagtccaagttctttcccatggtgtgatctgagctatgatcatgctgcatatctcagggatgcttctctactcaacaaacatctactgagcatctgctgggccaggcactgtgctgggctctggggacatagcagtgaaaaggacagagatgacattctgatggcagagacagacaaacacattataaagtaaggtccttttgggctggtcacggtggctcaagcctgtaatcccagcacttggggaggccgaggccggtggatcacctgaggtcgggagttcgagatcagcctgaccaacatggagaaaccccgtctctactaaaactacaaaaaattagccgggtgtcgtgacgtgtgcctgtaatcccagctactcaggaggctgaggtaggaaaatcgcttgaacctgggaggcagaggttgcagtgaaccaacattgcaccattgcactccagcctgggaaacagagggacactccatctcaaaaaaaaagtgaggtcttgaggtctttttggactaagtgttaggagttaatacaaccacaatagagagtgattttaatgacggtaacacaagggactcactgtgccaagcagtatttttattttttatttttatttgtttattttttgagacggggttttgctcttgttgcccaggctggagtgcaatggtgtgatctcggctcactgcaacctctgcctcccgggttcaagtgattctcctgcctcagcctccggagtagctgggattacaggcatgcaccaccacgcctggctaattttttgtatttttagtagagtcgggatttctccatgttggtcaggctggtcttgaactcccaacctcaggtgatttgccgcctcggcctcccaaagtgttgggattacaggtgtgagccactgcgcccgacattctttataatttttaactcatttcatccttatgtcctcccatcagagtgcatactgttatttagcccattttatgacaaagaaagtggctggcacacgctttcttgagtcttctgctttgggggtatcaaaacctataactgggccagaggcaatgatcaggcacagagagggtgagtaacttgcccgcagtcacacaggtggcggagtgttgctggcagagggaacagcaagtgcaaagataggtgtagtcaccagagacagtgggtatgaggttgtttgaggctgagttatccagacatgagtgggtccccagcaggggcagcagagacagcggggcaggtgtgctggctggatagactgctgcgtgtttgtgttctaggaggccaacggtcctgctgatggctacgcagccattgcccaggctgacaggctgacccaggagcctgagagcatccgcaagtggcgagaggagcagaggaaacggctgcaagagctgggtgagggcggggctgaggcggggttggctgggtgggctgtgtgtggggtggagtgtggggagtcctcggagtgcatgggatgctgcatgccttaatgtgggactgggccggtgcggccctgtggctgcctggcaggggccaggggaggagcgcggccgggcctgtgcatcccagctggaaagcagccactcattctcttgtggggtcctagatgctgcatctaaggtcacggaacaggaatggcgggagaaggccaagaaggacctggaggagtggaaccagcgccagagtgaacaagtagagaagaacaagatcaacaaccggtgagagggctgtagggacatgagggggccatggggacatgaggggggctgtggggacatgagggggccgtggggacatgagggggccatggggacatgaaggggtggggacatgagggagctgtggggacatgagggggccgtggggacatgagacgggctgtggggacatgagggagctgtggggacatgagaggggctgtggggacatgagagggagctgtggggacatgagagggagctgtggggacatgagaggggctgtggggacatgagaggggctatggggacatgagaggggctgtggggacatgactgaacactgcccagtgctccctgcctttgaggctctgtccttcacggtacaaggtcttccaggaagggaaaggcctgttctgggaagctacccttctgtctagggaactgctgcatgccaggctctggggtaggcacggaggagatggagataaggaggacccagccttatgtcctcaaagggcgcagaggagaaaaacacacatgttcaactaagctcaaatacagtagggccctctgcacgaaggccatggaagcaaggaaacaggtcagggagagacctctgtgtcttgggacttgggctttggaagatgactaggaggaaaaaagggaaaaaagggcaggaggtaggggggcattctagacctgggtacgaagaaaaaaatgtgatgtattaggcaacagggggccagggagcggtgggagagaaggcaggaacctgtggactcacactgtaagggccttggctgatgagttgggcagtgacatgggcagtggggagccactgaaggtgtttgaacaggagtaacatgatcagggatgaattttagagaaggtgctggggccagggtgaaggtccccattctcctgtttggggctgtgggtcgttgctgagccttccagaactatgcttcctaacatttctcccactggaggtactaatgctgtctctctctctctctctaaccttctgcctgcctgtctgtcttgccatctgccttcccccacctaaccccttccctcaacctttccctcaaggatcgctgacaaagcattctaccagcagccagatgctgatatcatcggctacgtgtacgtgtctgttttgcttctctgttgggggagctagagagggaatggccaccacagtttcttgagtttcctgcttgtgggatataaatgagtgtggctgggctcggagcaatggtcagaacaggaggcaaatgccctggtgggtgcaggcagcaaccacctccctccctccagtgaagtggaggctgcttggctaaatcagagccttgcaggataaaggcagagaaaggaatgtgcttgccacttattcccatgtgggaggggcaaatggcagagcaccccaactccctccctctgtgatgtctcttggtgggtgtgtggggtgaagggttttttgttttttgagatggagtttcgctcttgctgctcaggatggagtgcagtgctgcgatctcggctcactgcgacctccacctcctgggttcaagcgattctcctgcctcagcctcccgagtagctgagattataggcacatgcaaccgtgcccggctaacttttgtatttttagtagagacggggtttcaccatgtcggccaggctggtctcgaactcctgacctcaggtgatccacccacctcggcctcccaaagtgctgggattacaggcatgagccaccacacccagctgaaggggtcttttattcaacaaaacagacactgagcatgggatgctggaggcatgtaaaggacaagagctgctcctttgtgacatccatctcttcctcctgccccagtgcactgactttggccatcagcccctgcccagaccaccacaggccccctcacatgtttcaggtttggggtctacttggtgtgatgagtaatcaagaccagggttggcaaacaggttatatctcgtgccgacgtcagttagttggtagagacatcctggagggtggtggtggggattgtggagctgaagagaaggtacttgctgttcttcactctaggtgtgccctggcagcccgtcatgtgtcgaggctaagcctcctctcacagggcacagagcacaccagagccttcgtctgcttccttccactctccctcatttagtactctttggcactcgccttgtgccagattggtaagacacccacaggccgcccccctcaccgtgctcatggtctggagtgtgttatgataagggccttgtggaaggacacagtgagctctggaagccactctctgcctggggagcctgggcaggcttcagagatgcaagaccttcagctgaccttaaagtgtgagaaggagtttgctggatagggagggtgggaagagaaggtgggaggagcagctggggccaaggcatccagagagaaaaggcccagctggctgcagtggctgaagctctacaggctgggatggtggggatggtggggatggtggggatgggtgggagctgaggctgggaggtggttggcttggggctggttgcaaagcgcctgttgtgccaaggctgagctcagacttgatccagaaggcagtggggagccacaggaggcttccagcaagggatggggatgtcagatgggcatgggtgctgtggaataccacagggggctcgatgcttctgttgagcctgaggaaatggcccagagagcacccaggagagccctgaagagagagtatagaccagggcttctcaaacttttttttttttttaagacggagtcttgctctgtcacccaggctggagtgcagtggcatgatctcagctcactgcaacctccgcctcctgggctcaagcaattcttctgcctcggcctcctgagtagctgggactacaggtgcccgccaccatgcccggctaattttgtgtattttttagtagagacggggtttcaccgtgttagccaggatgctctccatctgacctcgtgatccgcccaccttggcctcccaaagtgctgggattacaggcatgagccaccgcgcctggccacacccagctaattttttgtatttttagtagagatggggtttcaccatgttggccaggcaggtctcgaactcctgacctcaagtgatccacccgcctctgcctcccaaagtgctgggattacaggagtgagccactgcgcccaggctcaaactttcacatgcctatgaattaccagggggtctcgtgaaaaccctgattctgattcagcaggacggtggggaggcccaagggtctgcatttctgacaggctctgtcgtcatgctgatgccattggaccatggacgctttgagctgcaaggacagaggggagcctctggaccctgaagggacagctccgaggatagctcccctcatccccacttgccacccagctccacgcagcactttccttttttccagacctgcttgctacctcattgaattctcagtccagtgaaatagttggtagggcagagctatgatcctcattttacaggctaggaaatgagcatacagccagcatccctagagaggggccaggtcacctgatccggggtcagctcttccatggagcgctcctgccatcagtcatgtctggcatcggcagaactggtcctgcttgagatggagagggggcttccagggacttgtgagcgaccctcgctggccaaacaggacatagacccagctctcctcacctaagaatcccttattgtctttctgttagtgagtcccacgtgtagattttgtccactagactgtatttacttgtttccccactgtcccttagtcagtggcttctgtgactgtcaaccagaacttctgatgaaggaccgccagttttcatcctaacttgattccaaccaaaagcagactccagtggagcattcatgccccaggctgtggctcctcagagacagtggtggttctgggctacaaagggctctgtggtgaaagacgcttgggatgtggtggattccatcacatacacaccttggagggtcacgacgcacacagcacatgaaaggctttgaaagtcttgctgtaaagatcctctttagctgggttttccataggtatttgaccacagtctttctggagaatcctcacacagaacattcaggcaatgctgaactaggtgcttctgttagatggttagtcagtgtcctacttctgccaagtttttggaaatggtgaaatagctaaggtcctgcattaggtcgtcctaggacctccaagggtctttaggtgtcaggaacctcaggttgggaactcccgatggggaagtaatgaacagagggtgcctaggctgggaagactttctgaggaggtgaggcccgcactgagacctgaatgacaagaagcagcaagccaggaacaggtctgggagaagcgtgttccaggaagaggtgatagcaagtgccaaggtcctgaggcaggaccaagctaggcttcctcctgcgccaaggctgccctcctctgaagtcaggggggcacaaggctggggaggacacagtgccccagagtaggctgggcaaagcagccttgctcaagggcaaggctgggggaaagcagactgctataaaagcccgtcctatctccacccgcagggcatccgaggaggctttcgtgaaggaatccaaggaggagaccccaggcacagagtgggagaaggtggcccagctatgtgacttcaaccccaagagcagcaagcagtgcaaagatgtgtcccgcctgcgctcggtgctcatgtccctgaagcagacgccactgtcccgctaggtgcctgctaggtgcatggccacagagcatgggctgggcctgggcacaggaggagcagctgctttggtcggggtggagactcgcagcagctgctacccacagcctattccactcctccccatctccaggcgctgggaggggggccctcaccccatcacgcctcgctccctcctggccctctggtccagcccctcacgcctcctctcagtctactcaattgtgactgtccctcctgatgtattttttttcttggcttaaagggtgtgttgttgactctttttacacttatttattatcattctcacttctctggaagcca

SEQ ID NO: 36846 - DNA, 28350 bp, Homo sapiens
gtcgccgcggtgctgctgctcagtgggagcgggtcttcgcaactgtctccgcgtggcgcgcgcctctagccgcccttcccctggcggctacggccggagggagcggaggcgagcgggagtcgggctccatggagagcggcggacaactgggcagaggcggagctttcatctcggcaccctggttccagtgacccgcgctagcgtcccgtcccgcccgcgtcggagcggccgccggccccgggactgaccggcctcgccgcacctcccgcaccgactagcgctcccgggcgctcctgcgcccgactcgccctcgcccccactccccggcggggtggcggcggccgggcccccacggcggcggccggagcagcagcagcagcagcaggagcccgcctctatgatgaagttcaagcccaaccagacgcggacctacgaccgcgagggcttcaagaagcgggcggcgtgcctgtgcttccggagcgagcaggaggacgaggtagggcgcccggcgccgcacgctgccctccggggcgccggggtctagggcccgggtgcttcccctcgctccccgcccctgcgcaggctgcggggctgggagggattagcccccttcctccctccctcctttcctccctcactcctttcctccctcacttcttccttcctttctctgggctgatagatgagacaaagggggctcgcccagccccagtttctccatctgggcactcgagaaggcgcctggtccccgggaaggtcccgggccgcgtaagtctcgcctagcgggagtcaccatcttaacgtgcgaattgagttgaaagccggataaacctcgagtgctcagcgagaggagggtggaaatggcgtgagtgttgcagcagagcccttgtgcctcttttacatattttccttccatgttacagccgtttgcggtctcggattcgatctaagcatgtttgtggagtaacagacagtcctcgtgcttggaattgagtctagtcttggcaattcttgtgggtccatgaacccgcaagctgttggcataattatgcctcatttttaaaacggccttcccttcttaaagttttctgactgcagaaaaatggttagtgaaaaatgtggaataatgccaaaagggagacgatggactagagatgggcaaagctgccattttcagacagtaatctccagctctcagcttatgtataaagggttctttgctgtctggcttgacatctggaaaggagtagcctttctcgttctcagagcagtcgttcttggataatttacccatctgcattgggctgagaatgagacccttggggtttccctggagagcgatttttacttaattcagtagtatttatttaaaatggctaactgttgaagtttgcttagggcaatagtagccttttggtattgccactcttaagataaattacataggtgaaaaaaattaacattctgagttctgctttcataaccaaccgtgtataaaatactaggctaaggctggagatgggaatttaatggcttccttactgctagtccctgtagttgtgatgaatatgacacagaatacactcagtggcttagttcttgttatgttaacgaaaagttctcgaaatttgcccttcaaacccttgttttgcctttatttttttttgaaaagaaaccaagccctttaaatgggttgctctgtgctcactcataacctttacgtattagacttgaatcccaaacgagtgtgcagagaaatacggccccagcctttgagatgggtctgcttaggagagctagaaactgcaaagggaaaggttattaacttttacaaaatgaacaagtcaacaagcattaagtgtgttctgtaaaaaagataaagccttagcggaaaggggccatgttgaggcaaagtagtaaactttaaatataaaagaaatgatagccaaaagggatcaagatagatcaaggatcttgtctggtttcctcaatattgtgtaatgatattcttaattgagtgcttacaatgtgccaggcgctgccagaagaaaacttgttatacatttaatccttttaacactgggaggtagtgaagttactcccattttataggtgaggagacagttgcagagcataagtaccttcccaaatgacacaattaggaagtggtagagtcaggattcagggtccagtccttactcctgatgttgggctctgtttgttgagtgagtgagatttttgtgaggctaagtttggaagcctatctgaaagtggtgactgaagtgttgccataatgtgaacttggaattcaggctttgtaaaaatactagactctaggggaaaatatgagtgatggaaattgaaatgatgatctctattgtgcttatggtaaagcaaagactgatagaagctttaggaattactttagcaataaaaataaatgattatttttatgcttggatattatttctactgaaataaatactaaattcatagcctctagttgagtcaagagacccgtgtcattaggtaaggtgaagtagggagcaagttttggagaatgtattagaaaaatccattgtataaaactttgtaaatctgataacctgtaggttgagaattgaagagagtgagtcatcttgttagaggatatgatctgagggaagactctagaattctccttaagtgaaatgcacagccaattttaacatctggtttagctcttcagaattttcatttctgtgattgtgtgtagttgaggctttatctattacatgattattacagaataaactctgttagctttcctggagattctattgtttctctatgaatttgccttcactctgttgaaattgcattgccagacttcccaggacagtctagaaaaccagcttgagcccacctctctagttaataggtgagaaatgtttccctctactggatgaaaaacacctagatcctggttagaagatttaaatgtatgttttgtttgaggatgaaatgtttatatagagtacaaatggaagtaaaagagtaattgcaatttgaccccaaaaaagctacgtggcgctcccatctggctgttcctgtactgaagttctcagtaagtttctactttaaaacagattgttctaggaaagaaggttgttctaagagcagagttattcttttaaggtggctttatatattaaatattttccattttatctttttctgttctgtagggtaaataagtattagtatttgtttaggaagaaattaggtagcagaagtaacctatcccaaggtcacagaagctggcagatccttttgagctctggtcctttgtttctaaatgttttgtttatttgacctacctccccagctagttatttctgtggggaagcaccctcagttttggccgctgggcttctagacaggcccacagctaattgccctgtagagtagctgggtactgtgcttgtacagtgaaagatgacaatgcttttacaaataggtaatcagaaatggattctgttgaatgtatttgcatatatgatagtttaaaaggggatgaagagatgaggtcttagctcctaagaatcattctgtagggaaaggttggacaagggatcaatggaaagggaaataaagtaagggaaaagtgcggtcgggtattctggggttcagatccaatgtgagtcatttggagttggatgtgggtgactgggagaggagggaccaggcgtcccaaatagagcaagacttggggctgtgatagatttggctgcagcttagggatagcatagaatcagtaatagttgaaaaatttgcaacacttcaaatgtaaggttgagaagttgctacgcaagaacaaagttttgttttgaacttagttttgaacaaagaacattgagatagtagatgtgttcaagcttgagagtgatctggcagcaaaataggtttagactgctaaggggagaagtagaatgacttgatcctgtgtgaaatccagacatagttgcaagagaggcattaacaaatcagtctgaaggactaaccactacaggccaggcaggtggctcatgcctgtcatcccagcactttgggaggcggaggtgggcagatcacctgaagtcaagtgtttgagaccagcctggccaacatggcgaaaccctgtctctaccaaaaatacaaaatacaaaaagcagccgggcgtggtggcatgtgcctgtaatcccagctactcaggaggctgaggcatgagaatcccttgaacctgggaggtggaggctgcagtgagccgagatcatgccattgcactccagcctgggcaacagagcaagaccctgcctgcaaaaaaaaaaaaaaaaacaacaaaaaaaaccactactcttccataggacttgctgccctaattagcttttaagctctatgagccaggggctgtcttctacagatggtctgctataatgctgaatatatattcctgaaaaatcttgagctgtacaaaatcatgcagtaaagctttggtgggaaaggtcaagtctgaaaacctaaaaccagagctccgatgagcaacaatactaattcaaaatattactagagttaaatctcaactagcatttttatacttagaatcaacagtcagtccacccttttcacacatactctggggctcatagttcttcagagttaagtccttgaaggtatttctttcaaatggagaccactttcatcaaaaataagtactatccaaaggtagccttttttttttttttttttttgagacagagtctcgctctgtcctccaggctggagtgcagtggcgcgatgtcagcttactgcaagctccgccttccaggttcacgccattctcaagtagctgggactacaggcagccgccaccatacctggctaattttttgtatttttagtagagaaggggtttcactgtgttagccaggatggtcttgatctcctgaccttgtgatttacccacctcagcctcccaaagtgctgggattacaggcatgagccactgcacccggcttggaagccttttttaaacacagggaagtgtcaccaacttcttcatctgtgcctccagctctcccagaaggtttcccgtcattaaaccaggcattaacgtagaatttgcattggattttttttttttttcttagggtcttggtatagctcaagcttttctctaattgaaaaaaagcttataccccgtcactttaaaacattgacctgctaggtaaaaaatccatggtcaacctgatttacaacattattgataatacttatctaccaatcccatataagttggagctaaacatagtttagaagaaagaactgttatttctggtctactctgcctctggtccaaaaagaagtactaattttcttaatagtaggtagctgtttagcatgtatcaaaccattttcataacctatgttcttttaaaatgtctatgtgcatagtgggtgtttctaataacacggctggcctaattttggctaaattttggttaagtgtagtagaattaggttaacgtagtttcaaccattcatgataccctgatttatgataatttggaaagaaagaatagcaacctcgaaacagtttctgagtaggccaggtgcagtggctcacgcctgtaatcccagccctttgggaggccaaggtgggtggatcacctgaggtcaggggttcaagaccagcctgggcaacatggcaaaacctcgtctctactaaaaatacaataattagccaggcgtggtggtgtgtgcctgtagtgctggctactccggaggctgaggtaggagaatcccttgaacccaggaggcggggctttcagtgagctgagattgcgccactgcactccagcctgggcgacagagcgagacagcgtctcagaaacagcaacaacaacaaacagtttctgaatagctacaattttcataataaacctcttcattcttaggggtcacttgaggttctctggatggctcctccgctccccttcccgggaacagaagtggtatctatagtggttggagttcctagagccaagccatgacaattgcatctttaagggtaaaagctgaaacacaaatgggaattcgaggcccaaggacctacagcctctgaaggcataaatgcattacatagcccttgaacagcacccttttatacatcaccagcgaggaggacccgtcaggtgataaagggtatagattctataaaatagatcaggggtgcccaagcttttttttttttctcgctctgtcaccaggctggagtgcagtggtgcaatctcagctcactgcaaactctgcctcctggattcaagcgattctcctgcctcagcctcccgagtagctgagactacaggcgtgtgctaccacgcccagctaattttttgtatttttagtagagacggcgtttcactatgttggccaggatggtcttgatctcctgacctcgtgatctgcccacctcagcctctcaaagtgctgggattacaggcgtgagccaccgtgcctggcctggggtgtccgatcttttagcttcactgggcctcattggaagaattgtcttgggccacacataaaatacactaacattaatgatagctggtaagctaaaaaagtaataattgcaaaaatattttataatattttaagaaagtttacaaatttgtgtttggctgcattcaaaaccatcttggactgcatgcagtccacgggccacaggttgagcaggcttgcaatagatcattctaattcatagacttttatccaataagatttagggttggtttcctgttgactactgtcaatacactattcttttttttttaagagtctcactctgtcacccaggctggagtgcagaggcgtgacctcagctcactgcaacctccgcctcccaggttcaagccattctcctgcctcagccttccaagtagctgggattacaggcacatgccatcacgcctggctaatttttgtatttttagttgaattttgtatttaaattttagttaagttttgtatttttagtcaccatgttggccaagctggtctcttactcctgacctcggcctcccaaagtgctgggattacaggcgtgagccaccatggccggccaatacactattcttaaagtgataaatgcttttctccaaatgcttaaaaccttaggtatctaggaaaagacaaaataactcttcagcagtgccaggtgagtggtgtttttttctggtaattatctaatacatgggaagagggagtaagatttagtagagtagtaggaagaaagaatgcttatgcgaagataggttgaatagagtaggaagagatgtcttcacttttcaccacactaatagcgttggctttggggtctgagtgtgctccaggtctggctctgcaacctggtagaatgagtagcctccttttcgtaaatctttcatatagtcacagctctgatttatctggaaggttgaatgcatcttccttcatctctgtcatcgctaatgtaacagaccagtatcttgatggatacagaaaatctagtctactcagagaagggaatttcaaacctatgaatgaccatgtgtggctctgtcaactgttggtgtgtctttgtagaatgagcttttataacccatctttagagcattaattagcatgctaactatactagtagctttgggggtgtgatagaaatgtgtagatggctgttgtgtgcgtttagagtgagtgttgaagaataatgcattgtgatagggttctagagattgagattcttccacttttgtaggaggggcttaggagcagctgcctattatttgaaatcaatattattgcaagaaaagcaaccattatggttatgttgctatgattcagcaaatggcgcccccaaaacaagccaaaaaaaaaccttacaataaattgtgctgaaatttgattttagatttctgcatgtatagattttatatatatatatatagtaaatctttttatatatatatatatatatatatatatatacataattttttttttctttttgagatagaatctcacttctgttagccaggctggagtgcagtggcacaatcatggctcactgcagccttgacttcccaggctcagatgattctcccacctcagccccccgagtagcttggactacaggtacatgccaccatgcctggctaatttattgagttttttgtagagacagggtcttcctatgttgcctaggctggtcttgagctcctagactcagtccgcctgccttggcttcccaaagcaccgggattacgggtgtgagccattgtgcctggcctatagaagatattaatagttcaggctgggcacagtggctcacacctgtaatctcagcactttgggaggccgaggtgggtggatcatttgaggtcaggagttcaaaaccagcctggccaacatggtgaaactcagtctccactaaaaatacaaaaaaaatgagccgagcatggtggtgtgtacctgtaatcccagctactcaggaggcttacgcacgagaattgcttgaacccaggaggcaaaggttgcagtgagccgagatcacgccattgcactccaacctgggtgacagagtgagaccctgtttcaaaaaaaaaaaagaagctattaatagttgagttttcccacagagttttagtagaaaagatataatgaagctgaaaaatgtgagtatgtaactagtaaaaacacggactgctcagaactagtatctccaaaatttatgtaagaaacaaaatttccattattgactatactagatattttcatcattctcaaatttttgtggaacacttaaaatttgtattagcagatatgtcaaatcttttgtctaggttggaaaactcttaactggaagaacatagctaaatctttgataatgaaagtacaccttcttattaattttggcctctggaaaacaatactgaatgaactctgatttttttttattattattatttttgagacagtctcactgtgttgcccaggctggaatgcagttgcgctatctcagctcactgcaaaccgcctcctggattcaagtgattctcctgcctcagcctcccgagtagctgggattacaggcgtgcaccaccatgcccagctactttttatgtttttggtagagatgaggtttcaccatgttggccaggctggtcttgaactcctgacctcaagtgatcctcctgcctcggcctcccaaagtgctgggattacaggtatgagccactgcacccggctagactgttttatttgcatgctctttacaaaacgtgttttttcaagctgaattgctttagtagttccataaaaatgtagtccagaaaaatctacattgatgattttcattttcaacagattccaagtgaattcaacagaaaagctgtaattcttgagttcctgatagttctggagtgacagtactccactacggtgcaactcctcaccaccatccccagtttctcttttataatctcaggctttttaacttggtgaaatgtttttctggaaagagaaatggtcatatagcactgaacaatagagcaggtgtggcggttcttaggaaacactgagttatgttttcatcttaatctcaaccccttgcctaaaaagttgttagtgtcctctgttgtctgcctaattaaaatataaacatgctccaatgtgataccaactttttttcatctgtactggtctagatctagtgctggggaccgcttccaagtgcatgacagaccccaggtgatcacaggatggcctagctatcacactagttggccttaagttaaaagacttttcactgttattggggttgggggcaggcaggggactgttttaattgtccttctctctactaatgctgttcatatttttccaccctggcagacatacgccatcatccagtctattctcttatctggagtgtatccctcagttcttgctcactcttagtcactgccttctccccaccaccacccccccagatgtggccttgccctcatttgaacactcaaatgaactattcaagatgagtaggcaagtacttaatgaaacagacagactttcaaatctgtcaccatgacatctgtgtgagacctcttttcataagctagttgtttagatggccagtcatttctatatcacagatattaagtacccatttaaagcgatcattttatggaaagataatttgaagttattggtctgaccaaatttattcttcctgagatgtcaagggactcttggatgataagttactggattaggctaaatcgtttgtccacaatttataatgatatagatttatatagatgtatgtgttcttgcagtttttagacacaaaatattgagcattctatgtgactgtattccaaccccacctccaagaatataagctctttgagggaaagatgtatattcagtatcttttcatcacatacaattcttgttgagtatcacacaattagtagataaggaacaaaatcagcaacttctttctccacagtgcttctctttaaggtggagaacttgtgctgaattgtcactttttgacaggagtcagtctgttctctgtccttctagaggctgaagattgtaaagacaaaagtgaatggatttagtttggataccatgtgcatgatgcttctttcctgctagcccattttcatgattctgattttctttcgaaaagcattttaaagtggtaaggttttgcatgaaaatttaagtggataaataactaacagttacatattttacctgttctgaaaaggatataccattaattggctgtagatgtccaatatgtgacccttgagatgagcacttgaaatatgactggactaaggaattgaattttaaattttatttaatcttaaatttagccatatgatgctagtggtgactgtgttagctgtagaccctcaaaagcatgaaaggttcaaaagtagcagagtttaggacagactggaattaattggcagatcaagggcccagaggagcccaattctatctgcaggtttgtcaatttagatgagtagacaagtgcttaatgaaacatgctggattttaaaactaccatcaccaaaagttggatattagcacatctgccttaagctagtagtttagatgtgaatcatttctggaccatagataattactcatttaaatttatcggccttttttttgaaagatacatttggctgggtgtggtggctcatgcctgtaatcccagcagtttgagaggctgaggcgggcagatcacctgaggtctggagttcaagaccagcctgaccagcatggagaaaccccgtctctactaaaaatacaaaattagctgggcgtggtggcgcatgtctgtaatcccagctacttgggaggctgaggcaggagaatcgcttgaaccggggaggcggaggttgcagtgagccgagattcttatatcataaattactggattgtgctaaatcacttatcaaatttatatactattttcatgaggctttctaaaaagtaatttatgaaagagagatgttgagacacaagggttccatattactcatttttggaagaaaagtttagtcatgctgatgtcttgtagatgcaggattggttttaaatctgaagcatagaccgggcgcggtggctgacacctgtaaccccagcactttgggaggccgaggcaggtggatcacgaggtcaggagttcaagaccagcctggccaagatggtgaaaccccatctctactaaaagtaccaaaatgagctgggcatggtggtgggagcctgtaatcccagctactcgggaggctgagggagggaattgcttgaaccaaggaggcggaggttgcagtgagccgagattgcaccactagactcaagtctgaatgacagagcgagactctgtctcaaaaaaaaaaaaatctgaagcataaaatgtttcttcagaaaagcagacacatcttatactaatggtttttcaacattattaatctcctgtaatttagctctgtcttggagaactggaaacatcatagtcaatgacctagatacatgagactttgcatttcatttattcaggactgcaacattttgaatatggatgattttgaactccctatttactatttactaagtgatgatgtacttttcaggcggctagccacctgcgttatgtcccattattaacgtaatccaggaagttgcttagagagcatagaattgtgtaacaagaatttcatctaggcaatagaaaccagtttattcctaacccaaacctagtgaccagaaaaagaggcctgtaactctgcagtccggaccagtagttgctgtttacttttccagtgatgcgagacaaactcttaacatttttatttaacttaaaaactaacattcacttgccagtcttgatagagggccagtgcctttggttgccatagatcctctgtaagcctccaattttgaataaaatacaaaggttttgaaatctgatttgtagtttctctgttgaaagtagaatttgaacttagagacccttgcatgcacttttggatttttaattttctttttctaattttctataaagtctcatctgggtataatttgataatgtaataaccccccctccctttttttgagacagtctcattctgtcgcccaggctggagtgcagtggcatgatcacagctcactgtaacctcgacctcctgggctcaggtgatcccttccaccacagcctcctgagtagctggtattatgggcacatgtcaccatgcatggctgatttctgtatttttttgtagagggagttttgctgtgttgcccaggctgttctcacacctgcccgccttggcctcccaaagtgctgggatgggattacaggcgtgagccaccatgcctggcctggaatgctgcttttctaagaggaggttctatgcctaaatagatactctcttttaactcagcattttgggggcttgagagaagggtgggagttgctgaattgtcagcttgaaactttccagtttggaaaagttcctggtaacttagtcaaatgagagaggactcctgtgctggctgagaactcttaaaggccagcagctcctggcagcagggagggagcagggcagatagaagtgctggcatgcatttaaaagaaaaaaaaatcagtcatggctcttgcctgtaatcccagttgggaggccaaggtgagaagatcacttgagcccatggttttgagacctgtctaggcaacatggcaagaccccacctctacaaaataatacgaaaatcagactgggcatggtggcttactcctgtaatcccagcactttgggaggccaaggcaggcagatcacttgaagtcaggagtttgagatcagtctggccaacgtggcgaaaccccatctctactcaaaatacaaaaattagctggtcttggtgggaggtgcctgtaatcccagctactttggaggctgaggtgggagaatcacttgaacccgggaggcagaggttgctgtgagccaagaccatgccactgccctccagcctggatgataggacgagactccatttcaaaaaaaaaaaaaagtacaaaaattagccaggcctggtggtgggtgcctgtactcccaactgctcgggaagctggagtgagaggatcacttgagcccgggaagtgaaggctgcagtcagcagagattgtgtcactgcactccaacgtggatgtccaagtgagaccctgtcttagttatcatcatcatctctatgcacactgggaattaaacttcgtgataaaccctatgtgttttcgagggagaactgtttaaatttacttgaaggtagtatactaagataattttgtggacacttttgttcaaattgacttatttatttttattttttatttttttgagacagagtctcactccattgcccaggctgaagtgcagtggtgcagtctcggctcactgcaaccttcgcttcctgaattcaagcaattcttgtgcctcagcctcctgagtagctgggactacaggaatgtgctaccacacccagctaatttttgtatttttagtagagatagggtttcaccatgttggccaggttggtcttgaacccctgacctcagatgtccacccacttcagcctcccaaagtgctgggattataggcatgagccaccacgctcaccttgagttgattttaacttaagtgaagttcaacctaagctagcccacaaatattcctttgtttcccccccccccttttttttttcctttttttgagacagaatctagctctgttgcccaggctggagtgtagtggcatgatctcggctcactgcaacctccgcctcccaggttcaagtgattctcctgccacagcctcctaagtagctgggattacaggtgccttccaccacgcccggctaattttttgtatttttagtagagatggggtttcaccatgttggccaggctggtcttgaactcctgacctcaggtgatctgcccacctcagcctcccaaagtgctaggattacaggcatgagccactgcgcccggccagatattcatttaaaagatgggtatgtaatacctgttacctgttaaataaaatctaggatacttgtctaaggtaatagggtatttttgtaacaatttgtagatttcagtcttttttttttttttttttcccccgagatggagtcttgctctgttgcccaggctggagtgcagtggtgcaatctctgctcactgctcactgcaacctccgcctcccaggttcaagtgattctcatgcctcagtctcccgattagctgggattacaggcatgcaccaccacacctggctaatttttgtatttttagtaaagacggggtttcaccatgttttgtccaggctggtgtggaactcctgacctcaggtgatctgcccacctcagcctcccaaagtgctaggattacaggcatgagccactgcgcccggccagatattcatttaaaagatgggtatgtaatacctgttacctgttaaataaaatctaggatacttgtctaaggtaatagggtatttttgtaacaatttgtagatttcagtcttttttttttttttttttccccgagatggagtcttgctctgttgcccaggctggagtgcagtggtgcaatctctgctcactgctcactgcaacctccgcctcccaggttcaagtgattctcatgcctcagtctcccgattagctgggattacaggcatgcaccaccacacctggctaatttttgtatttttagtaaagacggggtttcaccatgttttgtccaggctggtgtggaactcctgacctcaggtgatcgcccacctcggcctcctaaagtgctgggattatagatgtgagccaccacgcccggccacatttcaatcttaatgctattcttggtaaggggtccatagacttccaaattaagggccagacaaacattttaagttttgagggccacacagtctctgtcacaactgctttgactctgctgttgcatcattaaaacaaccagacaatatgtaaaaatgagtaagtgactcgattctaataattccatctgtggacactgaaatttgaatttcacataattttaaaatgtaaaaatacttctggctcacagactgtacaggtggtgagctgcagactgccagtcctgttctagatcataaatgatagctgcctgttagaagaatgaagtgacttttgcctatgtatgcaggtttaaaatgtgaaggatgcttcttgccacctaatcataacagtaacaagcactctgtatcaagaatcgtctttatgtgcatttccctatttctttctcacacatctgttatcttcttagtattcttattttttaggtgaggaaacaaggtaacctacctatggtcatttccttaaatttggaatattccataactaaataaacttatgtgaccatagacctcagtgcatacaactctggctaataagccaagtttctgttttttgtttttttgagatggagtctctgtcacccatgctggagtatggtggcacgatctcagttcattgcaacctccacctcctgggttcaagcgattctcctgcttcagcctcccaagtagctgggactataggcgcccgccaccatgcctggctaatttttttagtagagacggggtttggggtttcaccatgttagccaggatgatctcgatctcctgacctcttgatccgcccgcctcggcctcccagagtgctgggattacaggcgtgagccaccgcgcccagccaagtttctgtttttatcctttgttattatccaataatttgagagttttaccaccagtagtttatttcattagataaggtgatttggtagtgtgaccatgttaatgttaattctgatttcagaaagatggtgtttaacaaaggttgtcaattgcatttttgtggtgtaatgcgtaccccctaattttaattaaattttaaaatattttaatctagaatagagttataaccttgcagaggtttgagaatgttgtttatatacgaagtgcttctcaggctggaagtatacagttatggttcaccttacaggtgctgctggtgagtagcagccggtacccagaccagtggattgtcccaggaggaggaatggaacccgaggaggaacctggcggtgctgccgtgagggaagtttatgaggaggtgagatgttctttcacacaaattctgtttcggagttttaaaaacaaggccctttgctacataacactaagacagcgagacgggtccaggagtgctttttgcctgatgcaactttatttttaattttaatttttttttttattttttgagatggagtctcgctctgttgccaggcctggagtacagtggagcgatcttggctcactgccacctccgcctcccaggttcaagtgattctccagcttcagcctcccgagtagctgggattacaggcacgtgccaccgcgtctggctaatttttgtatttttagtagagacagggtttcaccatgttggccagactggtctcaaacccctgacctcaggtgatccgccagcctcagcctcccaaagtgctgggattacaggcgtgagccactacacctggccttaatttttgtatttttagtagggacagggtttcaccatgttggccaggctggtctcgaactcctgacctcaagtgatccttctgcctcggcctcccaaagtgctgggattacagacatgagccacagcgcccagccagaaatactaatttttgatcagtccttgccgctgatgaagtaaatgacaataaaaacttcacagaagcaggaagatagtgagttggtatggggaggggtattgtatttaattagatttaagtaaatagccagagtgtaacttgtatttatatacattttgttataaaaaggtaaacattttatatttcatctttttttaataggctggagtcaaaggaaaactaggcagacttctgggcatatttgaggtgagttaaaaagtaatcttcactttgctgataatagaattaatgatttcttcctaaccaaccaaataatgtggcagcagcctgaaccagacatttctctcagactagcagtaggcagtcagtccaggattaggtagggagggaagtaaaagccactttttcatatgccaccacttttatttatttatttttaattaattttttttaagacagagtctcgctctgtcgccaggctggagttcagtggtgcaatcttggcttactacaacctctgcctcccagattcaagcaattctcctgcctcgtcctcccaagtagttgggactacaggcacgcgccaccacgcccagctaagttttgtatttttaatagagatggggtttcaccatgttggccaggatggtctccatctcttgacctagtgatccgcccacctcggcctcccaaagtgctgggattacaggcgtgagccactgtgcccggctgccatcacttttatatagcattattatggtagtgattacttctgtttgaaaatacagtggagctgatactgaaatgtttatcttaatccactgtagactgtttagggtatagatcttttaggaggtacaatatttttagtatgacctaagagcttaggtctcatgtgttttatctggaaatgtccccattgcccttagcaaatattatatgatacacctagtgacttaaaggattgtacgaagatataaatctcaggtacatagaacagatgctaaaagaatagaattctctttcatatattctcttattactgaaggcagaatagaattttcagggagggaatttgaatgtgataggcagtctctggaagccagggagaaaggaggtccagatgtatcttcatccaagattcagacctagatacacagtataccagaaacatggtcactttccttttttcagggtgctgtttataggttagtacagcctttatagtagaaccatataaattttatttttaagccttaggaattcagaaaaaatcccgattttgtagcacttggtagaattgatgatgacttttaccggaatacagtaattaagagtaaagttggccgggcgtggtggctcatgcctgtaatcccagaactttgggttggccaaggcaggaggatcactaggtcaggaattcaagaccagcttggccaatatggtgaaaccctgtctctactaaaaatacaaaaattagccgggcatggtgacgcacgcctgtagtcccagctacttgggaggctgaggcagaatggcttgaacccgggaggtggaggttgcagagcggcactccatctcaaaaaacaaagagaaaagtcgttcaagtagaattcagtcttttccagaattcagcagttgcttcacccagttaaatagcaccatctcctggttaaactgaaaaacatactgaggtttttacaaataacacatttgtcaatatgctgacaaggtgtttgaagaaaatgtctcacattataaataaagcttaaataatatgggaaggtaacagtattaagtgctttacaaatactgtttaacagcacacgtcaatcaaaaaatacctttccccttagaaaatataagggaaaattggattgccctgcccattcatcccagtgatttttgtgaatttgtgaatatagcataataaatgtactgatttgtgagacatagaaataaaacaactgattcttaaaaataatgaatgatgtgttaattgacagttgcctctaatttattgttgtttttattccttctcagatataaaaagataatccttcccagctgtaaaaacccactgttttgagtagatttttcaggttgtttgtggccaaaatcaggacaattatctaaagtcgtggactatggcaaagaaggctaactttaatcaggatgaaggaaggccaacttgtttaatttttaacccagaaacaagctcagttgcctgttttatttaatttatgttttttttttttagatggggtatcattctgtcatccaggctttagtgcagtggcatgatctgggctcatcgccacgtccgcctcctgggctcaagcgatccttcacttcagcctcccaagtagctgaattacaggcatacaaccacgcccggctaatattttcgtatttttagtagagacggggtttcaccatgttggacaggctgggctcgaactcctgacctcaagtgatctgcccgccttggcctcccaaagtactgggattacagacgtgagcttctgctccaggccatgggctattctttatgtgcaccttgataggcctgcaggaggagtgcttaaaggaactggtgctgtttgctcttacaaaggtcctaaaggaagcagttttccatgtcattgaaaggttgtcaggattagccccagggaagaggggataggataaaaactatgggaatgcaggtctattattttaataagattgcattcaactcttaagattttctttatgaaaataacatcagataggccaggtaaggtggctcacacctgtaatcccagcactttgggaggccgaggtgggtggatcatgaggtcagggtttaagaccatcctgaccaacatggtgaaaccccgtctgtactaaaaatacaaaaattagccaggcgtggtggcgtgcacctgtaattccagctactcgggaggctgaggcaggagaatcacttgaacctgggaggcagagattgtgggggagctgagatcacgccactgtactcctgggcaacaaagcgagactccctgtctcaaaaaaaaaaaaaaaaaaaaagaaaagaacatcagatatatagaaataagtgtttaaagtttagtactggaggctgggtcctcatacctgtaagctcagtttttgggaaggccaaagcaggaggttcccttgagggcaggagtggaccagcctgggcaacatctccagacttctacaaaaaaagtagtattgagagccaatttcaccaccagtaatgatgaagctctagttctagtcttctgtttaacttttaaatgttttgtcttatataaagtcacttttgtgttggactgtacaactgaatatacttgcctgtgctgggaaatacgctatgctaatcagcagtatgccagactaatttttttcccttggaaaatgtgtccatggctagctcctgtagattaaaatgcatttctttttatattcaagcagaaccaagaccgaaagcacagaacatatgtttatgttctaacagtcactgaaatattagaagattgggaagattctgttaatattggtaagttcccttttgttatctgaatactctgttctaacagaagattgggaagattctgttaatataggtaagttcccttttgttatctgaatactctttgcttatattcctgtgtccagtttccatcctagatttttttttttttggtcacttttcatttagagcagggaagataattcaaatgtagagatgcatattcatcttaattattccccaacatattgttgtctaagtcatttatcggggagtaagtggacattacttatatggcttactttttaaaatggactgtcttgtaaccaatgtcattcttttctctaggaaggaagagagagtggttcaaagtagaagatgctatcaaagttctccagtgtcataaacctgtacatgcagagtatctggaaaagctaaagctgggttgttccccagccaatggaaattctacagtcccttcccttccggataataatgccttgtttgtaaccgctgcacagacctctgggttgccatctagtgtaagatagagagaactgggtaggcctctcccaccatgtgcagtctcatggggagaggcttctttcgtttcctcgtcaaacatctgattgacgcttgcaaactgtctgaatttgccatgcaaggttttcaaacaatttgcatgtttttcagatgctttcaaatctttttttaaaaaaatagtgtaaaatattttaataagccaaagccatgtggaatttttgtttagatgccttaactgtgccacaccccacaaccccctatattattttggttgtctatttctcacagcatattttcagttttttgtccatttgacatcagtctgtggtttattttgtcatcagattacttgtgggtatacctaccccaaaattgttttctcattcacagcattagcatattcagcaaatccatctgtggtgggaattaaaaatattattggtattaaagaaatccattcaccccaaaacttgttttacaggattacaattttaattcaaaatttccagatttgggctatttctgtatgatccaataacttattttgtcacagggcttaatttgccatttttggggatttgtcgactcattttgtctgaattttcacaactggtattatgtcactagctacctgatacggctatttcccttataactcaatagtaccttaacacaaagtataactctgtagagttggtgaatattttagggaaatattagcaaaatgcatgtagtaaagacatcttatgaaaactgtattcatggaatttgatttagcatgctcagttgccagttcccattatcgatactctttctttgcagaataccttagaaccgttatttccctcagtgtagattgctcttaaaatgtattcagttatttagtggcccccacaggagtggagtcttgaaatctaattctaaatgccagtcagtgatgatcgcatcacagttgagtgaaatggccttcctgttcagctgttagagactgaagattgttagggcaccttagaatgtctcatcttttctaggttgtcaacaggtactatttgtcacataactaactttcgaggcactggaacatacctgaactaagaattaaatcttttactttatactcacttaaaatcaagaatcccatctaaaacacataggtaccttatctgaaactcttgcacttccccaaccagggcagaaatgaggtgggagaagtttgactaaaatgagggatgggggaaagtaaaagatgtttttttttttttgagactcgctttgtcacccaggctggagtgcaatggcacaatctcaactcaccgcaacctccgcctcccgggttcaagcgattctcctgcctcagcctcccgagtagttgggattacaggcgcctgcctccatgcctggctaattttgtatttttagtagagacagggtttcttcatgttggtcaggctggtctcaaactcctaacctcgtgatccgcctgcctcgacctcccaaagtgctgggattacaggcatgagccaccatgcccagccaaagatcatttttttatatagacttcagccctttgtaaatattgtaactggggagtatagagtagaaaaaaagtatagttaaaacatttgttctacaaattaacctttaaaaatataattactgctaaaaatagagtgctgttacacttaaggaaaattagtgccattttggaaatgagatcttgtgccataaatacagctgaactgaatataaatgttcacaaattaatgctgtcaaaggaatgagtaaagcagaaaaacttttaaccagcaacatttcaagtacgtagtgtgatcaaacatgatcatccagaatttttatatttttttctttgtacagaggttacatattctgggtgttcttttataaaggaaacattttaaatcccacaaattgacactttctatcttcaatggactaagatttttttggtcagtaatctctgaaatttccttaaattatatacttaacatagcagagaaactggattgtttttgtatataagactgcttccacctgaaatgctgtcataagtactgggggggtgggggagtgcccatcttgtacatgatattcttagaggtaataaggtaatgatgcatgaatttattttataaactcttggactatgtatttgacatgtaaaatatgtacagtattaacgtcaaccatctctttaaagttagcctataaatattgttgtataattttctttggtcagaaacacttggactgaatagtgacactcggtaaggattttcagtgccatttagcaaaacgtctttagtctatgcaactagcaaaaatctgcataatgcaacaacacagttttcacacttcaaattttacatgaggggttcttcacgattctcctggaacccagtctagcaaaatgagaggaaaggccctagggagatttatttctgttaaatagttaactctgctgagtatgacaaatagtgtctactatctcaaccctccaaaatttgcagagtgttgggactgtcatttgtgattttttttttttttttttggtggggtagttgaataaaattgggcagctaaatttttcagttccatgtgcctcccaaataaaaaacagaaaataagtagtttttgtgaattgacttgcagacaaagtagaaactgtgctgcatgatgttattttgtaaacagatgacattttctgaccaggcacatgccatccaattttctgtcaatcacactgttgtataaagcagcagaactgaaggggaaaaatgattgttgtatacactgaattgctttgcatggtctcatttgagataattgatgtaagaatcctgacttttttatatttggaaacatcaaataaaaatggaaaaaatgatcatggctttaaaaaaaaaacaaaaacacacacacatgaactcagatttgcaaaccaggtttctgaaactttgggtaaggtgtatgcttttaactttgaaatgtataaacacccagcggaaacgtatacctttcagtgcatagtgcattgtgtgcttaccctgggttgtttaaacttgtgttcaaatattccccctccaagtgaaagcctgtcgggaattccacagtaacacctttactgttctcccattgatgatcatatacgttacctcttcctagcggtacatttgtatgatccttactactggaattaccgggttaaaaggaaatgcttaccactaagatgtcagtattctcctcatggatattttcagtctcaatgttgccagtctaatagtatagtatgtggttgctttactgctgttctccccacccccgtggagttgtgtcattattttaatgaatgtgagctcttgacttactctagaattctaatacagatactttctgcactagtatcacttttattattgcagttccatttaaaagcataactggctaagtcaccgccccacccgccgcattacatttcctaaaacatactgctgccaaagaccaactgtagaatccttaagtcctgttcaagtgtcacttcattttttattaggggtttcttagttggagggcatgagaaacttggccctttccaatgttgtcttcacattggagtataagaattctctataggactctttaatttttttttttttttggtagagatggggtcttgctgtgttgcccaggctggtctcaaactcctaggcttaagcagtcctccagcctcagccttctcaaagtgctaggatgattggcatgagccacctcgtctggcctgcaggtctttttaagcatttgctgttcaataataagcatcttctttatgcctagtatttgtgataagagcacaaaacaattttctaatctcaaagagcttatattctagtggggtagagataagtgatttatcttggtgtagttttggcttttttgtttgtttttttgagacagcatctcacactgtcgcccaggctggagtgcagtggtgcaatctcagcttactgtaacctccgcctgccaggttcaagcgattctcctgcctcatcctcccgaggagctgggatcacaggcgcctgccaccacgcccggctaatttttttgtatttttagtagagacggggtttcaccatattggccaggctggtctcaaactcctgacctcgtgatccgcctgcctcggcctccctaagtgctgggattatgggcgtgaaccaccgcacctggcctatcttggtgtttttacatccttcagtatttttcaaggttttacagcttttttatctatagacttataccatcttcaaaagcaatacaattttatttgtagacgtgatttcccccaccaaatgcacattttatggagctctaggacaaaagtcaggatgaaaagtaatctatcgctggtgctactttaataccttcctgactggtgccactggctaaattctagcagtacgatgagagggccattaaggcctatcttagcaagcaagacattatagcaaagacctaaacactcaaaggttcaacgtcttctagccagggaactattctctaattcttccaccttgatatgatttcagcaaattctgataacccggtattactcttaatgcatttttgtaacatttgacaaacatctcccaatatgtagactcccactctcctgatgctaatcagtatcagacaatggaagtaaattttcctgcttttctcaacttttcctcaaattcatgttagtgaagtactttcatttggccatcattatttatcaaccttaagaaacatgcctattgacgaagtaaatatactaggaattcaacgtatctacgggaatgtggacaaagacatataccaagacaaggcactagagtgaaaagccattaaaataaaatgctcagcagcaaaggatttgtaatggttaacttgcaatatatccatatggtgtaatattacagtcattagaaatgacatttgcgtaaggatctgagtggaaactgatacagcctgtcggagagctactgagtagtattttatcacagctgcatacataccctttcacccaacagttccactcctgggagtctagtcaacaaatggacaagttgcacaaccaagctatggtcaaatatgtgtgttgtaggatttatgaaactggtaccaatttaatattcaaatgtgattaagtcatggcaatctatttactggatactttgtggttaccaaagagctatgtgctgccacagggagtcctttcaatagtgattgaaaaaggcagaacactactagacagaactacctgttttatgcatgtattggcatacactgaaaaagcttagtcacttaaaatgaggttgtacagattgtagattttgtttttaaacgcctgtatggtttaaaaaatgttttgggaaatagacatgagcagggcagagaactacaacctacaggccaaaccccaccccactgcctgtttgtacggccaacaagtttaaaatttttttaatgttttaggtttttttttttttaaaaaaaatactatgcccatttgtttacaaatcgtctgtgggtgctttctcactacaatggcagaattcagtagttgagacagacctatggtccacaaaggccgaaatatttactgttttaggagaaaaaaacaacatgaattgtaataacttggacttacttggttgctcagtcctgatgtgtcctgttaaaacctaagagaaacagcaccaagttcaatctagtgcaatcagcctatcacatctaagctgcttttgccagatctgatatctactcccgaccttaagccaggagactttgtaaacttactaggttataataaaacttaagaactatcgatatttactaatctacatcatggaactatttcaaaagcagtcatatggtaagatggatcaggagtctttaaaaataaaactgagaaagaaaaatcatgtgatcaattcagtagtagagacagaggttggtatcaagtctatgttcatacacttaccagtgccacccagcagggccatacaagacacatgaaatgagatcagctcaagggtgacaagatgaaactgggagagggccggggagacccgaactcttaatattggattccacacaagaggaaaaattttagtccagctcccagcatggcagctaatggcaagttagtaccataaagccaactcttggaatatacctgacttccacgataaaatggagatgagtgcaggggtgagtgtatagttaagaaaacaaacaatatattactagtccaggtggtagatgacagatttttattatttacacttctctcaaattattacattcagcatgttttgctttttatgttatttaaagtataaaccctcatataattccctaagatgggtggcatgccaagtagctaaatgaaatatcatcccagcccaaaagtacttattcgaatgaaatattacatttttcttaaataaagcaataaattaggtaccctattatcatggtattttcttttttggccagcttttctagataaggttgtattgctactgcaactaacaaaaaagatgtggcagggctgggcacggtggctcacgcctgtaatcccagcactttgggaggccgaggcgggcagatcacgaggtcaggagatggagaccatcctggcccaacatggtgaaaccccgtctctactaaaaatacaaaaaattagccaggtgtggtggcaggtgtctgtagtcccagctcctcaggaggctgaggcaggagaatcgcttgaacgcgggaggcagaacctgcagtgagccaagatcatgccacagcactccagcctaaactacagagctagaaagtggctagagcagcc

SEQ ID NO: 36847 - DNA, 28350 bp, Homo sapiens; identical to SEQ ID NO: 36846

SEQ ID NO: 36848 - DNA, 55181 bp, Homo sapiens
tcatcaacatgcattcccagaaatgccatgaaaggaaagaccaagtcttgactgagaaacggaccgggcagatgagggactcccacatatacctgtttcctgctcttcccgaagacattttgccacaagcatataattcagcttctgaaaaatacggtcttcctcactgcagacaccatgccagcgttttaaatcaagttggctactcgtgctgtttagagtatgcagtttgcctgtggcaatattaaactcatctggaagaaagcacttaaacctatccagttcctcatcggtgatgttatccaggctggttagcaagagtatctccttatatttactctccatctcacgacttttcagcttataagggatccaaactatgtaagattataccaccaaaagtgattcaacattcaaaatgaagcaaggtgagctgttactattttttaaagggaaaataaaatgtttacagtacagtaaaagagattttggtgaaatataagaaataactttttaagcaagatagtccttcttcctgggaaagacatcttcagagggtatacaaccacctccagaattcttagaaaatgggatccattttcctgttatttttaaaacagagttattcaggcataactgacatacaacacaatgcacatatttcacatgtgcaatttaaattttttgacatgtatacagtagataaagctcaatttttcaatttcttctttcatggatcatgtttttggaatcatatggtttggatatttattttccccaaatctcatgctgaaatgtgattcccagtgttggaggtggggcttgacgggaagtgcttggctcatgggggtggatccctcatgaatggctcagtgccatcccctggttgatgagtgagttctcctctgagtcacagagatctgattatttaaagtgtgtagcacattgaagacctaatgtgaccagtaacccattagaagaaaacaggataatctcaatatgttgaggtaggggaaggtgtcttaagcacaaaaggtgcaagtcaggaagggaaagtttattaaatttgattgcatgtaaactctaaatttctttataaaaaagaaaaattaaacataatacttccaaatcctgaaagaaaacataggcaatgtatataattcagaatgtgtgtagaactacatattgtcccatttgtacagcccatgtgaaaaatggacaataggtatgaataaccacgttactcaaatgtccaacacacatatgaacaggtgctcaaaattaccagtatttagtaattttactttaaaagtagcaacctatatggtagaggacttgagccaagaacaagaaaggatgtttatgagctgaagataaccaactgtgacttttaggggaggctcccattgatagagacaatgttaatgaattctgagttattacttttaatatgaacttattattttttcctatagacaggtgatagctagagaaaccctatttatacatgtagaatttataagcaaaaattgaaagtatttataaagtattttaagggacattttcaaaataaggaacacatttcaaatacttaaaatgattaaactacatgaacgcccctgtcttaccagtgaaagaaaagaaggaaatttgcatttcctgagcatctattatatgctaaacacagtcaactcagcatgtttccctacttatctataagaatgcaaccctcctacaaccctattacgtgctaacattcacatatcaataacaatttatatataagaaaattaagacaccttttatcacataaatataaaatttacattttactccatgatatctgtttacttaaaacatattttaaagtatttgctatagggtaaaatgtatacccaaagaaaatgcagacaattgatttggtggcttcatgtcccaggggtgtacacactgtagttgagaagtatggtcctgtaccatgcataatagctgacactgggtagcaacttactgtgtacaaagtgctttcacatgaagcctggaagacacaaagaaaagaaaatgttgagggagcatataatcatctctgaatggggatgataattcctatctccaggttgtaaatacacagtatggtatgcctgatacaaaacagctggcatttattatagtctctcaattgttacattttaaattaggtggcatgagttacctggaaccaaacagctagtaaaagacagtacatattactgaattcaagtcttctgaatccaggagctctgctttttcttatgccaacagcctgcttatcatacagagagtatggaatgattctctgtttaaaaaaattaaaaaagaaagaaaaaaaaaactagtgttatttgcttcgaaaacaccaaccctcagatatatagtagtgttataattgaagcattagcaattattttctttgtcaaatcatttatttcttttcaaccagaatattggcaaagcttgctccttcactctgttcagatttctgcttgtttttttctaagctcatccttcaatgaacacatgctgcaaaatagcacgataccgttactattacctcataccatttgtatttcttcatagaatttatctgcttgtaatatataagcattatattatatatgacattatagtataaatgctgttgctatttgtttattctttaatggccagcctgctgaaatagaagtgccttgtggtcaagcatttgtgtgctgtttattgctgtactcctaccacctagagtagtaggtcctcaataaacatttgttaaataaacatatgttgaatcaactgtctaggcatcccatctaagacttcagccctgggaatctctacttcctaggctctattcatccatatggcttgattactcaagagccagagttacctgagaatgcacagagcaaatgtcctcactgcacattcttgaagagggatgttcaagccagaaatagcatagataaaaaacaaaattataatcaaaccatatctatctacttgtagaatgatttcaaaagacagcaaggttaagaaggcttttcaaaatccaaggcattatgccaaatatataacatatatttaataaaagtggaaaatttggaaacttccatctctggtgggagtaatccaacttcctatggttccactgtgcaagataccctagattctaagaaggaagtaaaacatggtgtattgcagggaaacttcaagtaattgaatttgtgtgaactttcagactaagctgatagaaaatcgcatggtttattttaatgtttctgctattagttattttttcacgataatttaactggtgaatccagttatctatttagacaatagatgtatttttattctggctatgtcataatattctgcaattacaaaatcacataacacttaaattactgccgtaaagctaagaagaaataacttgccatattccaaattcctaaaggagctcgatctctgttacctaagcaatccctcctctgttttgctcttttgtgattcttaggctggaatcacgttttggctctatcagcctaaggagcagttagccacctgtcactgagttagggaacaaaaagaccaaggcgataggtatttgcaccataaacttctcctatcttgtatgtccataattctgtattattattattattattattatgttttgagacggggtctcgctttgtcgcccaggctggagtgcagtggcatgagctcggctcgctgcaagctccgcctcctgggttcacaccattctcctgcctcagcctcccgagtagctgggactataggcgcccgccaccatgcccagctaattttttgtatttttagtagagacggggtttcactgtgttagccaggatggtctcgatctcctgaccttgtgatccgcccgcctcagcctcccaaagtgctgggattacaggcgtgagccaccgcgcccagccaattctgtattattttgcatttctgacactcatgacttgataccttaaacattcaaacacatagaagcacttatttgtgtgaacagcagtttctttccttgaaccaaagattgtcaacccttaatctaaaacataaaaggaaataaaattcaaacaccacttctccattacttgtaaattttatttctctcttcttaatatattaatacccaaattccagccaaaatattaaggatggatgtggtggcttatgcctgtaatcccagcactttgggaggctgaggtaggtagattgtttgagctctggagtttgagatcagcctgggcaacatggcaagaccttatctccaaaagaaaaaaaaaaggttaagaaatctaaatttcagttaattttgcccttattgctaagtaaatctgagtaaattatagatgttagtaatttggggtaagaattcccaaaaccagccgggcatcgtgactcacgcctctaatcccagcactttgggaggccgaggtgggtgggtcacttgagatcaggagtttgagaccagcctggccagcatggtgaaaccttgtctttactgaaaatacagaaattagccaggcttgatggtgcatgcgtgtaattctggctacttaggaggctgaagcaggagaatcacttgaacctgggaggcagaggttgcaatgagccgagatcgtgccatcacaacagagcaagactccgtctcaaaagaaaaaaaattcccaaaaccagatgtttagggtggagagttcattactgacaacagtagagaatctcatcttcaattttagagataaattatatcaagggaaattttgacagccaaagtgaagtcctgaaattaaacagagtaaagaaattatcaatctagtaaagatcctcaaagaatgctttctggagaacagttttagataaaataagcaaataaagaatgaagatagcagagataaagccggagaagtagaaactatcaatgtttttacccccttcaaaaataatgttgaaacttagtacccaatgcaacagtgttgggagcttgggccaaatgggaggtatttagatcatgagaatttcactcacgtaaatagactgattaatgccactctaacgggcatgtagggggtgaattcgccccgtttgtcatgtgaggacacagcaagaaggcctcaccagatactgatgcttgaccttggacttccacctcaagtactgtgagaaatacatttctgttctgtataaattacccagtctatagtattccattacagcagcactaaatggactaagacagtgggaaagtatgcatgtccattacagggagggtcagagaacaggagttttcatgaaccagaaacttctttcactcatattttctccatgagacatgcaataaacagatgaatgatgccaactctggccttgtacagtatatcatgactggttcacatcactccccaggtttccatatgcattcactctcctctcctgcctcaacactgagtctcttttattccactccaaagtaaagaggtcatccctagaactacagaagctctttctgccaacagagttgtctggagtttatggcattagctttgagcaacaggaaaagtagaatacaaaactgcaatacagaaactacaaaatttcaaggaaggactggctgagagaagccttgaggttggaggggaaggaatggcattgttgtgaaaacgtgttctgggaactgagcttaaattgaattgtaggaggctgcagtcccactggaaaatgcatactggcaccaagatgactgctgcttccaggaacatcctcccactccttagcaatgtggaacagattgaaggaagctcaaacaatccatttaagcaggaagtaaatagattaagagagcaaccagatggcctaaggcactatcggtatagctatccccacccctcagcgcccccatcagcttttccttccttgtttcttctcactgtctgaaagactactcaggcgtgcactgcgaggtggagatctgacttctcttgttcccgcttaagactgcctcctgtgtaagtttctgctatctagatctttgactaccaaccagccaggagtggtctgcctcttctttggtctgagcttgccttgtgcttatattgttgtacccaagcgagttaagaaaataccccacactttgagacgaattaagagtcctttagtaagccagtggccaaagagacggctaatgctcaaaattctctcggccccgaggaaggggcttgattaacttttatacctaggtttaggaaggggagggggactcaaatgcaataattctacagaagcaaaaacatgccttaaaagacaaatggttacaagaagagcaacggtaccaggtgcaaggttgtaaatctttcattgtaattagatatagggtctatgccggacacgaactcaaggttttatgttgttatctttttgagaaaaagcctgggaacttcatacattgttggtgttactaccttatcagttaattgggctcttttgaaacgctgaggatctgtttacccaggccaactccttactaaagggggttgggtaaggagcccttagtgtcttgtaaattaaggggtcaattggagtttgtccgaccttcccagctagagagagtcttatttacatgagaagcaaggctgggtgattaaagagacaagcaggacaaaattcaaagtaacgagttagagtaaaaacaaggttaggcatttcaatatagggtggttcttagtccagcagggcgttttcccgataaccacctgtttaactacattcacccttggtgcaagtgccaaaaaacaaacaaacaaacaaaaagaccaaggcgataggtatttgcaccataaacttctcccatcttttatgtccgtaattttgtgttatttcgcatttctgactgtttatagaattgaattggcctttaccttatcatataataatatactttaattttaatcacaaatacatatgttaagtagaacacaatctaggaaatacaagataatacagagaaaaatggaagtattggggaaaaggaaacagcacaaaaccaagtgtgacgaaaaagataaactttgacttctaatttcaactgagaatcaatggacaaaacatcaaagccattatctgaaatgcatggttccattcatgtgagagttggagagacaaatgttagtattccaaaaaagaaaataattcggtttaggctttgggaaaatcagattctgtgtcttaacagcaaaggtccagccccagcaggaagcatgagaacccaaacaatgcccttgtgctaatattgttaagtggagaatctgtaaagaaataatgaagaaaatgacattcacacaagcttaaaaggacatggatgttttgctaaagaaaaaaatatgtgtagaaattagtaaatcaaggaagtaattttgcttagcattcaagtgcatgggctttggaataaggtagatctggtttgaatttggctccaacactaactaggcgcctagtttttagaaaatagcttcaattactgctacacactggattatgttatctaaattcatatgatgaagccataacctcccagtgtgatgatatttgaaaacgaggcctttggtgggtagtttatgagggtggggtcctcataatgtgattagcacccttataagaagaggtatcagagagtgctctctctctctctcaacactaggtgaggaccctgcataaatatggctatgtgcaagccaggaagagggctcataccagaaactaagttggccatccttgatcttggaaccctcagcatccagaagacccaaatcaactaagatagtagtcttctctaaaaaggggaaactttgctgcatagagttgatttgcaaaacaagtgaacaatgcatatgccacagtctattgcatcatgaaaaaccagtgtgcaataggtctttttgttcttagcaaggtaaagacatttgcaatactgacaggagaaatgtcacctacaaatactctaaagtgtgaagtgacataaatgtttctgcacagctaaaactttggtatatgtggaacagtatggaaaatgaggccagaaaggtaaaatagtaagctgctttttgtcataaagagagaaatggaacactcattgttcaaaaataggtacataattgagagattttattcagaataatgcctgattaatataaatttagtcactgtaataatgtagctacataatttatatatatgtatatatattcgcacattttttgctttatcaggaatttttgtatattctactaatgacttttctgtatgatagcacaaattgcaattgttggccactgccacaaagtgggggaaaatgcacatttttaagcatttctttgcttcatctatgaaaatttcatctttgtggtatgaattatggagcattgtcctgagttgcccttataggtgaccgcagtttgtgtgttgtatgctggagtcccaattgaggacattactgcatataaaatgattataagtaaaaggcagaaaatgttctgaagggtcataacttccaagggttctctaccctttgacctctggattggggttcccagtgactgccttaatatccttctctacctactgccttaaggccaactcaatgtatccacgtaaagagtaccctaaagccagtaaaagattatcacgaacacccagagatgtttatggccatcattccagatcctctttgctttttcttgacttactccttttttgataaagttattcatatggtttcaaatccagaattcagctattcacttcatggccctagtttggattaaaacaatcagctttcttttgctctgtagatggccttggacagtacatattaacagtctatggggccccttttccactcatgaccacatcctgcttgcagatctgctgctgggttaacaccacatcatctgctagttgatgccatttatttgacatcctggggttacagcacgctaaagggcacccactgtccttaacagagaaaaatacactgctgagcagaggattaaacagactcctcacactaccggaagttcagtgcattttccaggattttcaagtcttcgatgctgtcatgttgagagtccactatccacgtttgtttatccaggaataatgcagaaaatctgagcattcgtgaatctaatcattgaggtaaagtaacctagtcatggtcaagaggacagctagtgttaaactccttcatataaatttaaggaaggatttacatattcataatgactttctgatctggaaagcccaggcttgtcagttattaataattggatgaatacttcaggtagtatttaaacaaatagcgatttcatagcagacatttccccaaccaggagatgcagtaaagtattggtagcaatagatgctcctaccaagatctcctcctgccactgccactctgtgcacaggaaaggaggggagaagaagccatgttgcttctcttatatttgagcatcatttaagggaatataagtctctaatgactcacatgtaagtctgctgggtaagaaagttctaatgttggaactcctttcagctatcgaattttgtaagaaaaaaaacttatttgtgtttatatacatttatgagatacaagtgtaatttcgttacatggatatatgccatattggtgaagtcagagatttcagtgtgcacatcacccgaaaaatgttaactgtacccattaaagtaatttctcatcccccatttcccctcaccacatgctccagcccttgccaggaaactgttcattttctctgactaacagaaacgaaagctaaaaacactggtgggaggagtctccacattgtttcctactccattttctctggggcaatagcagaataggagcaagccagcactagtcagctaactaagtgactcaaccaaggccttttttccttgttatctttgcagatacttcattttcttagcgtttctggagattacaacatcctgcggttccgtttctgggaactttactgatttatctcccccctcacacaaataagcattgattcctgcatttctgaagatctcaagatctggactactgttgaaaaaatttccagtgaggtgagtactgttcctgattttgtaaatatgatcttgttccttccttgaagtccccagaatcacaaggggacaatcagtattggttattcagggtcatgggatgatgggagtagggctgagtattcagaaaagtgaaaactgagttgcttgatatgaatccttcatttacttaggaagataacaggcatcttctattccaccacaactgaggactgaacaagagaaaatgcattttgaccgttgcagattttaaaattaattatccgagtgtatactggcataagttggtacttagaagagggcttctgttattttggctggaagaagtgttggaaactcggtagctgtggtgggttctcaagatagtgacatgaaaaaagtatcatgaaagaatattaagtaaaaaacatatctgagcatagagatgtattatatgacatcatcccaattttacaaaacataagaacaaatgtacacagagtagaaaatttttttcagtttcacaaacacagttactcaagcacatggtgtcttaatattttcataagtatattgatcctttactttagctccattctgcaccgggtgctagcggcagaatttcaatcattttggaattactctctgccctcctgaaagttaatgattttttttttccttgtggcaaggtataggggagtggaggggaaggcagttaggaaaaggttactattgtttacttttcaaatttttaaaagatgttttctatagcctggtacaatatttcatgtgtgcttaaatggaatgtgagattcttaaatgttgttttcagaattttattagataaatgttgttaattacgttgttcaaatttattatatcattacagattttttcaccttgttcatttagtaattgaagcataaactgaaatctcctattataaagtttgcttttttggccgggcacagaggttcatgcctgtaatcccagtactttgggggagaccaaggcgagcggatcacttgacgtcaggagttccagaccagcctggccagcatggcgaaaccctgtctctattaaaaatacaataattagccgggtatggtcatgtgtgcctgtaatcccagctactcaggagactgaggcaggagaatcgcttgaaccaggaggcagaggttgcagtgagccgagactgtgccactacactccagcctgggtgacagagcaaggctctgtctcaaaaaaaaaaaaaaattttttttctttgtagtgctctcacaatcacatacatgttatgtgtatatataatatacattcacacacaaatatatgtatatataatcatgtatacaaacaggtacacacatatatgtgtgtagtgatgtctgtacatgtgtgtatatgaagagaaatatatactaattatagtaccatgaagcactataaaataataaataatatcattagataaattagataaattcataactaaaacataattttctaggagttgaaacttttatcatgtggtatctgaagttacttttgggcttaaggtatatttaaaattacacaaacatagataaactggctttctttagttattccttgcaagataatttttaacaatttttttcaccttttgttaacaatatatatgtagatttcttaaatcaaatttgatgaaagttgtcacttaacaggtcagaccttttaggtatatgctggtaattaacaatctgctgtctttacttcaatttatgacacttctatatcatctcactatctaagacaattgctttagtgaattgtcatgttctttttcttccctccctttaccatgctgttgtaatttctgtttctcttatatttgatcagggttttctttgtaagacattaggaacacctaaaaaagtttatttttcactcttcttatcttttggctggcagaatttttaattttattcatgttttcctattaaatattattttcaatagatgttttcttgtggtatgagtctttgtcttgcaaaaagactgaggccctgagtatcacaaaatagtttttgagactcttctatttaaatatcattttgcctaaattaaaactctaaaatgtaaaattatattttcccttaagacaagatgaaagcacctcttctgtgctgtggagctagatacattttgaagttaagaatctggaggcttcagaaaggctatttagtgtatatattctaaatagtgtcttactagaaactccattgggatataaataattactccaaaatcaaaagcactaatattgcaaaacaaaacatgtgagtgttcacatttcagtgaaataaagattatacatagcctactgtcatcccaaatctggttttattttgcaaataaattgtgctgtcacacttgttggaaacaagtgctcagtgccacaaagaaaaaccagcacttaaacaggaaatttctcagcaaagcatatttgcttctacagaagggtgctgcctgcgtcagtcacaatgcacattctaagctgaccggattggctactgctttaaattctataggggtaattaggcgggaaggaagacactgtcctgtaccaattaggcgggaaggcatgtctggggcggcaaaggaaggaagggttgtttacagaacaggaaagaacaggaaagtttgaagacgaacttattgtttctagcacactcacaaaataagtcaaaactttccattgaaaattttttttggttttgcaattgatatggaactttggaccaacattatataaaaataactccattgtcctgcttcaggcagttttgatatagagattcactttcaatttgattcttgaatctttgtaggtgatctattcctcattaccgaaggcttacagagtatttttgttcattatattcttcagtttcactataatgtgtttttgtatagattttcccttcattctctggaccttttcagtccaaggatcctcatgttctcgtaagaaggaagcttttttttttttttttttttttttttgacggagtctcactctgtcacccaggctggagtgtagtggcacgatctccgctcactgcaacctccgtctcctgggttcaagcaattctcctgcctcagcctcccgagtagctgggactgcaagcgcttgccaccacacctggctaatttttggtatttttagtggaaacgaggtctcactgtgttagccaggatgcttttgatctccggaacttgtgattcgaccacctcggcctcccaacatgctggaattacaggcgtgagccactgcgcctggcccaattaatagcccctgaaatttagatatcttggttatacacaaagacatcattcctaaaattaaaaaattcattaatttaaaagttttggaatccataccttgcactgtcatcatggaagtgtacaggtgttaagaggtcaagagcagtgacactctgtccatagggagactctgaaatctaccatgagacaaagcctcagttgagtcttaaggttgtatgggaagtagtcaaagaaagaaatgtgggaatggctttccaggcagtaagaaggaactagcaaagtcatgaggcatgaagacacaaggtgtccggcatctttgtgaagcatagatacaaggagtacaaaggtactagaagtaaaaaagatgcagcttattcaacactttctgagacagtataggaagcaaggaattttggggaagaaaaaggagaaatattgaaggatttcagtggaatataaatgtggcttatcgagagaaaactgattgtgcgaaaagaaataattagacaaatcaagtctgaaagaagaaaaataaaacaaccaataaaatcatttcagtgaataaatactgtgatgctgcactagaaagcatgcagattttcagcaaagttatggttttatgggtacagagaacagaagccatggtctagcaccaaagaagggaggatgctaatgaaagccaactagggaagagtcaaggagaatagggtcagtgccacagcatgaaactgtagcgctgtagcagaaagttattcatataaggtgggaggctgcagcccatttacacctaggccgctccagtcatactgggtgtgggaagatttaagaaacaacaggcaggatttggggaataggcttcagccccagtaaaggataagaagaggaaccaagggctttgacactgcagagctcatactcttaacactgaggcaattgcttgttctcagacctccctctaacaactggacccaactcaactattctcattcaatgggaataatttcttagacattcctaacccagcagttcttcactcaatttctacagtaacacatttggtcgttgagtccttctttatcacacatattcatgaacaactctttcatatgggccactcactcacataggcatacatcttttaaattgtctgtatacatgtgtaacactgtatataccattttctcttgtaggctcacttatgtctgtaaagatgggaaaaaaatacaagaacattgttctactaaaaggattagaggtcatcaatgattatcattttagaatggttaagtccttactgagcaacgatttaaaacttaatttaaaaatgagagaagagtatgacaaaattcagattgctgacttgatggaagaaaagttccgaggtgatgctggtttgggcaaactaataaaaattttcgaagatataccaacgcttgaagacctggctgaaactcttaaaaaagaaaagttaaaaggtaattgggaagagggaacacccactccctgcaaccatccccaaaccctccccaacattgattagagccccacctcggacatacttgagatgtgttttccccagtttgtgactcaacagctgagacaatgttggtacttcagaggccaacaagttgacaacttagtgcattccattactggtgtagattgaagtatttcagaatgtatatttgggatcagtgaaagaacaaaagtgagagggagttgaagggggactgagacttccagtacattagaaagattatataataataaaatcataaaaactgtttaaattcaagatatgtacatttagccaatgaatgtatctgttctattgagaccatttaacccatcactaccctttataatttaaaaaaatgcaatacttacatgtgagcctgcctctcagaagtgtgatctcctctcttgttatatcaagttaaaaaaaaggatttgaaaaagtctaagtccaaaatcagtatatccttcctcatggaaacctttggctggtttctataatttgaatatctttacctggggaatgtgacctagcagtctccatcatgaaaacattagtttttaaaacaaaatgatcggagaaccgcattgggaaagggttaactgaagcacatggagttcagagaacaggaagcatgtgctcagtgcacaggggaggagtgaggaaagtgctgaggagcatgagtcagtgcttgttcctgtcttgtgactgctggtctccttaaggccaggctgggctaatgcagtagagctagactaaagcacagctgaaccctcaagcaggaactgagagcaaattgtattgaaactgcttcagctgtcggagatcgtttatatgtcttccttttttctgcattggttgggaataaaattgaatctattccagtaaaaggaccagccctatcaagaaagaggaagaaggaagtggatgctacttcacctgcaccctccacaagcagcactgtcaaaactgaaggagcagaggcaactcctggagctcaggtaagcttcaggaagaggagcaggcttcaagtcccacagaggaagctctgctacggctcttccactcaatctctccagcaggcagttatttcttcatgtttcccatcaagtttcagatttaccaaattgtatgataattgatcatcttattgatgctcaaagcaatgcaccaaacacatgagtaaacataatgtaaatatatataacataaatgtgataccttcattctagtagagtggagtgtcaacgtgagaatcaggtaagtactttgtccatgtgtataaaaacctagtttctctaatcccaagtcagcacatcccataacagaaataattagagaaataatgtgtataacattctcctctttcttcgtttaatgaaaccatctatgcccatctcttaaactggcgagagatgggcagcaacctctcaagtttccaagaaacatcttcttaggaataataaaactactatccaataatgaaaatgtgctctacttcatttggcactgaaaacgaataacaggaaaatcaaaccactttcagaaaagaaaaaaatcaaccaaagaaaaggctggacccaaagggagtaaggtgtccgaggaacagactcagcctccctctcctgcaggagccggcatgtccacagccatgggccgttccccatctcccaagacctcattgtcagctccacccaacagttcttcaactgaggtacactcttcctggtcccattttgctttgtttttttcaacccaaagtaaaggactgatttcaccggttacttaaaaattgcatcgataatttgctagttaatccaatgtacatattgagaaaccactacattttgatcttttgctttcacagggatacttgatgaacttgacattatctctgactgcaggaagttttctgttctgtgttgtttggggaagggagagagagctatgcagtacagaactgtcagctgtgggctcactgtctactgctcccatgtccttcatacctcttcccttggttcactatagtattccatgtcagacctctccagcacctgctagtttgtgaatgaggttatccataccctcagctctttttcttgtagattaaacaacctcccctgcattaaaactgttctatcgcagtttaaggagactgggatgttaaagagtaaagatgttaaagaaaaccctttctgagccccaggtttctgttagcatgctacctgctagagccctgacactgagaaaggctatggtggtgggaatgacactctgtagagtttctgcagcctgaacctactgagatgatggcattctgaggggtttatcctacttgtgttctcacctgctgtaagcaaactgaatcttgggtaggaacactatgaaatgtgctctttaaattgccctgtctacactggtgataactgaacactctttgtgtctatagtttgtggtgggcaccatttttcattttttttttatttttatttttttttagtatttattgatcattttaaatgtcatttaactttgtctatttttaggctctggcactttaagctggtaagagaaatagtataagaaattatttcattctaaaatttatttatttatttattgttgttgttgttgttgttgagacagagtctcgctctgtcacccaggctgaagtgccgtggcataatctcggctcactgcagcctccacctcccgggttcaagtgattctcctgcctcagcctcccaggtagctgggattacaagcgcctgccactacactcagctgatttttgtacttttagtagtgccagggtttcaccatgttggccaggctggtctcaaactcctgatctcaggtgatccacccgcctcggcgtttcaaagtgctgagattacaggtgtgagccaccgcgcctggccctaaaatttattaagttacttcatgacactggctttcagtatccactggtcttatgttgctcttatgctttatttcttaaggttgattctgtttacagaaaggtcatcttttcactatatggtctcctctgttacttcatcttgctattgtaccagtttaagatatcttctgccctggctcgcaatccctctctatcctgactccagctctaaacatctgtgcaagttttggggccctgtgttatactgaggtcactgaatagcagttctgtatttctcaattagacatttttctttgttctcctgtgctatcatacacagaacccgaaaacagtggccaaatgtcaggtaactcccagaagaaatgttctccaaaaacgcccagtgatagtgaaggtactgagtacaacaaagccatttgaatatgagaccccagaaatggagaaaaaaataatgtttcatgctacagtggctacacagacacagttcttccatgtgaaggttttaaacaccagcttgaaggagaaattcaatggaaagaaaatcatcatcatatcagattatttggaatatgatagtctcctagaggtcaatgaagaatctactgtatctgaagctggtcctaaccaaacgtttgaggttccaaataaaatcatcaacagagcaaaggaaactctgaagattgatattcttcacaaacaagcttcaggaaatattgtatatggggtatttatgctacataaggtaagtcctcaaaattgtttcgtttcatttttccaccaacacctgaaattaaaagtcttgatgtgtgagatgaagctttgcctataaactggatattagaatccaggactctgaagactaatgacaggtggataaagacttctctgaagataagactgggattaggggacctgttaatatttctttcccatgttctccttcccagagcattaaactgtagtctttacaataatgttcactgagaaaccttaagactttatcagttgttattatctatgctaagtgatcaaggacattgtgaggtctacatccatacacacatgatactaagtttatccctttgattattatctctactgtcataaaaatcacattatttttattttgaatgaagtattgtcctctgaggcttgagttctggttgtgacagtcagaataagaaataaattgactactcatggctggaaaacaaatgcagaaagtaggtaggacaatgttctgaccaaatgaaactaattcatcataaagaaatggaacaattgggaaatacgaatttggatgatacttggaaaatcaggtaatctaaatttgtcatttatatataaataacaaaaaaaaaaaatagagtacagagtgcttttcctgatatgttcctgtccaaattcataaccagttagcatgagacattccaccccgcaaaaaagcatctatcctctgctattgattcaagcaatttatctgatcaatacttcattacccattatatttgtttcctagaacaactcattaacctgcgttactttctgtacacagtcttttttttttttttgagacggagtctctgtcgcccaggttggagcgcagtggcgcgatctcggctcactgcaaccttcgcctcctgggttcaggcgattctcctgcctcagcttcccaagtagctgggactacaggcgtgtgccatcacgcctggctaaattttttgtatttttagtagagacggggtttcactatgttagccaggatggtcttggtctcctgacctcgtgatctgcccacctcggcctcccaaagtgctgggattacaggcatgagccattgcgcatggcctatatacacactcttaaagagatgattcttacaaatccagttctaggatgatgagtaatgagcaaaaagctggaatgtttgagctcaaggacttggtttcaggagggggtacaaatattggaagagactcagtaaatgcagaaagtagaaaaagtaattagagagttaccagaagcttgctttttcttacagattcctcataagtcactgaataaatagttgtagcagatatccattctttttgcatggggccagagacccagaaaggctatcagagatttcagcttcctctgtatcaaggtgctttgggaagcaaagctgccctgtaggtgaaagcagtagaaatttggaagaaaactcattgttctagaactgtcatagaaatatctcagatatgaaagacttaaacaaaaaggatattgagggacggctttctgcaaagatgtggcctaagatatgtgcatatctgtactaggagttgctgttgtgcatcttgtttaactctcttagaagggacttcagcctatatgtggttgttattaattacattctcaggaacagaatattaattttctgttacagaaaacagtaaatcagaagaccacaatctacgaaattcaggatgatagaggaaaaatggatgtagtggggacaggacaatgtcacaatatcccctgtgaagaaggagataagctccaacttttctgctttcgacttagaaaaaagaaccagatgtcaaaactgatttcagaaatgcatagttttatccaggtaagaattaaataggcaaatattagttttccaaagtggaaatgatttgctttaagttttggcaaaaacaagtttgtaggttttttttacagagttcagcgggaggcatgagaaaacagatattctccttgtattcacatttactttttttaattttttttttctggatggaatgatgtgataggatacaattttaaaaagaaagaaatctgaactttatcaaaaaaattgaactctgaattttatgtaaacttttaagtgattgtagggttgggatttaaaattacatgttctccatttgtgaattagaaaacgtcgtgtgtgtgtgtgtgtgtgtgtgtgatactttctagtttgtaacattacaatacacatatgtgtgtatttagtccataaaaatacctaatttgaaacttaaaattatttgcagtgatcaaaattatgtcccactgacaaagttttatacagaggaagctctccaatttgttaatttgaattcaaatattcacgtgttaagtttccttacagtacatgattttacgctgttgccattttgaatgttgtaaattattttttatttcagtaggtttttgggaaacaggtggtgcttcgttataggaataagttctttagtggtgatttctgactttttgatgcacccatcgtccaagcagcgtacactgtacccagtgtgtatgtagcattttatccctcacccccctcccactctttcccctgagtccccaaagtccattgtatcattcttatgcctttgtgtcctcatagcttacctcccacttatgagtgagaacatacaatgtttggttttcctctcctgagttacttcacttagaataatggtctccaattccatccgggttgctgtgaatgccgttattttgttcctttttatggatgagtaatagtattccacggtgtatacataccccatttctttatccatttgtttactgatgggcatctgggctggttccatatttttgcagttgtgaattgtgctgctgtaaacatgcatgtgcaatgatctttttttgtatactgacttcttttcctctgggtagatacccagtagtgggattgctggatcaaatggtagatctgctttttagttctttaaggaatctatacactgtttactatagtagttctactagtttacattcccaccagcggtgtagaagtgttccttttcaccacatcgatgccagcgtctgttttttaaaattttttgattatggccattcttgcacgagtaatgtggcatcattttgtggttttgatttgcatttccctgatcattagtgatgttgagcgtttttccttatgcttgttggccatttacatatcttcttttgagaattgtctattcatgtccttagcccttagcccttttttttttttttttttttttttttttttttttttttttttgagacagagtcttgctcttttgcccaggcgggagtgcagtggcgctatctcggcttactgcaagctccgcctcccgggttcacgccattctcctgcctcagcctccagagtagctgggactacaggcgcccgccaccgcccccggctaaattttttgtatttttagtagagacggggtttcaccgtgttagccaggttggtctcgatttcctgacctcgtgatccgcccgcctcggcctcccaaagtgctgggattacaggcgtgagccaccgtgcccggcccttagcccactttttgatgggattatttgtatgtgcaatgcttgttccctggtgccataaataaatagcatttgaatatcaatttaattttttcagcaaggccatttttatactttttgtagaaagggtacactcgccagcagttttgccacaagagtatacggaacaaaggagacaggctcatttataatctgacgcggccaccctcctgctgcgttcggtttccattggctgggacgggacctcaccttctgtatttgtcccgactggctagcacttagaactttttaaaagaggcaaaggcataggagaacaaaggaaggaggaagtaacttgtggaatattgagaaaggtaaaaacacctttaaataaggaagaggaacaggctatgacctaatgcttgcttggatcagtataagcatgttagggcaaatatttaggctaaattgtgggagctaagaacataaagtatattgattttttattatggctagcagatatttaagaatgtttgtacaggtctttgaataaattttgcttttaagagaagttactatttatttctaattagatggggaggaaagtttttgaagaggaacctctactttttacaatttcccctcatttcataattcttctttaaacttgtttaatatgttttgacttaatttttttttgtccttttaagagaagtaatttttcagaatagggtggaggagaattaggagttaactctgcaagagtggcagagataagtttttgtataaaatttcaaaggcagggaataatataacagcctacaagaataagtacaccaataacaagagcaaacgaggtgagaattgaagttaaattttttttttatccgctgaaccaatgttttattattttagaaaaagagttatttattttagaattgttggcaagtttatcggatagggctgttaatccttgtagcacttttgttatagttctatcaggggcagtattaggaataaaggtataacattgagttttaattatgacacaaacttctttttttgctaatattatatttaaagctattttatttttctagaccatctggctggtaggtcctaattgcttagctttctctttgatggcgtcctcagtgtaatttatgaatcgttgctgattatagtagatatagtttatttagtctacttaaaaaaaatttatagttacttaacagagcaacatggatttaaactctgcagctatttgattttgtgctttaaacttatttggcacttctcataggaccttaatagcatttatgtaaacctaacgtttaaaggactcatgaggagtttcctttggcctgcagtgtcttgtttttacctttttttttttaggttggtgaaatgccagggtgcaggggatagccagttggattagagcataagtactgctccaattatttggcagagtgtctagtaaaagtcctctacaatatcaccatacatttgcttggggatggctaagcgtggactgatgggcaagctcttggaaaggcttgagctccttgcatccttttatgcttctaaggaacaccaaattttactcttgccgtgagaggcacaaagtaaacttggcattcagaggtggaagcaggcttgccctcgggggcggacccccggggtattgagtttcaggaaataacagatagagagctcagcatgatggattatcctaaactgtgggattttgcaagagagccaccatatgtccatttctggtcaatgaggagaccgtccgagtggaaaggggataatctggccctctgggctaccatgcgtacaagcgtgataataatttttatttaaagtgcgaagggaatatttaattcattccagccaggcatttgcatcttgatattttgtcttaatggctaaggtctgtcttagatgtcttatttttacaatagacaacctagttttattattagatgtaggggcaactggtgtgggatctagaaccgaggctactgaagaaggggaagatgggggaataatgcgtgttttaaaaacacctagggggtctttttcatttatgtcaatccccatgccatctaagcgaccaagggcaggtctagagttagttaaggtggaggtggtgataaagagaaggacagagttacattgataagggctgacagttagaaggggtagcccttttggtgaaatagatgaagggttttagatctgcacaaaccttttttgtggaagtctaactttgctcttgagtagtttaaaggatgtagtcccatttactacaaggttgccaggctgtaggagcagaaaatcgatgccttggctgcaggtgctcacaatgatgagtgctacgggtaattgtgtcaattagagggccgggacataaatatttgtgtgaaaaggctagctgtcgttaatctttttttatttccacaaagtatgagaaaacaagcattaaagacaatggtctaaggtgagttagacttagttatatttataacaaaggagctaataacaaaagaaaaaaatatataaaagatgtattaaaatgaagctttctttaacttagaagggcttaatcttagtacagtaacccataattctaacgaagaagatgttttcttgactcaaatatgatgggtccattctttctcagctgtgcggacggcggtctcagtggttaatacataaaatagggtccttcccaggctcgagtttttttttttaatcttttttcatcttttaataagaacatggttttcaggctggtgctggtgtactggaaattctaggggtggtacctgtgctaaaagacttttagttctgagggaaaagaaagtggaaaataagcatataatttttgttgcatatcctggggcttgaagccccatggtgacgcctcccgctccattcctgctcagcgccgcccaagggatgctgtggccctggcccctcttgaagtcttggccttcttgtggccttcaccacccccgcgtgctatggccttggggatgaggggcattgtgacttacctggccaccctcgggacttaaaaaaaaataaacaccattttatatttgactattttttgtataattttatactaaataagttaaattttacctttatattaatgtgctattaatgttaaatttaattttagtaaaatattgtagacattatttatccaattttaatgtctgaccataaagtaaaacttttatagactcattttaattttttatatttgtttttttcttgatgatttgcttgagttcctcatagattctggatattagtcctttgtcagatgcatagtttgtgaatattttctcccactctgtgggttgtctgtttactgattatttcccttgctacgcagaagctttttagcttaattaagttccatctattcatctttgtttttgttgcatttgcttttgggttcttagtcctgaagtctctgcctaagccactctctagaaggtttttccgatattatcttctagaatctttatggtttctggtcttagatttaagttcttgatccatcttgagttgatttttgtataaggtgagagatgaggatccagtttcattcttctacttgtagcttgccaattatcccagcaccatttgttgaataggatgtcctttccccactttgtgtttttgtttgctttgtcaaagatcagttggctgtaagtatttgggtttatttttgggttctctattctgttccattggtctatatgcctatttttatacccagaaccatgctattttggtgactatggccttatagtatactttgaagtcaggtaatatgatgcttcctgatttcttccttttgttctttttccttagttttgctttggctatgtggtctgttttttggttccatatgaattttaggatttttttttctagttctgtgaagaatgatgttggtatttggatgggaattgcattgaatttgtagattgcttttggcagtatggtcattttctttatttctttcttttttttttttttttgagacgaagtctcgctcttgtcccccaggcctggagtgcaatggcgcgatcttggctcactgcaacctctgtctcccgggttcaagcgattctcctgcctcagcctctcgagtagctgggattacaggtgcttgccaccacgcctggctaatttttgtatctttagtagagatggggtttcaccgtgctggccaggctggtctcaaactcctgacctcaggtgatccacctggcttggcctcccaaagtgctaagattacaggtgtgagccactgcgcccggccaatatggtcattttcacgatattgattctacccatccccgagcataggatgtgtttccatttgtttgcgtcgtctatgatttctttcagcagtgtttttagttttcctttagaggtctttcacctccttggttagatatattcctaagtgttttattttatttattttattatttgcagctattgtgaaaatggttgagttcttgatttcattcttagcttggttgctggccgtgtatagcagagctactgattttcatgctttaattttgtatcctgaaactttgcttgaaactttgctgaattcatttaccaattctaggagctttttgaatgagtctttagggttttctaggtatacaatcatatcatcagcaaacagcaacagtttgacttcctctttgccgatttggatttcctttatttcttttgtctgattacctggctaggacttccattactatgttgaatagaagtggtgagagtaggcatccttgtcttgttccagtgcttagggggaatgctttcaatttttccctgaccagtataatgttgtctgtgggtttgtcatagacggcttttattaccttaaggtatatcacttctatgccaatattgctgagggttttaatcataaagtgatgctggattttgtcaaatgctttttttttgcgtctacttagatgatccggtgatttttgtttttaattatatttgtgtggtatatcacatttattgacttgtgtatgttaaaccatccctgcgtccctggtatgaaaccgacttgatcatggtgcattatcttgacatgctgttggattctgttagctagtattttgttgaagatttttgcatctatgttcatcagggatattggtctgtagtttttttgttgttgttgttatgtcctttcctgcttttggtattagggtgatactggcttcatagaatgatttagggaggattctctctttctctatcttgtgaaataatgtcaataagactggtaccaattattctttgaatgtctgatagaatttagctgtgattccatctggtcctgggcttttctttattggaaattattttttattaccatttcaatatcactgcttattatcactctgttcagagtttctatatcttcctggtttaacccaggagggttgtatattttcaggttttctactttatgcacataaagatgttcatagttgcattgaatgatcttttgtatttgtgtgatatcagttgtaatatttatcattttgtttttaattgaacttattttgatcttctctcttcttttctttgataatttcactaacggtctatgagttttgtttattttttcaaagaaccagctttatgtttcatttatcttttgtgttgttctttgtctgtcacaatttcatttagttctgctttgatctttgttatttcttttcttctgctgcattcgtgtttggtttgttcttgtttctctggttccttgagatgtgaccctagattatctatttgtactctttcagactttttgatgtaggcatttaatgctatgaactttcttcttagcatcacctttgttgtatctcagaggttttataggttgtttctctattatcattcatttcaaagaattttttagtttccattttgatttcattattgactctatgatcatacgggagcaggttatttaatttccatgtatttgcatggttttaaggttgcttacagttgagttccaattttattccactgtagtctgagagagtacttgatataatttcaattttttttttaaatttttgagacttgttttgtggcctattatatggcctatcttggagaatgttccatgtgctgatgaaaagaatgtatattctgcagttgttgggtagaatgttctgtaaatatctgttaagtccatttgttgtagggtatagtttaagtccaaaaatttttgtttgttgactttctgtcttgttggactgtctagtgctttcagtggagtattgaagtcaaccagtattattgtgttgccatctgtcttatttcttaggttcagtagtaattgttttataaatttgggagctccagtgttaggattgtgacattttcctattggactagttcttttagcattatgtaatgtccctttttgtcttttttaactgctgttgctttaaagtttgttttttggtgtccatttgcatagtatatctttttctacccctttaccttatgtttatatgaaaccttatgtttatgtgaggccttatgtgttaggtgagtctcttaaagacagtaaacacttggttggtgaattcttattcattttgctgttctgtatgctttaagtggagcattttggccatttatattcaatgttagtattgagatgtgaggtcctattttattcatcatgccatttgctgcctaaataccttacttttttattactgtgttattgttttataagtcctatgagatttatgctttaaatgttttatgttctattttggtgtatttcgaggattcatttcaagatttagagctctttttagcagttcttgtaatgctggcttggtagtggctaactctctcagcatttgtttgtctgaaagagacttgatctttcatttatgaagcttagttcactggatacacattctcggctgataattgttttgtttaaggaggctaaagatagtactccaaacctttctagcttgtaggatttctgttgagaaatctgcttttaatctgataggttcctttataaattacctgatactttgcttcacagctcttaaaattcttttctccgtcttgactttagagagcctggtgactatgtgcctaggcgatgatctttctccagggtgttccccgggtgttctttgagcttctcgtatttggatgtctagatctctaggaaagccagggaagttttcctcaattaatccctcaaatatgtttttcaaacctttagatttgtcttcttcctcgggaacaccagttattcttaggtttggttgtttaacataatcccaaacttcttggaggctttgttcagttttttttttttttttttgagacacactttagctcttgttgcccaggctggagtgcaatggggcgatctcggaacactgcaacctccacctcccaggttcaagcaattctcctggcttagcctcccaagtagctgggattacaggtgcctgccaccacgcccagctaattttttgtatttttagtagagccagggtttcactatgttggccaggctggtctcatactcctgacctcaggcgatccacctgcctcagcctcccaaagtgctgggattacaggcatgagccaccatgcccggcagctttgttcatttttaattcatttttcttcatctttgtcagattgagttaattcacaagccttgtcttcaagctctgaagttctttcttctacttgtttgattctattgctaagactttccagtgtgttttgcatttctccaagtgtgttcttcatttccagaagttgtgatttttttttatgctctctatttttttggagatttttccatccatatcctgtaacattttttaaatttctttaagttggtattcatccttctctggtgcctccttgggtagtttaataatccaccttctgaattcttttctggcaattcagagatttcttcttgggttggatccactgctggtaaggtagtgtgatcttttggggctgttaaagaaccttgttttgacatattaccaggattgtttttcttcttccttctcatttgggtacactatatcagaggaaacatctgggactcaagggctgctgttaggattttttttgtcccacagggtgctcccttgatgtggtgctctcccccttctccaaaggatggggcttcctgagagctgaactacagtgattgtcaacacccagcagagctactgtgctccaggctccaggctggtactgggtagtgtctgcaaagagtcctgtgatgtggttcgtcttcaggtctcatccatggatatcagtacctgctcctgtggaggtggcagggcagtgaagtgaactccatgagggtccttggttttaattttgtttattgggataattttgtgttggttgtcctccagccaggaggtggagcttttaagagagcatcagctgcaatagtatagggaggatacaagcttgccctagggtcacttgaaataggatttgagtttctcaggtggtgggtgggggggccacagagctcccaagagattatgtcctttgtcttctggctaccagggcaggtagagaaagaccatcaggtgggggcagggttaggtgtgtctgagctcagattccccttggacagggaaagctgatgctgctgtgggggatggggtgtgattctcaggccaatggaggtatattcccaagggaattatggctgcctctgctgtgtcatgcaagttgccaggcaagttggggaaagctggtagttacaggcctcatccagttcccacacagcctgaaaggccagtctcactcccaccatcacccaccaacaacgctgagtttatttccaggcagcaagtgagcagagctgagaacttgctaccagcctccctgctgagaaagcaagcagggttttcagagttcaagcctccctgcctgctgtggcttctgtgctggtgtctgcactcccagatcacccccacccctgggttctgtccaggaaattttgtgttcggtcgaaacttcagctggaagttttcttctccctgtggtatttccccaattctactggcagccctcctgaaggacctttgtgagacaaagtcagtaatggcttccctggggactgagagagcccatagggctcttcccgctgcttcctctacccctgtatttcgctcagctctctaaattcaccttagctccaggtaaggtcaaatccttcacttgtgatccagaccttcaggttccccagtgaggatgtatgttcatgggtggatgatcccctttcacactttcacactttgggcactcacagtttttctgctgtctcctggagcctgcagcagcagtccgctttttttcaaacgtgccattttgaatattccactcacatttaaatggaaaagcctattaagatatattaggagaatgatgttcctcataggcttcaaaaggatataaaactcgtggtaaataataaaatatttgaagaaattaggagggtggggaaccaatataatgcagtggccaaaagcaaggactttggaataggaaagacttgttctacatctggcacattagtttcctgatattgggaaaaatagcttttaaatatttctcataagattggtttaaaaattaaatgagataatggaaaaatatttcttattccattgccttgtacattatgggaaatcaatgtgcaataggtcctattgctcttagcaagataaagacaaacactggaaagatttctagggagagaaaatgtcacatgcaaatgttaaaatgtgaaacagcatagtgagttctgtataaattggtatatgtagaaaggtataggaaaatgatgcaagacaggtaaaaagcagccctccaacaagctggcttttgtcataaagacagaaatggagtctccaatgtaaaaacatcagtaagtagatattgaaagattttaggaagaagagtacttgatcattccacattttagcaaaaaaaatattctgacaattgcctggagggatacattagagagagaccatgtttggaagtaatgagacctattaaaatctaataaaggatgatattctcacaaatgaaaagatgttgtgcttcctctaatattgaaaaccattaaacagaaaatgaatactttcagataaagaaaaaaacaaacccgagaaacaatgaccccaagagcatgaagctaccccaggaacagcgtcagcttccatatccttcagaggccagcacaaccttccctgagagccatcttcggactcctcagatgccaccaacaactccatccagcagtttcttcaccaaggtacaatttcctgggtcccatgcctcatgtctccccaccataatttacagggatcattagactgttgaaagagctactgctgtaatctctgtgaatggattggtacaatcttggtatgaaattatgtcactcaatcatttattgaattcatacagtgagatagcaccacatcataatctttactatctaaaaggcattcatttatataatgatttctaactttaagaggattactatcttgtattgctccagttgtagagagggtaagagagagtggccagacaagcagagacgaaaacaagaatgcgttcagatcctacattcccgtttcttttacccatttcccctttgcttattagtaatatttctgattttattttcatagttccaagttcctacccccattacatattttgacacatggtgttttcttgatgggtatctgtttctcctatgtcatcactggtgagaatctccttaaattttacatgccaacttaaatgttttcctctggcaagttctcgctgatacaagatactggaactgatgagtcctcccattctttgctttcacagggtctcctgtcaatgagattaaattactaatttcatagaagtgaacagagagacttactttataatgtgttccccatacttccttgatctgaggttttccttaacagggtcagcatagctcaggttatatctgtagaccagagcaaacctacaaattcagcttagaacatggaacaacaatgacaataattatatttccactttttgagcacttaactagacgttggttcttacgtgttgttcctgatgtacgttatctcattctttcttcataaccatcaggaggatgctaattctgccccaattcacagagaagaaaatagaggtacagaaaggttaaaaatcttcctcaagctttcaaagaaaattagagtcatgattcatatccagtcttatttaaacctaaaacgtgaaaaattaatgattatatatggctttagattaggagtttatatatgccatgtcagtaatttatttattagtcacgtaacagttacatagcccacgctttgcaaaccttctgataacaaatgtggccagtggtgatcagagtgtgttctaataagtaaaccaccctccagaagtagaatcctttcattcgcctctctaacagagtgcattttctatattaaatatctgaatgacagaagtggtagaactatggaaattaaactaatattaataaataacaaaaaaggttaaaaatagtcaaaataaaggaagttatacttccttgcccttggtaaagagtatttttaaaaaatcacttacttggtaatgccaaggtaagttcttcaatatttctaaatacatttgagaaccttgaaggattctagctggctgatgcagactacaaaacagcagaattctgcatctggaattgtggattttaaagaatctttctagcaaagtgatgatcaaaacatctaaagcaacataaggctgggtttcctggagcctgaagagctgcaggaaagagaaagagtaatttaatcaagtaaaatgtatgtgattaaatttctcactattaattaagtatattcattgagaccctactagtctctgtgtcttttgatatttacaaggtatgcgttcatgaagtgcttcctgactcaagaggattactgtcttttgttgatccaggtgtagagagagattgtggggaagtagccagatggaggaagatgaatacaagaatatgttcattatctttattccaattacctttcatcctttcacttcgttcatgaccacattccaggttttattttaaaatatcgatggtcttttccaaatgagaagctttgacatatagattgcttcctttgctgggatcactttctccagtctcttcttgaacccaactctccacaggccccagcctaaatcccttcctagagcaagtcctcactggcaaccacgtttcagattaggtgagatcctcccatagttggttctctctggtcctccctttgtgagctttcctagctccctttatttttcctaatagcatttaaacaattggggtgtgggagtaattttctccttttatataccataagctcagatggtaggtagcgtctaccccagaggaacagaatacaagaggggaaaaagtcagttcatgctatgtgcatcaattcttattccagattaccttttgctcagcagtgatatgacccttgtagtcacctgcactgagggttcggaagcctgtacctgtggtgaaggggcaggaaacttggaggaaaagcagaaggattaaatcattattttttacagttgcttcttacccaagccccaagctgtattctgacccagcagcagatacctccagccaccatgtacacatcctggaagagaagcttcctatatttaaggattctctattttgatttttttttggtttgttttcattgttgtaatttttagctagcttcagaaagctgtatttccctccatagtttatgcaggtgttatttgaagaacagaacctgtgtctttttgccatcttggcacaggtggctgtggaaggagcccttgctcagtcattgcaacctaagatccattttctttgtgccttttcagtgactaaagtggcatctccaaacaactatgcttttatcactcatatttctttgaaaggattatgtgagaatttctaagtcccacctgctaaaatatgaatcacaacccttgctacagctgtacaaatgattgtgctgtatgtgaacttccctggagcacaggaatcccaggaggattatatgccttcatggcctcatgcacctaaacacactacgcagccatttattcttgggtgtccactatcgtctgtaaatacagttgtctgtctaactactttcctagtgactcgcaggtgagtatagtcttgttccactgatcatagggtttcccaaagattttctctatggtatacgctctatattcattgagatttaaaacaaacaggctattcttatcattgatttttttttttctgttctgtacacctaaagcaagaaacataaattgacatgaatcaggagcagggatgggaggggagataattgctctaagaaaaaaaattacatagtgatttaaaatattattcaaccaaagattacatttctctcatctaaattctactctggttatgggactgttttacttaaatgaatttgagaagataatactccaaggtactctcgtgaataagtggcagaaatgaatagagaagtctctttaataaaaagcttcccataccaactcgatctagggtttctgtcaacaaggtaaacagaatatgagacggcagttaatcagaacacacatacaaatccctgcagagacagtgtaacaacagtgacataaatcggatttctacttcgtaagcacttactaggtgctggttttaaaacctgtattctttatgtatattgttgcattctttcctcataacagtcatgattgatgctattctcagcctcattttacataagagacaaccaagataaatacagttttaaaatatttctcaaaattcacaaagacagtgagtgtgctaaatgtaaattatgtgcactttatgtagtttttcttattcattcttccttacatcacccagatgatgttattgtcagtcacatttcacatttctaaacaccaaggatcttagaggttaaaactttactcaagctgataatgatttttagtgttagagccaagattcaaatccagccttaatgaactctaaagcttgagcatttaatgatcatatactgcttccaaagtcagaatatagatgttgaactgtctcatatatttacacatatttaaaattagacattgtttttgtttgggtttgttttcataatctagtctctgcaaggctcctaatgaaaaatcaggtgctgtaagtctctgtatcatcctatgttttacattgccacgttaagacccctgtgttcatctgcacccaataatcagatgctgtatcttcagtgtaagtcaaaagaaaaactagatgacaattttccaagttagtgtctcatctaggtgccaactgcactgtgaccacacagttttctaatcactcatccatgtgtaccagttgaagacaggcctcccatgtacagagttctcaatttttcatgttgttttgttgttgttattgtcctgtttgactggtaaattccaaaattctatactttctaagagttttatatgtcgtatagagctacctatcatgactgtttgccatcttgcttcaggtggatagacagaggctatgcctagtgaagtcattatctgctctgatcttctctgctatttcaaggacaaaattggacatcccaggacagtcagttttctgacgcataatgacttgaaagaaagttaatgacagtttcaaagttcccaattgcctaaatatgtgatacagcaatttctgcagccataggaatcattatgctgtgcctaaagaccctaggacagggattctagaaagaggcacgtgtctccatggccgccgatgcttaataacacagtgcattacttctgctttggtgaccagcccaaaggttgtctcaccactcactctaagattcaccagctgagcaggaaagccttgtccttactcatcatggtttctcccgaagattttgtatatgatatgcgttcattgtgcttttggattcaaaacctgaagaagacagaagcatgactttaagtcacgactcctctaaagcatagatcatataatgcctgaatcatgatcgggtatggtagcagggattatttactatgagaaaaacaatcagctactatattaaaatattactcaacgaaatctacaatctgctgaaatccaaattctgatcatctaaattctgctgaaataatgagaatatttgtttcaacttattttgaaaagaaaattactcaagacagttttatcaatgctattaggctgccacattgtagaagggaataaagaggcttttttgataatcttcctataccccctcaatcaggagctccctacaactgggtcaacataaagcattaaatatctttaaatagggcagacattaaaaaaaatgcacagaacataaaataacaataaaaatattgttctgcttattgaggatttattggatgctggtctgtaaaaactgtgtttgttacaaaattatgccatatattcgtcattgtatctccataaagataaaattttcatctcatttcacatatgagattcatgagatacaaagaggttaaaaataccattcaggctaataaaaataattagtgttagagtaaggattcatatctagttttagtcaagtaaaaaactttggtaatcatgcaaatatgtttcttccagtatgggacagtatatattaaaattctgtcatatatccataaatattcatatatgtagtgttgaattttgcatttgttttcataatccagatgccacaagccataataaggtgcataacgggcctatagggttgggtgttcgaaaccataacaagcaggttttatagcccttttttcaatctatttaaagaccagagaaatatattttatagacgggtctctatatattggagatgggtctcactctgtcacctaggctggagtgcagtggcgcaatcaaagctcactgcaacctcagacacctgagctcaagggatcctcctgcctcagcctctcaagtagatgggactaaaggtgcacgctaccaggcctggctaattttttaaaatgttttgtagagatgaggtctcgctatattgcccaggctgatcttgaactcttggcctcaagtgattctcctgcctcagcctcctgagttgctggggttacatgcacaagccactgcatgcagcttaaatgttcttaaagtctttcattagtgacattaggggaagtcacacatgattttccagacaccctctatcctttctttaacaaggtataaaaagacaggtgctgggaatgccctagtgcaatttggaatgatcctaattactgttgggaatcctgaaggattctgaatatctgatgcacacacaccacaggaccaacagaatcccgcccctggaactgtgctttcagggaatgcttccagcaaagggaggatcagtatgcccaaacagccaacacgtgagtttcctggaacctgaagtgcaaattacaggagtcagtttgtgtatttgcttgatgagaatggcttctatcactttggttaatgttgttctaaaatttgctgcccttataaactgagagggttatttaacaaaaataacctcaatggaggggcttaaccaagttggcctagatggattttcagcagaaatagagccaggactcaatcacacaccaataaaatttcaaccaacaggatgaaggctataatactggtttgtgagtgtacagttgaaggagttaggatatctaaattgacactcttcttccatagaaaataccagagagatgacagtgagaacagaataaaaggaaaaataagaaaaccaaacctatatagatacagacatggatacattaggtttttgtttgtttgtttgagatagagtctcgctgtcacccaggatggagtgcagtggcataatctcagctcactgcaacctgtgcctcccgggttcaggtgattatcctgcctcagcctcccaagtagctgggactacaggtgtgcaccaccatgccaggccaatttttgtatttttagtagagacggggtttaaccatgttggccagactggtcttgaactcctcacctcaggcaatcctcccgcctcggcctcccaaagtgttgggattacaggtgtgagccactgtgcctggccgggttctatctcattccgaaaaccacaagacagaaaagactcaatcttttcctgagaacctggaggccagaatcaccccagttgatgacttcaatagaataaagtcttctcaagacttgaaactgcatctgcaaacttctggcttcagaaaacctccaggagtgagccatcctcagacttcacagaaaattacataaaccccatccagccatttcttagccaaatcactagcttactattatcatcctttgtgcctcttcaaaggtgtatttgcattgtataatgcaataggaaccattgctgaagaggtacaaattagtacagacattttgaaaaccaatttggtgctatcttaaacctgaaaacatgcatactttaccaatgctgcaaatccaactgggcatatgaataaataaaatgtatacaaatagtcacagcagcatcatgtgaactggaaaaatcttggaagaacccatgacgtatgtcaagagaatgggtaaattagggaacatgatgttgaattgaaattaaataagctgcagatgcatgcatcacagatgcatatgaggcatataataattggaaaaagcaaatcacagtaaattttaaatagtataataacatttttgtaagctctgaaactaataaaactaaatatcatattgcttaagaataaatgccttgtgtggtaaaagctatttttagagctattcatcatgattcaagactgtccttacctctgggagctaaagctgatagaggatgagttcagagagaagcatgttgttaatcttttctttcttaaattgtttgagtgttttcatagctactcatgctacgaagtatgtagttttaaacactgaacaaaaagttttatgttctaaatttagaaatatactcctttcaataagattccattaatacatgtggcatacttaaatagagaaacatttttaatgaaacgattttcatctcaccttgatctggggtatccatcaacagagtcaacataaagcatggaaaatgtgtgcatcaggcagaaattcaaatcctgcacaggccattattaacaatggcaataattatatttttgcttgttgggcatttactagggtctaggctctaaacttattagctatgtatattatgtaacttattcttcattacaaccccataaatatgatattgtcagtctcaattcacatatgagaacactagcgttcatagttttggaataatgtttctaccagtgtgagagagaagatttaaattgtctccagtatatttacatgtgtgtgtacactaacatttcagaatagacagtgtcaggcttgggtttgtttaatagcctgaactctgcagcctttcagtgatggaggaggtccacgagagtggccagaggctgttctcatcagagagccacagcactgcagcaggctcctgcagccctctcacctaccactttttcagctaacggtgcgatagaattatattagtgaaagccagaagtgagaaaaacagtgacaaatggacatcacatgtaaatggttagaaatgggttttcactattataattaatggtattcaaagtatatgattttgcagacactctctgtcctcacttgaacaaagtgtaagaagccagctactgggaattccccaggtggaacgtggaacccctgtgattacgattgagaatcttgacgatttcagtttgcctcatatagacagcaagggcaacataatcctgactctggaactgtagctttgagaggatcctcgcagcaaagatcagtttgctgaacaaaaagatggagaggttggtgtactagagcctgaagagcagataactattacctgtatgtgtactcatttgatgagacaggtttacttataaatactcctcagtttggctgattttactctgagtcatgcccccctcatcaccaggaagagttatctaccagaaaatgacattaagtggtctcagatcagcatacaacacagatagatccaagaatctaaggccagtgaaagaaacttcagtcatctgaatcttgaccatttcagactgaagactataatcctggtcctgtgtaggctgaaatgtgggctgaggaaactaaagttatgtcagtatctagacacattagcagagggaagagcctataaaaagggggattttgaaaaaatcatatatggagcccatacctactcgttaatagttcagacccatttttttgtcttctacttcaaagacgtaagtgaatattcctggaaaattctgatttctcctacatactggcttaaaagggacatgtgatgttttcttagctccaacccttctaaataagcaatgtgtccatttctgtagccataggagttattctgctgcacctaaacctcccttagcttagtaatctcagccaggatcatatgtcttctacctccggtacagccattttccctctggtgtccagccagccccataggaggcaaaacctgtctgactaccctctatatgatccagtagctctgcaggaaagctttattcttattgatgataggttctctcacaaattttgtgtgtgatatggattattcctggttttgattggaaacccaaagcataacaattttatatttgatatcttctgccatgtctcccttaaaataaacaacaaaatgatttgaattatgaataggaataattgctattttttcctgaataataaatcccccagtattactataccaatgtgttcatcctctatattccagtttctttgcgatcctttctcctttgctctctcaccatacatcagagttcagtttccgtatccatgctcttaaccacatcgggggtttggatacttcttttgatgtcaattttttccatctcagttctgtccccagatatcttcaaccacaaggtaccagtctaatctattccttgagcaagttctcactaataccctcctcccagaatagatcatattttctcattgtttgccttcataggtacctttctatttctttagagcatttatcatagctataataaacctatgactttcttccctactcagcaataaatgtagattatagataccctttcctaggggaagacaacacaggggtgggaaagtgagtttacacttgtgtgttgtcaacacttacccagcttgccttttgttctgccctgatatcaccccctgtgttacctacaatccagcgttatggggcctatacccaaggcaaatgggcagggaaggtatgggcagggaaatactgacccatggcaacttgagggatagggaacactaagatttacattattattctccaatatcatttctcacccaagccccaagctgcccccggcccaggttgcagacctgagcaccatcacacatgtcagttgaggacaggctttctacatgtgggttttctcaattttttagacagtcatttttttggttattaatttcaagatttcatatttccccctatatagtctttcctggttcttcttgggcagaactagctgcttgtaactgttgccatcttgggacttaccatcaaggccacaggtagagcccatgtgtagtcatgaaaatctcaggcccactgtctctctgttactgcaatgacatacatagacatcataagacaactactctgtccatgcatactggcttggaagtgacactttctaagaccttgcctgcctaaatatgcagcacaatcatttctacttgcataggaatcattctgctgctctgaaagcacaagatccaaggcagactcatccacctaaacatacaccacgtagtcatttcttctctgggatccagccatcttcacaggaggcctgcaaaaatggtgtctgaccaatcagtctgtgattcgcaacgtaagccgggaatccttgctcttatacatcacagcttctcccaagtagtttttctataatagagttctttctgactttttaattcaaagccggaaacagactattacctttgatttatgctgttacgtatcctgaagtgaacagtacacaagggcataattcatgaacagggtagggtagaggaggatttattctgagggaaaacaaatgcttgcacttttaaaatattattcaaacaaagattataatttcatcatccaaactgggctattgtgatgacagtttaagatttcacttatttttaaaagattatatctcaagacaatcttgtcaataaaattacattgctacacatggcagatctgaagagaggggcttctctcctattatgcttcctatattacctccatacaaggtttccatcaacaagggcatcataaagcatgaaatatctgttcaccggagcagacatgcaaacccctaatagatcgtggaaaaataatagcaacaaagatttatttattgagcatttactgagctctggactctaaaacccattctttgtgcacattacctaaattattctttataacaccataaaaaaatgctatggctagtcccatctcacatgtgggaaaactgaggtgcaaagaaatcttcctcagggtcacacagatagtattagagtcaggattcaaatgcagccttattgaacttaaaatgttaacatttaaaatgtgaacctttaatgagcatagattgaatccacagtaggtgtgcaaatgttaaaatgtctgcagtttatttttaaacaattttgaaaatacagtgttttgtttggggtttatttccatagtccaggtgctcagtggtggtcagagactgttctaatcaagaagctgttctccatgtgagctcactacaagcagttcttttgtgtacctctctatcaacaattgccacttaaaaaattaggttactgaatgggaaaactgctaaaataatgtgccacattggccaaataggatgaatattttttggacttccattggtttaattaaaagtagtcaaggtatgtgattttagagatattccccaattttacttgaaaaatgtataaaaatatagctaatgggaatgctttaggtggaatattaaattcttctgaatacagctaaaaactctgaaagattctgattgcctgatccatactgtagtgatcatagaaccttccctgaggaattgtgaatttgagagaatcttcttattatggctatgatcagagatccctaaaggatggagatctgggtttcttgtatgctgaagagcacttgagagagactggtttgtgtatctaattgatgagaaaggcctagttaataaatgtccataaatgtagccaactttattgcaagccatgctgcccccaaaatagccctaagagttgtacctgaccaaataactcagtccagttttacaggacgtgaagactgagtattccatccccagacaatgcaatttcagttatctgagtttttaatcctgactgggatgagagaaggctgagtgatagaagtatctgaatatgtggtattattcctcctgcaactcagggaaaaacagagaaactggcaaagtgaacatcctatttaaaaaagaaaaaaggaaaagatgtgtttcatctgatcttgaaaaacattaactagaaaaaaagaacaaacatctattttcctttagaaaagtgaagacacaatctccaaaatgaatgacttcatgaggatgcagatactgaaggaagggagtcattttccaggaccgttcatgaccagcataggcccagctgagagccatccccacactcctcagatgcctccatcaacaccaagcagcagtttcttaaccacggtacaagttccctcttcccaatacattcccctcactacaatgtaatgacaaggattaacacaaccttgaaagcacctcaccaatcccctactacatacaatgctttaatttaaccaaatcagtcatttatttatcaagtgtgtattttgaggtcctatccaaaattaaaattctatttttatcatctctattccatagcaggtataattagatatctttttaattttattttccttttggcttacctttttgtttttccctcaatacaccacgaaaataatactttaaggtagaacaaggtgggaaaaaacagagccaaccataacactatcactgattctttctctttcatttattataactcaaataataccatctttaaaaatttaggaaaagaaggtacataagcaaaaataattaatttttaactatcagaaatctttatctaatgccacatttcagtacatggtctttctgactttacacctttcattatgtatatacaaagagtcttattatattctctcagagtaaatcacattacgcatatttttctataactcatgctttttattaatatatcttgaactgccattcaaccatacaatatagatttaaattactttattgtaccagaaaaattgcatggttattccatacattataaaatgatcctacgttatttggcttatgttgtttctagtattctgtgaatttacaatgaacatagtaagaacaaatgtctctcagatcttctttcattaccctcagagtagctttataattatttccttaggtcctgtgcaccttgtgtcagggtactaatgtcatggctattgtaaggtgatttgatactgattaacttcattgggaacgggtttcctaatgttatggaaaattggccacattgatgagttttgtgtgtgatatgcgttattcctggttttgatttgaaaaccagaaggataacatttttatatttgatatcttctaccatgtctccctttaaataaacaacatacaatgatttgagatatgaacaggaataattgctattttttcctgaataacaattccaccagtattattattaccaatatgttcatcctctacattccagtttctttgcaatcctttctcttttgctctctcaccatacatcagaggttagtttcactatccatgctcttaaccacatcaagggttttgatacttcctttgatatcaaatttttccatctcaattctgtccccaaataagttcaaccacgaggtaccagtctcatctattccttgagcaagttctcactaataccctcctcccagaatagatcatattttctcattgtttgccttcataggtacctttctatttctttagagcatttatcatagctataataaacctatgactttcttccctactcagcaataaatgtaggttatagataccctttcctaggagaagataacacagaggtgggaaagtgaatttacacttgtgtgttatcaacccttatcccagcttgccttttgttctgccctgatacctctgtatgacctacaatccagcgctatggggcctacacccaagacgaatgggcagggaaggtatgggcagggaaatactgacccacggcaacttgagggatagggaacactaagatttacattactattctccaatgttgtttctcacccaagccccaagctacccccggcccaggttgcggacccgagcaccatccacacacgtcagttgagaacaggctttctacatacaggttttctcaattttttagacagtctttttttttagttattaatttcaagatttcatatttccccctatatagtctttcctggttcttcttgggcagaactagctgcttgtaactgttgccatcttgggacttaccatcaaggccacaggtagagcccatgtgtagtcatgaaaatctcaggcccactgtctctctgttactgtaatgacatacatagacatcataagacaactactctgtccatgcatactggcttggaagtgacactttctaagaccttgcctgcctaaatatgcagcacaatcatttctacttgcataggaatcattctgctgctctgaaagctcaggatccaaggcagactcatccacctaaacatacaccacgtagtcatttcttctctgggatccagccatcttcacaggaggcctgcaaaaatggtgtctgaccaatcagtctgtgattcgcaacgtaagccgggaatccttgctcttatacatcacagcttctcccaagtagtttttctataatagagttctttctgactttaattcaaagccggaaacagactattacctttgatttatgctgttacgtatcctgaagtgaacagtacacaagggcataattcatgaacagggtagggtggaggaggatttattctgagggaaaacaaatgcttgcacttttaaaatattattcaaacaaagattataatttcatcatccaaactgggctactgtgatgacagtttaagatttcacttatttttaaaacattatatctcaagacaatcttgtcaataaaattacattgctacacatggcagatctgaagagaggggcttctctcctattatgcttcctatattacctccatacaagatttccatcagcaagggcatcataaagcatgaaatagctgttcatcagagcagacacgcaaacccctaatagatcgtggaaaaataatagcaacaaagatttatttattgagcatttactgagctctggactctaaaacccattctttgtgcacattacctaatttattctttataacaccatacaaaaatgctatggctagtcccacttcacatgtgagaaaactgagatgcaaagaaatcttcctcagggtcacacaaatagtattagagtcaggattcaaatgcagccttattgaacttaaaatgttaacatttaaaatgtgaacctttaatgagcatagactgaatccacagtaggtgtgcaaatgttaaacaattttgaaaatacagtgttttgtttggggtttatttccatagtccaggtgctcagtggtggtcagagactgttctaatcaagaagctgttctccatgtgagctcactacaagcagttcttttgtgtacctctctatcaacaattgccacttaaaaaattaggttactgaatggcaaaactgctaaaataatgtgccacattggccaaatagggtgaatattttttggacttccattagtttaattaaaggtagtcaaggtatgtgattttagagatattctccagtcttacttgaaaaatgtataaaaatatagctaatgggaatgctttaggtggaatattaaattgttctgaatacagctaaaaaccctgaaagattctgatagcctgatccacactgtagtgatcatagaaccttccctgaggaattgtgaatttgagagaatcttcctgttatggctacgatcagagatccctaaaggatggagatctgggtttcttgtatgctgaagagcacttgagagagactggtttgtgtatctaattgatgagaaaggcctagttaataaatgtccataaatgtagccaactttattgcaagccatgctgcccccaaaatagccctaagagttgtacctgaccaaataactcagtccagttttacaggatgtgaagactgagtattccatccccagacaatgcaatttcagttatctgagtttttaatcctgactgggatgagagaaggctgagtgatagaagtatctgaatatgtggtattattcctcctgcaactcagggaaaaacagagaaactggcaaagtgaacatcctatttaaaaaagaaaaaaggaaaagatgtgtttcatctgatcttgaaaaacattaactagaaaaaaagaacaaacatctattttcctttagaaaagtgaagacacaatctccaaaatgaatgacttcatgaggatgcagatactgaaggaagggagtcattttccaggaccgttcatgaccagcataggcccagctgagagccatccccacactcctcagatgcctccatcaacaccaagcagcagtttcttaaccacggtacaagttccctcttcccaatacattcccctcgctactatataatgacaaggattaacacaaccgtgaaagcacctcaccaatcccctactacatacaatgctttaatttaaccaaatcagtcatttatttatcaagtgtgtattttgaggtcctatccaaaattaaaattctgtttttatcatctctattccataacaggtataattagatgtttgtttaattttatttttcttttggcttacgtttttgtttttccctcaatacatcatgaaaatcataccttaaagtagaacaaggtgggaaaaaacagagccacccataacactatcactgatttttcccctttcatttattataactcaaacaatatgtttaaaaatttaggaaaggaaggtacataagcaaaaataacttttaactgtcagaaatctctatctaatgccacatttcagtacatggtctttctgattttatacctttcagtatgtatatacaaagagtcttattttctctcagagtaaatcacattcacatatttttccataacccatgttttttattaatatatcgtgaactgccatgcaatcatacaatatagatttaaattattttattgtactagaaaaattgcacagttattccatacattataaaaatgatcattttttatttggctttatgttgtttccagtattctgtgtatttacaacgaacataataagatcacatgtctctcagatcttctttcattgccctcagagtagctttataattatttccttaggttctgtgcaccttgtgtcagggtactgatgtcatggctattgtgaggtgatttgatactgattaacttcattgggaatgggtttcctaatgttatggaaaattggccacattgatgagttcattagagttaagtccatcagagttaaagccatcactcacaggtggccaatatcatcttccaggtcagatcacattgctggtctgtggaggcagccgtcctgcctccatgttctggtctctaagactcccttgatcccttcttgcctccatacctcctcttccagatcagcagcccctccaagtcaaagtgctctcctacaactcagaaacagtgcaggccactgtggagacaggaggttaaagaaaagtcccctcccgcctaatttttcacgtccatgactctttttagttcctgccattattcagattggagagcctctaacctgggccccttcagattaggaaagtttgtggagtcttccagtggctgccttaatgatgtttttgcaacatagtgctgcttcattagaaagggctttgcaatttggttctttaaaatgcccctatctactagaatgagttccaactgaaatctcatgaaatctaaggtttgtggttgagactattccttactctgaatgctagtaatatgatttttttctctatttttattttatttggtcactgtcatattaggcaggagggaacttttctttaacctcctctctccacagtggcctgcactatttctgagttgtaggagagcactttgaattggaggggctgctgatctggaagaggaagtatggaggcaagaagggatcaagggagtcctagagaccagaacatggaggcaggacagctgcctccacggaccagcagtgctcaatatgacctgacctgggtagaaaggagtaaaactgagattcttctaaaatctcatctcttttgggagtcacttcatggcagctttgcctttaccctctgcttccccatacctcttgataggggatatgccttttctttatgggttaattctcattaaaaaagaaatattcttccttccactctcataaaacaatgaagataataaaattactccttacatctttttcatttcttccgttacctaaatcatactatctcagtgatctttgtctagttttccctactttacccagttaaggtgatacttgaggaccaacactgaggctgagatgactctcactagagaatgaccctgtttttcctgttttaattgtgcctatgttttggtctctaccttctaagttgaaaccaagactgaagactgaacctgaagaagtttccatagaagacagtgcccagagtgacctcaaagaagtgatggtgctgaacgcaacagaatcatttgtatatgagcccaaagagcagaagaaaatgtttcatgccacagtggcaactgagaatgaagtcttccgagtgaaggtttttaatattgacctaaaggagaagttcaccccaaagaagatcattgccatagcaaattatgtttgccgcaatgggttcctggaggtatatcctttcacacttgtggctgatgtgaatgctgaccgaaacatggagatcccaaaaggattgattagaagtgccagcgtaactcctaaaatcaatcagctttgctcacaaactaaaggaagttttgtgaatggggtgtttgaggtacataaggtaagcccacaccattgttttataaaatttctcctgcaacctccaatttttaaagtcttaacttgtcaactggagtttggtcaacttactcaacacagaaaatcaaccccttcacccttcccccagcactagagataattgaatagagttcatttcaggatatggggtacgttatattgtaacattcctcttcttaaggtatcatcatgcaagttatttagacagtcactaggaaacttggcattttattagttttgatgatctattcagagccacccttgtccaggacagtgcagagtttatatcaacacacatatccttaggattttgtttctttgagttcttctccatctgtatcaatgacaacttaatttaattgtgaataaaagagttgctctcccaagcctgaatcctgattgtgacaaccagagtaagaaataaaatagactactctgctttagaatgcagctatgtctaacagttagctagaattctgatcatttggactccaaagtttcttgcctcttctcattcattaattcatcaggagactgtagagcaactaacttctgcattaaataataagagaaatacgaagcaaaaagactaaaaaagtcacgtagcttaactgctcaatttataaatggggcaataaaatgcaaaaaaaagaaaaaaagcttggtgaattcttaggcttacagtgtgcctttcagtctctacacatcatgtaaatattatgcttagctgatttaacttcttgtttgaagtactgtttcatactccattatacatgtcttctagggtggcttacttttaattgtgctgttttctctacactcagtttaaatgactgtacatatatatgtggttgtagagttaatgaataatgagctacaaaccagaacaatgtgactagatagataggatgatctagatttgagatctgggcagattgggaaagagtgactatatggagaagaaagaagtagttacatattgaaataacagtctacttaatgaggacgtgcaacattctttctcaaacttacaaagtgccataaaaagcctctattctctgctcttgggcaggtgtgaaagaaacctaccaaattaatcagatttttctgtatccaggctccttaaaaaatcccagctgtgctgatgtggaaacaggaagaattaggaaagtaatcaattttttttcctagaaaaaatccagcagacaaagaacttcaacaaaagaggctcaagggaggagttgaaaggcaggattcaaagaccaagtatcttaagctatttggtacctgttattcaggacctacagctctgtttactctatcaaagacaaaagtttccagaaacaccctgtatttctcatagatttgaaaattattgatccagtttcagaagataagtgttaattttcttttgcagaaaaatgtaaggggtgaattcacttattatgaaatacaagataatacagggaagatggaagtggtggtgcatggacgactgaccacaatcaactgtgaggaaggagataaactgaaactcacctgctttgaattggcaccgaaaagtgggaataccggggagttgagatctgtaattcatagtcacatcaaggttggaactttataggaacatcatttttccaagtggcgaatcattttgtttatactttaagaagactagactgctactattacagagagtctagcaagtggaaaaggaacaaagccttgcactttactgggtgtaaacttcccaccattgtttttaaagaaggatacttgtaatcataataaaaaaaattacagagactttcaaaggccatgatacctaagttaaataagaaagaattggttgcttttaccacaatgtggagataatttaataagaatttgggtttggttaaggcacatttgtttcaactagctggttctgtgactttctagttgactaaagacttacactaggaatctcaggttcatcatttgtgaaatgggagaaatactgtctaccatagagggtcatcaacttagctcacagcagccctgaattaccaagaatgcatctgagcaaatcagatcacaaaggtacctgcctttagtgagatacatacactggtttacatcagacagaggtagctgggtctacataacaaagtccatgctttttgccacactgacccatacattcatgtgggattcttggaacactaacaaaggctaatattagaaggcaaatagttcaaaacaaaggctgacatattcaggcacacacatgctctcagattgctccagttctcaggaccagcagtcaaacatttcaaaccttctttgatagcaattgcaccaggaataccttttgtactctcccccttccttctgcccaatgaaaaccctctcctcaactcttgtcattgggtgcaccagctcctttctctctcctgttgttccctgacatctcctgctctttcacttgcactcatgctgagtaggagtgaatatctcatttcacggtccaaattaaacagagaggcatgactcaaaggtcaagaatttattaagggagatagatgagagcgagaaaagaatcatttagaaaggaataggggaagagatatggtgcagggggaggagatacagtgtgattgaagggagaaatgtaggatcatcagcatctcaactggtctgtctttatctctttctccttcaaggtcatcaagaccaggaaaaacaagaaagacatactcaatcctgattcaagtatggaaacttcaccagactttttcttctaaaatctggatgtcattgacgataatgtttatggagataaggtctaagtgcctaaaaaaatgtacatatacctggttgaaatacaacactatacatacacaccaccatatatactagctgttaatcctatggaatggggtattgggagtgcttttttaatttttcatagtttttttttaataaaatggcatattttgcatctacaacttctataatttgaaaaaataaataaacattatcttttttgtg

SEQ ID NO: 36849 - DNA, 26664 bp, Homo sapiens; identical to SEQ ID NO: 36165

SEQ ID NO: 36850 - DNA, 7768 bp, Homo sapiens
atcagttctcgcccgtctgggcgtgggcgtggccggcgtggctgctcgggaccacccgaacccgcggccatggccccggccgccgccagccccccggaggtgatccgcgcggcgcagaaggacgagtactaccgcggtgggctgcggagcgcggcgggcggcgccctgcacagcctggcgggtgagggccgggcgcggccggacgtcctcgcgagcggcccagggggtgttgcccctcatggaggcggggtgtctgccgtgtgtggtcacggtcgcctgggcccgtcccacaacctgggacccggcagtctccttcgcctgccctgcggccattcagggatgtgcggggcacctcctgccctccctggccaggtggccccagaggcacaggccgcagacaccgcgggggacctgcgtgggcctccagttcccgcccaagcccttcccgtccccagctcagggcaggtccagctgacgccagcggctggggaagactctgtcccctccaggtgtgaggccttggcaagtgcttcaagcctccctccgatcctcccctgtgagcagaggggtcagagcgcccgcggcgcgaacgcctcatacctcggtccggttcacactgaccccggcctttcctaggcctgagcagcagcccaggcccctcgccctgctgaccccagtgtaggctcagccaggccctgcctgcctcaccaggccgggagctgagtacagaagccagtgtactcaatgaagcagcacctgtcatcccagcagtttgggaggcagaggcgggaggatcgcttgagcccaggagtttgaaaccagcctgggcaacatggcaagaccccgtctctacaaaaaatctgaaaattagccggacgtggtggcggcgtctgtaatcccagctcttcaggaggctgaggcaagagaatcgcctgagcccgagggatgaggctgcagtgagccatgattgtgccgctgcactccagcctgggcgacggggccagaccccatcaccgattaaaaaacgaaaaaaaaaagatgccgggtgtggtggctcacgcctgtaatcccagcactttgggaggccgaggcgggtggatcacttgaggtcaggagttcgagaccagtctacacaacatggtgaaaccccgtctctactaaaaatacaaaaatcagcagggcgtggtggcgcgtgcgtgtaatcccagctacttgggaggctgagacagaatcacttgaacccgggaggcggaggttgcagtaagccaagatcgtgccactgcactccagtctgggcaacagagtgagactccatctcaaaaaaaaaaaaaaaaaaaaaaaggcaaagccatcaagtctttggggggtggggcaggcagtcgttaaaggcatgaactcccagcagaacgtttcagggagcagtggcactagagcccagtggtgggggtgtcgtggccaaaggaacagtgccatgggacaggaagagcatgggtaaatatcagaggacagccaggctccgtgccgggaggcccatgggtgtcaggtgggcagccattggtggattctgaacaggagagtgacatgatgagaattttttgtgtgtgtacttacttgttttacagtacacttggcacttacccctgtgccagacactgttcccagtgttttacaaatattgaatcttcaaacatccctccaagtaggacttattactcttctgatagatgagcaaattgagattccagaaagacctcacagccagcaagttggagagctgctttttgatgctagacagttggcctctggcctgtaatcttaataccccagaccatctttccatgtggccctcataggccctagaacagttgctcaggggaatcccggagcaagagatgagcacaggtgggagattcttcgcagactgtctgcagctcacgctaaggcaagtcaaggtggtgcctccggagacagaagcagagagggaggccagggagtgagtgttggcttcatggaaggggtgggactggatctgggcctagacaactgggggaggactgtggtccctcatcctcagaggatgcccaccagctcccccggactaatactgtttctcctctcaggtgcgaggaagtggctggagtggaggaaggaggttgagctgctctcagatgtggcctactttggcctcaccacacttgcaggtagaagctcccacgggacctcaggactgagggcagccacacacaccaagtctggggacggtggccagggggctgccaggcagtgtgagaagctcctggagctggcccgggtgaggttgcttcagggaagtgcaggaggtactgctccgagggaggcgaggcatctgctcccagcagggagccgacttttccagcctttgtgtgtccctggggttctttgtttaagactttaccccgggtgccactgagacccatttctcagtggccagccctggtggcaccagtgagtcacagtgctgagccatgtcatagggtgcagtgcccgtgtgacagtgccctggtggagcagtggtgggtctgtggcccaggctggtcaccaccctttagagggagttgttgacagaagctctcaggctcccaaccccagctcagcatgtagcaaggaccaccgagtgccagcctggttccctacgaggggctcgccccgggcatcctgccgccatggagagtgtgctcggtgggcgggagacagatgtggctgcgtcacagagcatcttgggaagtgaggggctctcagagataaagaccacgtcttagggaagagcattttccagaccggcagagcaagcagccgggaaaggccctgagaagaacacgtccttggcggtttgggagaatgaccccggggggctcgtgagttttgtaagcccatagctttccctgtgcgaggcttggggcattccagggacgtgggcaggggagaggccgaccactagctaagaccagacctcaggggacaaagttgggctcagggagactacagaggctgtgacagtcccccacaggatggtggtggtacagagcaggggcggcagcgagggggtggaacacacagggaaggtgcatgcagggtgccccttgggcttgacctcaggaaccggaggcctggcgttgccatccacagagatggaaacggggagcaggcttttctgggtgggggcgctgaaagctgtctcggcaggggtggaattggggtgctcatctgagcatacatggcgatgtcaggtaggtggcggacctgcatggctggcactcacaagtaaggtccaggctgggcataaatcgggtggtgccagctgtgtggttggtggagagccatgggactggatccgagtgcttgggctgggggaggtggcggggacagctagggagaaaggggaaagagcagagactcttggggagaagccaagagagggagggacactggccagccaaggccctgggagccaagggcagccattggccgggcctgtcatgtgctgcctgagctcacagtgggcttagcgacagaaggtcatgttggcctcagccagcacggggtgacagtgggctcaagggcgacaagatggggctgttgacaggagccagcagagggtcggctggcaggggcgccgggagcctgtccccgcggcagcagtctcagggtccacatacccatcctcttcctcgcaggctaccagaccctgggggaggagtacgtcagcatcatccaggtggacccatcgcggatacatgtgccctcctcgctgcgccgtggcgtgctggtgacactgcatgccgtcctgccctacctgctggacaaggccctgctccccctggagcaggagctgcaggctgaccccgacagtgggcgacccttgcaggggagcctggggccaggtgggcgtggctgctcaggggcgcggcgctggatgcgtcaccacacggccaccctgactgagcagcagaggagggcgctgctgcgggcggtcttcgtcctcagacagggcctcgcctgcctccagcggctacatgttgcctggttttacatccacggtgtcttctaccacctggccaagaggctcacggggatcacgtacgtaagtagcaggcgctgagggcacagctgcttaggccgtccttgtcacccccactggacttgggtgcatgcacagagctggccctccaggcctctcagccaacagggttctacatccagcatctgtgtcaaggcaggaacccaaatcctctgcttggaaaaaaagcagattttgtttaattacacttggctgaaagatccaaggaagtccagaccctaagtgtagaatgaactcctgctgcagcccctcatggacaccgggccctgcgcttagctctttactgaccggggggccccgggtcacgcctcaccacagatccctgaacctgggcccgtgactgcctatgtcactgctgtggggaacaaacagcttctcccagacagtgtgggagcatggactgcagccccggccccagcccctcacccctcgcccctgcctggcccagcagtctgccccatcagacggccgttcccaccttctcccctccacagccgttggcacctctgcctatcctgacccccagctgatgcccctgcttccagattcagcaacgaagcctcccccgtggtcccaccaccatgtccacctgccacagcgttagtccctggcccaccagagccactactgcatgagctccttccagaacagccctctgaggaacccccttccttttgtccctagagctgcactggtcccctcagcccctacttgccaggcaaccccgcctccacacacaccctaaacaggaggccaccgtgacctcgtcgcagagccaatggtcaggtcttcgtcctcagcgtacccagcctcacttgcgtatttgatgtggtttcttgccccgtccatgttggtgagggatttgatgagctgctgtgacaggggcatggaagtggggctcaaaccagatgggaggctccctctctcctaggacagccaggaagtggctggacacccagggcccatgctggcggtgtgacctgccacctctgtatgtggttcccggccctgggccgaggctgtctggctgtctccatttcccagccagtggaaagtgacacgggaagccgagggcagccagctgtccttcagtggcacggtcagaagctacctgtgtcaccagcaggagggtggcagcagtgtccctggggccacgtgccttgttacactggggcttcggtccctgtagcagggtagctggtgggcagcgtctgcagccccacatttccgctccccgcctccttttctgagaggtggtccctggacatccccacatcctcacctgctctgccagcctcatagctaagactctttctgcactggtaatgccaaggctggtctggagctcaggcctctccgtcatgctaggctacgaagcaggcacctcagactccctgaacctgccccctggcttgatcgtttctgccgggcactccccatgccagtgagaggcctggttctaacgtgctctgtgccaactgaacgtgtgaccctcccagcaggcgctgaggccagatcccctcagggtcctgatgagtgtggcgccatctgccttacagctccgtgtccgcagcctgcccggagaggacctgagggcccgtgttagctacaggctgctgggggtcatctcactgctgcacctggtgctgtccatggggctgcagctgtacggtttcaggcagcggcagcgagccaggaaggagtggaggctgcaccgcggcctgtctcaccgcaggtgcgtgcgggggccacacatgggggctgggggtgtcctgggcacttcacaaggacctgtaaggtgcacccaccttgacgctctgccccaccttccccagggcctccttggaggagagagccgtttccagaaaccccctgtgcaccctgtgcctggaggagcgcaggcacccaacagccacgccctgcggccacctgttctgctgggagtgcatcaccgcgtggtgcagcagcaaggtgaggtgggagcctgctgccgtcctggggtggtcagcggctgtgccggcaagatgcacctggctgcagcagaagtggggagtctggctctgagcaccctccagttttgagggtacagaggtgggcatctttttaaaggctcccaggtaggtcagatgtgggttcgttgagggggttaaagttccaaattcacgtgtattgaggctttgccgaatgcaggttggggtagtggccagccctgaaaggccccacgcttgcaccacgcatcccagcacacccttcctcccggggtcctcaccacacttgaaaaccctagcacactgactcacacccaccgaagatgccggcagggtgagagcgcacgctttcccaggagctgggcttcgtgggctgtgtcagctgcgggagcaggagggaacctcccggccgagccccacaccctgagccctacgcccccagccccgccccagcccccactgggactcggccttctgaaaaaaggctggctttcttggtcattagttgaaggaaatacaacatttatgttgtgtgtcatgtgcagagaatgtggacaggaaaagaaatgccgatggggatgggcatggcccagtggccccagctgctgtgaccccctttctcctctccgcaggcggagtgtcccctctgccgggagaagttccctccccagaagctcatctaccttcggcactaccgctgagccggcgcccgggtgggcctggacacagatgacctctacgggagtctgaacgccaagatttagtctcaggattaaccttgcttgcacagaagttagaacactctcagttttttgtcatgtaagatactaacctagccaccctgggagagaacagaaagctgtccctggctgcgctttctcagccctgggaggggcgcctgaacccagaacatttccctaaccccaacctggtaggactcagccacttcttcaggaatttcacttatttggacgggattttaggtttccctcccttccccaaaccatacagttgagaagtaattcagaagtaggccagaagacactttattcgtttatattgtgagaaaacagccccatcaggcttgtgttaaggcaatggactgaatgagtgcgtgctgggtggggtggggcacggaggctggcgggttgcttcagccagtgcagtgagaacagcagccccacggccccatgggaggcggcgctgctctccccgagggcggctgggcagagcacatcccccaggacttgatgaccacacggggcagagagaaaccaaccaaggccagcacctccgtcggaagcatttggcacacacaccttcaatacacgtcaaggtcgcttccagttttagaaaacagaaatctgcatctcagcctgagacgcacagagaggtctcttcctgacccagacgcactcacgagccaggtcctgggggtatgggggctgccaggggcgcccgagccctctcctggggggcctgctgggcaggcgacctgctgacccacggtcactgctgtgttcagcccctcagctcggccccagcctatttcccgcctccatttgatgtttccaggttttcaaaactgcatttaacctgcgccagagagttcaccgtaggcatctttaataaactaactccagcaaaatgtgggtacgttact

SEQ ID NO: 36851 - DNA, 7768 bp, Homo sapiens; identical to SEQ ID NO: 36850

SEQ ID NO: 36852 - DNA, 763 bp, Homo sapiens
gcattccgtgctatgattcaggcctaattaagtgattgcgtctgggcacggctataaaccactagctgcttcaactggtaatccagtcagtaggcaactgcaggggctcgccactgactgaaggcagtggaaggttggcagaaggaggctgttcaaggctgtttttgccttcactatggcaaaaatcattttgaggcacctcatagagattccagtgcgttaccaggaagagtttgaagctcgaggtctagaagactgcaggctggatcatgctttatatgcactgcctgggccaaccatcgtggacctgaggaaaaccagggcagcgcagtctcctccagtggactcagcggcagagacgccaccccgagaaggcaaatcccactttcagatcctgctggacgtggtccagttcctccctgaagacatcatcattcagaccttcgaaggctggctgctgataaaagcacaacacggaaccagaatggatgagcacggttttatctcaagaagcttcacccgacagtacaaactaccagatggtgtggaaatcaaagatttgtctgcagtcctctgtcatgatggaattttggtggtggaagtaaaggatccagttgggactaagtgacatcgtatcggttcctgttcagatgacatggggaagatgatggttcagccactggtactacgagaatgtttgtattacccacatttgaaatgatttgctatgatttttatgaagattaaaaatatatacacagtt

SEQ ID NO: 36853 - DNA, 5764 bp, Homo sapiens
agcccgggcggcgggctagggcgctcgcagggcttctgggccgaccccgctccggcgcctccgcttcccgcccggggcccgccctcgcggcccggcctcgctcccgggtcccagatgaccaccgagggcgggccgccgccggccccgctccgccgcgcgtgcagcccggtccccggcgcgctccaggccgccctgatgagcccgccgcccgccgccgccgccgccgccgccgccgccccggagaccacctcctcctcctcgtcgtcgtcctccgcctcctgcgcctcgtcctcgtcctcctccaattcggccagcgccccctcggctgcctgcaagagcgcgggcggcggcggcgcgggcgccgggagcgggggcgccaagaaggcgagctcggggctgcggcggcccgagaagccgccctactcgtacatcgcgctcatcgtcatggccatccagagctcgcccagcaagcgcctgacgctcagcgagatctaccagttcctgcaggcgcgcttccccttcttccgcggcgcctaccagggctggaagaactcggtgcgccacaatctctcgctcaacgagtgcttcatcaagctgcctaagggcctcgggcggcccggcaagggccactactggaccatcgacccggccagcgagttcatgttcgaggagggctcgttccgccgccggccgcgcggcttcaggcggaagtgccaggcgctcaagcccatgtaccaccgcgtggtgagcggcttgggcttcggggcgtcgctgctgccccagggcttcgacttccaggcgcccccgtcggcgccgctcggctgccacagccagggcggctacggcggcctcgacatgatgcccgcgggctacgacgccggcgcgggcgcccccagccacgcgcaccctcaccaccaccaccaccaccacgtcccgcacatgtcgcccaacccgggttccacctacatggccagctgcccggtgcccgcgggacccgggggcgtcggtgcggccgggggcggcggcggcggcgactacgggccggacagcagcagcagcccggtaccctcgtccccggccatggcgagcgccatcgaatgccactcgccctacacgagccctgcggcgcactggagctcgcctggcgcctcgccttacctcaagcagccgcctgccctgacgcccagcagcaaccccgccgcctcggcaggcctgcactccagcatgtcctcctactcgctggagcagagctacttgcaccagaacgctcgcgaggacctctcaggtaacgcagcacgctccagcccagccagctgggcgcaccgcttctaggcctccagggctggcggccactgccactcccacaaacagggaccccgaagctaggaggtctgagggcactgggaaaagcagatgctggggaaagccggcatcttattcgtgggagcagggatcagggtcttactgtcctcccagtatccctggccagcagccgaagcttcagaattgtctggctgctgtgagcgtggtgtaaagtcccctgccttcctgggctctttggggatccctgtgcaggagactgcaggtctcccgttcagagtctcacttagcttggagagaaggcatctggcctttggggaacttggtcaggaagctgtgtctagttccttttgtccctttttttccttgcgttcattttgctgtacttctgtcccgaagtaaatgtcagaatcagatatgttctgtatgttggggtgtctgcagcgagatgtttgcagctgggcaagtgttaagaggagggggtgggagggacagagctggatcccaggatctttcactaaagggacatttgccagtggagggggtcaccaaactgttggagactcctccccttccctgcctccccccccgcccaacaatggacccacattgatgatacaggtcctgggtggcaggacctgaaggaccctgctaggactcccctgagaaatgcgcctgccctgtggatgccacttgtagtgtggctggtttacattgttctggttgcagattatgaaaaattattgacttgctgaaggcggtgaaaggtgggaggggacggtagggatggaagagggaatttgaatatttgaccaggttaatgtgaagaacagagataaacccttacattaacccctcgctcggagcacctagggctgcagattaaaatcccatgggcctgccagtcaaaggcaaggccccaagctactctctcacactggcctcccacagcaatgagacagtggcttggagggtgatgcatgctttatgtgttcctgagccggtgtgcagcgggagcacccggggagaaggaaagcccagaaatgggcaaaagatgttggttccctggacggtgaaatttcccaaataggccttttaaatgtgggtctcagaggttaaccaaacaaagacagtctcggcaggaccacaccggagaggattttagcctgacttaacccactgagaacagagtcttgttcaattttatgggaatttcaacaagtaaccaatacaggcggccttcccctcttatttttgtattcccttggaccggctgtcaatcacacacacacacacacacacacacacacacacacacacacacccctcggtgcactggccccttcccttccccgcctgcctgctcctctcccagcctgccagctgccctccctgctccccttcttctcctctcccggcagatccactcaacttgaacccggactctgaggcttagcagccttggagaaaccgtactctaggaagaaaaaaaagcacacaggaaagagactcctgacccttcctcaaggctgctctcgccccacctcataacactgggcgcaggcacaagctcccaaaacttcggaatctggatacattactgtcttggagggggtgaaaactgcccagcaaagcaagccggcctctgtgcccctacccagcggcctcccgcggccggccttccctgggagcctcgcagaacccccgaccgagtctgggaacgcccgggggagacaatagctcgggcctgacgcccgacagggaccctctgcccttccttcctcgctgtcttgctcccgtccctataggatacccacccggccctgttgccatctccctggagcgccagcggtggaggcttcggaggagccggccggatgcaccgggaccccgcggggcctagttgggagcgcgccgcccactgaggcctgggggcccggcgaggcgcgggggtggccaaggcagtctccccggcacacagatcagcacatgtctacgcgcacacacccagcacgaccctccctcccccagcacaccccaagggccgcgccctccgctcctgggcctggtggccatggtccatgtgcccctgccggcgcaggggctgccctggagttctccattaagccctgcgagcacttcaggaaggagctcgggcttctgtcatcccgctcagcacatcaaagcgccgacggccgccttcgtgggcaggtgtgagcgctcgccctctctcctcccgagcctgctattttgtggtccaggacttgccatcagaacttgctttaacgcgacgagggaactcacctgtgtgcagagcgccgcgcacacatcggggctcgcgggacagggcagctgcgttagcgcagcgccgggtgtgttcgggtaggtgttgcgggcaaggaagtaggcagcggcccctgagcagccgcctcgctccggcattgcggggacacggcggggctgaggccacgagagcagggcccgagcccggcgggccgtggttacggttttcttgcactgaaaaactgaatccggcccgaagcgacgtgcactttatggtccccacaccactcggttaactaagaaaagacccgggcgaatggacctaacgcagcccggtgccgagagggcccggtccagcagcctctggggcccagtgcgcagggcactgcgggccgattgcgccccggggccaggaggcgccgagaaagcaaaagcaaaagccggcggcgggtggaggtcaagcggcccggtgcaggccggggaccggggagccgccccgggagagcagggtccaggccttctctgtccccctccagcctggggctacctcagggactcctcgcgctgccagatgcttcggaccaaagggcatttctctgcgccctgaagtcccggcttctctagaggaagtctaagacgttcgggacccacgaagatgcctgcggaggggcaggagaagaggcgtgcttttctgccccatcccttcatcttgcgattgggttgttttctatcgtcccctttggcacagggagtcctctgcgctcgctgctgtgaccggcccagttagttgggaaacaaggctcagaaagaaggccgcagtggtgtttctggggtagggtgcttggccctccctgaagccagggctcagggcagcacaggccaggagctctgccgggagagacccggaaccagagtctgggtctagttgtccggtacctgtgctcattctgagattaaagtgcacgccccagcctcagagaataaaattggaattccaggacataagaatccccctcgagggggaacttgctctgtgtttgtgcgagcatcaaaacaaaacataatgattccaaagcaattctatgacgtgcagttggtgtgtttgagctacttctaaagctgggctttctctaccagctgtctagcaatttactaaaaggcacagcagcaccttttgtactctgaggcaaaataagacaccctgccatccactggatgactttgtttctgaagaggtttttttttctttcttctttcagtgggactgccccgttaccagcatcactctactccagtgtgtgacagaaaagatttcgtcctcaacttcaatgggatttcttctttccatccctcagctagcgggtcgtattatcaccatcaccaccagagcgtctgtcaggatattaagccctgcgtcatgtgaacggaaagaggccaagcgatggccgctctctcctctcccctcctcagagggggcagatagaaactgggacggattcaagtcacatgcacgcggatagcagtaagccacacacctgccacttagccagaatgcccaggatcgcgttggtcactgttatttgcctactgctggaagaaggacaaccgctggcaaggtagcgttccccaatctgaatacctgcaggctcccacatgagggagagggcagactcaggtgggaagatgtgccatgcgtaaggcatcaacgtgtatctgtgggatcttcgttgccttcagtaatcagggtgtgaaaaaagcagacaagttgtgtgtgtgtgtgtgtgtctaagaaaacttgtgtgcttttcaaaaaggcagtgctaagcacaagatttcaagaaagcctcttcttgttgcctagctgagtgggagagtcattttccccagacactacatttggatacaggtgccaaagaacattattaaggaattatttagaaacaatgtgtctagtttaagaaagtggttttcagtattgtgacaatacaacgtttttacaaggttgttttctaccaccatattttaaagatatttttatgaccgtgtatactcacactttgcttgtattttaaaaggaggatatatttgcacttatgtatacttttacagtttgccaaaatattttgttgtaaaattttttttcaataaaatgtatataaca

SEQ ID NO: 36854 - DNA, 66857 bp, Homo sapiens
ggcaatcattggtaacctcgctcattcattagaatcacgtaagaactcaaaaggaaacgtgtctctcggagtgagggcgtttgcgtaaatctataggtttttcgacatcgatgccagttgctttgtcttctgtagtcgccaaggtggttgagagtttaagcttgcggatattgcaaagggttattagattcataagtcacaccaagtggtgggcgatccactgagcaaagccgaacttctcacatgatgacttcaaacaagacacattaccttccagcatctgttggggagacgagattttaagacacttgagtctccaggacagcaaaggcacaatggtgagtagcaataaaacctgcattataattgaaaaatcttgacatgttgcttaacaacgggcatatcacggctcttcctagcacttcacacgccaaagaacagcagctactcaggccaggggaatcgggtttttacacagtgcaactttaattggaatcatttgagatttgacacagctatgtggaactgcgtggaacaaacttggagctgggtgggggggtgtgtgttatattggttgttcaaggctgatgcttgtctctcagcagtcttgcattctattcttttccttaatgtgtatggtgtatgatcatattctatgatttatatgtgggcatgtaattgacatttgcaagggggttaatttccatctaaaaacaataatgctgttagaggttggggttagggggtggagtgggggtaagggtggggtaaagactgggagtttaggtgtagatggggggtggggttggggggagagaaataagtcagaagtgcatatcaccggtaatgggtaatcctctcgtagaagaaaaggttctcatcaacatgtgatcaactattaacaggatggctttggcaaagccatccgcacgtgacaaaccgtaaggaagtggaagaaaccgtctagagcaatatcaagtatcacttaattagagatttttaagccttttcctcctgctgtgccgggtgtgtaatccgggcgataggagtccattcagcaccttggacagagccaacggatttgtccgaggtggcggtacccccaggtagtcttcttggccccgctgtaaagccaaccctgtgtcgcccttaaaaagcgtcttttctgaggttcggctcacactgagatcggggctggagagagagtcagattttggagcggagcgtttggaaagcgagccccagtttggtcccctcattgagctcgctgaagttggcttcctagcggtgtaggctggaatagactcttggcaagctccgggttggtatactgggttaactttgggaaatgcaagtgtttatctccaggatctagccaccggggtggtgtaagccgcaaagaaggtaagcaccagggcggggaccccttgcatccccaattcttgagctattttgatactgtcttccggagaggacgcgtggtggaggggaggaggtagagggagagcatgagagggggttgtttcttggtatttgcccagtttgaattgccctaggtgagaaccctggggcaaagggagaaagaaaaaaaagaaactcagtcttcctgcggatataatgagtttagttaacttggacctgcaaatgtctgattcaaatgtaagatttatctctctttttctcctcttcacctccctcttttccgttctctttgctggtgtgtgtgtgtgtgtgtacagtagattcattactaattatgaagcttttgcaaaacattcgaattcctaaaatttgactttgtagcatttagaatcaggcggtggaggtggtgtgcggtggggagaggaggtggaggttgggaagagggaaggaggtaaagctaaacctccaacacaaaaaaatgaatcaaggtaatttcagctcttctagtgagaaggattcattctctctgtatccctccctccctctctttccccctccctccctccttcccgccccccttcttccaccccgccccctcctccagcctccatccctccctcattctatctcttcctctccgtcgccctcgctcctcgctggatgcttctttctgggttttcttttttttttcccttctgtcctccctccccgcgagtttcgggcgctggcttagagggttcccgctttctcaagggaaggggagctgccgagaccgcgctccgctccccagccgggccggatgcctcactgagcccaggtccgagtcagtcggggtaactcagggaaaggggagcctccgcctgggagtagaaggtcctttccggaccgaagagccagagagcgggccgggcgagggggcctgggcggctggaggcggtggagaagaacacttttagctccgtgcggcggctggacagagccaccaatcagctggacgcgcagaccgccctgccagggcgaggttgcgtccggaggcgccggtggagggcggccggctagtcgctgagccgccgccgccacccgggtgggcaggggactggcggtgggtggaggtgaggggcttggcgggtgagatagaagcggcgcggagccgcccagacctgtgttctacctctcccgcccccgcctgcacccccgggggacagcgaactgccggaacgcgcggctgcgttatcctcttgccactcttcagggagctcagggacttaggcgcccctgggcgggggccaccaggctctccacactcctataaccctcacccccacccccttctcaggccttttgttccggccacagagccaagcccggtggcagttttcgccccagggtttggtcgttctggactcctcccccgatcagctcttcttaattaaaaggcaagagcttggggtaggggtgaggggaacgtaggaaaaatctgtttccgaaactcaagaccactgttttaacgaacgaaagaaagaatcccaactctgcgcaggtggattcataggcgaagcgaggatattgtggaaattcagaaggaaaagataaaaaacaggcgctaggatcagatgacggtgataggctgctcggcacacaaagggagcgtagggcagggtttacggagcaagcctgcagcgaatggggcacagattgttccgagatccagtcgttttctcagtcagatctacgcgaagggaggggaggggaggggcgggcaggggagcgtggcgggaggggctgagcttgggggcggggggatttctgatcagtctgatgcaattccaagcgtgctgcaaaggaactccaaggcgcccgcatcaccatcgccacccacccttcccagatggtgctgttttaaatacggatctgcagggctgaacgcagaactgggagatttattgcaaaatcccgggaggggcgggggggggtggtgtgcggaacggggaatggaggagcagaatttaaaggtgcaacgcttgctttttccaatcaggcggcaaccggccggaattattatttttttctttctgtctgcttgtctctggattctaattcaccaagaaagaggtgtaaatattgtgacattttgaggcagcttgatggatgggaaagaaatcatctgtcactctaaattgcagagttccctctccccgcgccatcccttgctagcgaatactcgctgctgcctaatacagttgctagggcttcaaatgaatgcatcgttaagggaatattatccttttagttgacttgccaatttagttgacagttgaatcgagaaaattgtagatttcgtgtctctgggaggaaaaatgcttaacagtctaagtcttgtaaccttgaggtctttaacaacttaaataaacctcaaaagtgtcacgtcatcctctacacacacacacacacacacacacacacacactcaacttgtaagatgacatggtttcacctaaactgttgtggaaatgaatagcactttaaaaatggtgcacctgatattcactgtttatgtgtatttacaaagagctcttcagcatgaaggcaagacatttcaattgtcctgtttggaatcagtcagaagactagaaggtgatggagagaagaagggaagaaagaggaaagagagagaattttaacctagatgctattaaattaacagtaacctagcctacttttataccccttggtcttgcatattaatatttctgtatgtgagattttagcttggtctagctcccccaatggagtataccagtattgattcagatgagaatatgagcatcctgccagtagctttttcagtgtcattgatagtaagacctacaacacagcaatttttggaggatagaagagaatatatataagggctttgcaaactgggaagcaggcactccataaatgggaggtatcattatgacattctctttgcacatatcattttcatttcactgaaccagagtactagttattttaaaacataatctaatgtatatgctcaaggtagtaagtggggattttaaaagcaagtgattagttggcttataaaatattatttttcaattgtctattaatgtacattggaaagaaggcttttaaagatctaaaatcaacataaataagcttcccctttcatttgccagactctttccctatcagatttctgatctaaattcttaataagaagagaagctggtgaatttagtttctttccttttcctggcctgtcctctaggggaagctttagtaagaaacaacattccaaaatcaggcagtgagcgagagagaaggcaagggactggatgaccacaaaatagataatcagccaagaaacagaaatgagggaaaaccagcattaaagcatgacttacaaagggtttttattttgtaattctgtaattttgggaccaggctcaaacttgctcaagtaacattcactcgatcatattgcttacaatctgtcagttaaaatgatgtctaactgagcatattttttattaaatatacttctctcaaaggccagtaaagctactctttggttttaattagacaaactagtctaaccacttaaataactctaatgaatatgaactgatatcatcagatttaaaagctctgctgaaaactaaatttattctgaaaagcactgacttgccagaaaaatatctatttttgcagctttcttttcactctatggataatttaatgagttgcttattttaattttacaactgctacctcagaagtatctcaaattatctttctttggctggtgtctttctctgctgatctgctactgctgtgtgtgtgtgtgtgtgtgtgtgtgtgtctgtgtgtgtgtgtgtatgggcgtgtgtgtctctgtgtgtgttttctagtgggaatttaacaagcagtgagtctcttaaatttacatgccataatctatgtcaagaacattgcgtactacttagcaataaaaataaacattagcatctagtgaaagcttaccatcattgagtgctatggaaatagaggtcttaaagaaagattaaatttttcaacaaaaaaatttttcccctttttggcttaaaggtgattataatttcaaaaatatgacatctttcctcttttactttggaatgtagagctgctgctttaacaagtgtcttttgagaaagatacacgtgtttcataaagattaatacccttaaaacactatggtgcagagagggaaggatgaattctttaaccctgcctctaatctcatttggcaatttttggagtattcattctgactttttaaaaattcaggtggattttttttctgctttctttccaacattataaaacaatcctataagagatttttctgctatagtgcagactttatttgtatttcctagtaataacactttagattcatatagtactttgacagctctctataggtttcatttgatttccttatcagtcatgtaaggtaggaatcaccaatcaccttttacagatgaggaaagtaaggtgcagaattatctaacactacactgccagtaagatgtaaagactaactcagagtctttcttcaaattttaaggaaatttgtgtttgttcctctctagaccatgctgccttaaactccactagggcatcagagggagctgtaggcattattttctcctattttgatttatttaattaaattaaaaacattttttacaaatagttttcaaaatttcaggcctaatggaaagttttaactagtcttcctaagacagtatttccctctcccacagttagacactcaaagaaagcaggactcttcctctagttgacataccatctaagtcatagttgctaattccccaaaaaacaaatacaaagaataagaagaaccaaagccaagatgtacattacctttacttgtgaatcatagaatctgggttctgggaaggttctcagaggtcacttagcccagctcatatctgatacatgaattcatgctggcttgttttgtttcaatcctctggaatttcatcccagtcttggacactgggtacttgtttatcttggtagatgttctgatacttatgtggatcatgagcttggctgatcatttcccattttgcccaaaaggtatactttctatagagactctagcattcataattttattttgtaagtattaattggcaacacataatttgccattatgtgccaggaactgtattacaatctggagattcaagaacaagcaagaccaaatggtccctatcttggtggatcttgtggcctagagacaaagactggtctctttatttgctccaatccttagaaggggacagacctctggactcataagattccttttttcaagagaacacagtgaataagattaaaagcctgagtttaggctttacttccaaccgcttgtcagtacccaaaaaagtcaatcagtcactcttgatctctgcttcctcacacataaaacaaaagagatgttctcagaataaactctaaattccacttccgttccaagtttgagtgatataaaagatatagtctataactatttcttgcagtgtaggggaaattaaggcctaagttaccctaacctttggtgatttacaattctgggtgggtaccgcaaatttttaacttgttaagaagtatatcatgaaaaaaatcaaagtaacatatttgaacccagaatagaaggaatctaggtgttgaacctgttcatttatggaatgatggctaggaaagttttaatttagagaatgatctcaaatttctgcggattatttttaaaagcaggtggtgcgatggaagacctgctatcaaatttactgcttattttctttgtgcaagcagaagttataatttttcaggtcatttccttttaaaatcaaaaatattacatcctgaaattgcctgggtctcatgaataatgcattatatacacatgataatagataattagatggacaagccaaaagaaacatgaaaggaagcaggtagcccaaggattgcagaaggtgtgtgggcattttgacatccaggaaatgctatagatctgtccttaactaactcagcctggtggagataattaagaaaaaaaatgtgggtgtagaaagactgcaagccattccctgggattggctagattgctgcagtagttcaaaaacaattggcacagccacccacactagacatgattgccctttgatgaggcagctattgacttttataaagatgtcatatttaaaataacttctgatgcactaggcataacagacatcattcttgaattctattttagacaaatggcaaaatgtattacaaagtattaatttaaaaataaaaaatctttaaagtctagtgtctaaaaaccagcagtttagtaacatgcaacctctggatttaagaattcagcctgaagctgggagaaagctgtagcttgtataggacattttgatccactctgggcatttcccagaccactacaggaagtaaaatgtactttgtcaaagtttttaacctttgagtgaatgttaaatccactccaaaatcttcgcaacctgggaaaggtgatccaacaattttcctaaatagcggcagaaaatgctctgagatctttgttcccagagtgaatgttataatgttatgctatctagaaatttccttgtagcaccatgctcatcagtaccaaaaggagttagaattgattcctcccgcttcaaggaaatatatcaaccacctcctgtctctaagtaacaaggttactgtggggaaaaaatacacaaattaggtgattgcagaaaggtgtcacaaacatccaaagcctttgggatagggcattgcagtgtgagtgaatagagaaaagaaagagaatgtgggaaaaaattgagaaataaaaagggaagtcacagtggagttctaattatacaggggctcttgaattgactgttctctaccttccatgctcattgttgttctggctactttagtaggaaacaatgatttcttctgctttcaccttcctcctccgctaaggacttcttacttgccaataacttccataatcaatgtttaagaattgctctgatgcccagtgtggtggctaacgcctgtaatcccaacactttgggaggccgaggtgagtggatcacttgaggtcaggagttccagaccagcctggccaacatggcaaaaccctgtctctactaaaaatacaaaaaattagtggttcatgcctgtaatctcagctacttgggaggctgaggtaggagactaacttgaaccatggagacagaggctgtagtaagccgagatcatgccattgcactccagcctggcaaaaaaaaaaaaaaaaaaaagaaagaaagaaagaaagaattgctcactgtaatgactttcatgccatggactcaactctcttggcagtctggtaaagcttatgtaaacccttctcataaaaatgtctaaatggggccaggcgcgacggctcacacctgtaatctcagcactttgggaggccaaggcgggtggatcacttgaggtcaggagttccagaccagcctggccaacatggcaaaaccctgtctttaccaaaaaaaaaaaattagctgggcgtggtggcatgtacctttaatcccagctacttggaaggctgaggcacgagaatcacttgaatctgggaggtggaggttgcagtgagccgagattagccactgcactccagcctggatgacacagtgagactttgtctcaaaaaaaaaaaaaaattctaagtgaatgaaataaatgtataagattacaaaggaagccagtggcattgatgtacagttataaaaacatttaaaataatatattgtgtgatatagtaatatatatgctttttaatacattaaataagatctaacagcaaggtaaatattataattttgaaataatgataagtatcaatgtattttgaaatatctataaaactgacgtgatatgaaggtgtctgtgatgtatactggtgagaaagcatgcaagtactactgtgtaacatttcccacacatatttaacaacagaacacttgagaagcacttattaacacagcatagattcagaaatattaatttagtaaatgtcaacattagccattgttgtttccttcctggcaaaaggaaatcagcattgggagaaaacttttaaaattcacatttgccattagacaagctgtcaagtggggaaaggaccaaatactgagaaggccagggtatggtaagcatgtttctattgactgagcttgctattactctaacgtttatctttagcatcaccagcacaaccccattaccctagcaatccatcactccattgaaaaagataaaaagttcagattctggtcattaactcagcattgcttaagatacctgttctgacctcactaacccaagagattactgaaactcttcctgtttgtcattactacaccatgggaaattataatgatgtgggatgacatttactctgcattcatccagtgctgttatttgttttgtatttggcatatattacttaactcttaaagtaactctcagagatagattaagaaaactagagctcagagaatttaagtaacttgcccaaactaacacagaaaatctgaagtggagaagctaaacttcaaacccaaagttttctggttccaaagtccattatgaagttgtgcctccccatcttatagctaccacccagatttaatctgggtctcccattatcagatggtttacatacacattttcttacaagatcttgaccacaactctttgagatggccatgagtctcacaattcatttccaggagtgctactttagaatcattttgatctttgctaaccgatgagagattttcaaatagctaattgtcacctaccctttttgaagcccagttttcataatcataaaatggaaacagtattacaatgttttgttaggatcatatacattaataataaaatctaactttgttgagctcactatggtgagcattctgcatttccttagttcattgaatcctcacaacaatctttctaggctaagacgattatttttcttttaaagataaggaaactgaggcatcagtaattaattaactatcttaaattagcagagccaataagtggcaaagctgggttcaaacctaggtctgtctaatgtcaaagccctttttttaatcactaatctgcaaatcactattcaatcttagcttttattattataattatcatcacacttaaaacactatcaagatacagaatgatccagacataagtatatagtcactgaagagattagaatctgaaacttttcacctgcatgttcttccttccactttagtttattaacccaatggatgatgtctgactcctttcttaacttgtttagggcagttccaagttagttgacttctgagagttattgagtaagaaatgttataaattgtttggattaggatttagtatgtttagaagctatttcataagtttgcctttgcgaactgttactggctataatactgcagatgctgtgatgaggaacaccctctccaaagacacacagtggatgacaaacctccaaagctaacatgttgtttacagatatggagaagaagaggatggacaagcacagtctaaaacgtaattacaaggcttatagtccctgttggggactagaatgtttattggctttccttgtgcaattcaatgctcttcctccaaaggatccactccaaacttggaactttcctgaaaatagcatctcatttgggagcatgccaggaattggtgtctgggtcctttgtgtctttgcaccaactcagaactctggatactagctctagaaactaagctgggatatattctgggtaagggagtagcatatctacttgggcatcttcctgatacatttatttcatccatcttcctcctagagagcacctcctagaaagatgtggttttaaatgagggattggatgcatactggtatgtcttagcacacaagtcagtggtctttgcagagctgccaaaggcatataagtaatcaaagatgcggaagtctatgaagagacttcatcccacctccactctgatttattcagggaaggaccccatgaacacataatggatttgatacgtcccagagctctgaaagcagcctagcaaaaaaggataatcttgaaggacattttgatgtatgaaaaagtccacctaaagctttgtcagagataactaagtaatatgatggctggtagactgtaagtccttaccttggctcaggaactgtatatcatttggtaaactaaacttgtcgttcaaatttagatagaaaaagtaccttacaaatgatctagttcactgattcccttcatgcattgaaatcacctaaatcatctcttctttctgagataaggtctgaatgtgttgccagctttagcaaactcagtttgtagcccactgacctcatttgattgattgggcaactgaggtgcacagtggtagatctctcaatttattcaataaacaattatatggcccttacgatatctatctgaacaatcttgggctagtgaagttgcttgcccaggttacatggccagaaactgacagttttaaattaggaccaaagttcttttgactactatctgggccttaaaataatatcatatgacaaagatatttcttctgtttcctaatagtcacatcaaaaggaaacaatggacagtttgtgcaagattttagttactttaatgttcaaaataaaattaaaaacagattattactaaaacataagcataacaacactttaatagcattctaatcagatattattaatttcaaaatggtaggacaaaactaattatactttatacttcttaaatatcctatagttactttatgactattgagacactagctaaaacttgaaacttcaagttttcattgattcctatattattacttatttcagagttacttcatttggttcttttatctgagattggacaacagctttatttgattttcagcgacaaaattcttttcactcctgatcctccaccccaagaaaacaacagctactaatatattttccctaaagtgatcaagaaataaaagaggaattctagccaggcgcggtggctcatgcctgtaatcccagctctttgggaggctgaggcgggtggatcacctgaggtcaggagttcgagaccagcctggccaacatggtgaaactccgtctctactaaaacttaaaaaatgagccaagtgtggtggcgcatgcctgtaatcccagctacttgggaggctgaggcaggagaattgcttgaacccaggaggcagaggttgcagtgagccaagattgcgccattgcactccagtctgggtgacagagtgagactctgtatcaaaaaaaaaaaaaaaaaaaaagaggaattctaaaattaattatatctattaatatccctactcttaaaacgttagaaaatgtttgctcatttaaaatttttatttttaaaaccaccttatattccaactaaatactctttggagcaatttctttgttcctcatataatatccatacatataattctgcttttgtgattaacttttattactactcttctaaaattgtgctcttataaacatcagttaattaagagtaaatctgatgttttataaattctttctagaaacagagagcaaaatcatataaataacaatatgaatttccaaaagtacaataataaaaaaaaattagaaaaaaattaatctaggaaatagtcaagaatatgtcaaacttgtacatacttttgagataaattggcatcatgtagattagcatgattcttctttatggaattcaacttatttttactcactttgctctaattagtttttgtgtgcggacaagatggaaggtaatggaaatttggcttgcaaagtagttctaacatgatctacatccacaatctggttataatgctataagaatattatgtgggaatagtagttcaaatcagtatttagtatgaacataaagggacaaacaatgcaaagctaacttaagttgtttacacttggaacttatttaaattaaaaaggccagtggatggtcatatgtttggctcattcttctcaaggccttcaggaaaacatgcctatgaaataaaagatcctcaatattaaacattttactgcatttgggggacacatgaaatctggtaataaaggaagtgttggtcttcatttttctaattcagcatggaaactatcttgaggaaaactgactatggtcttagtttgtgtctcagaaatatatttagtctgaatcatggcgtcgacatctgacttccaaaattggatatctagccgtatagtacctcacctcccacacacaccaccccccattcccaggtcatgactactgtccaagcagcaaaaaaagaagtaatttcccagagtacatacatggcagtgacaaccaaccaaacaaaaaacaattataggggctggaatttaaattaatggctgtactctcaccaattcattccccattccaccccatctctctgtcttcaacttttatgaaacattatatttgtcctattcttctgtatcagcatcagcctttcctatatccaactagacttataacttcttggtgcctctcactggctgactaaggtttcagaagtacctacttacagcaaacacttgcagcagtctctttttggttacaaagtccctggacaatttctcaaggcgatattatgaagaggaagtaaacattctcctctgctaccccatttctttttagagtgctaactttattctatatctggtttaatgtcttcttaggccaattggactgattttacagacaccatagaatatctcctgagtaatgggaacaatatttctgctgatcccatgatttggtctcattgggttgttaggccataatggagacatacttgatgaatttatgaagacttgattctaggtatcatgtaggttagcataattctcttttactgaattcaacttagttttattcactttattctaactggattttgtgtgcagaccaaatgaaaagaaatggttcaatttaggtgaaaggtaaagcttcaaaagtagtgtagtatttcatagaccttacctttgagagaaattatatcagtatataataagcacctgagaatatgaaagcacaaatccaatttaaatgtgaaaggtctacaacttgggattttaaatggagtacagaaaagccactgtttcttaaacaattttgttgagggggaaaacagtgaaagctaaatgttctattcaagagttgtttcttttgaaaataatgcttcatttaaaagctaaggacagaagacgtagctttgttatgaaggctcatctttttattaaacaaccactactttgtctccaagttgcaaagggaagatttgtcaatctgattgaatcttccctttagtttttcccaacagctgtgtccagataattcatgactcctgtgtttcctgagccctggataatttcacacacatgtctggtttggggctccacattttcagaaaaatatagaaatcttggaggaggtccagggtagaccaagggaaatgattaatgggttgaaagttggagtttatgaagaaaggttgtgagatctgatcttttgctacgagaaaagtctgagtggtgacttaataacataaggaggttagtaagcagctgttctccatcttcactaaggttgaatgaaatgaaataagatataaattgcaacaggaacaaaaatgcattacaagtgaggacttccaagcaccagcattgctggattctagatagctccccaaaagaaggatgtgtagtctacttccctggtctgcaatgacaggcctataaatagtgagaaagatgagataatctcttaagatcccttctggacctatcttttataggtctatctatcatatttagaaaaattatttgcctcaaacaaaaattatctgatttcctccctctcaccctatccactccttctcttttgtctaccttttgtaaaacactgctaaccgaaataactggggactgattaaccgtggtgggccctcccccgcctctaagtgccactccagctttgggagcaagtttcttgtccatcactaccaccccctggccactaggggcatgtttaccatcatctttctacacaccaaacctacggcaagggaaaataaaacaaaacaaaacttcctagacttaacaaatttgcaagtgtcaccatggattaaaatacaactcttatgtcctagaatatgagcatgtaaagggctaaaatgtattttatgcatctgcctgtatcagcccatagaatagcctcctgacagatagtagatactcagcaatctttcatcaactgaatgactgtaactatgaagtgaaaggcaactaaagttgagaaagtcaggagtttcggatgtttccaaatgattctgtatgccagactaatctaaagcctaacccattcttcacaaccatgcactattaaggatttcattctcaccatgcctgtgctatctggaggtagaaagagggccagttgcacatcctgctcaagtccttggtcaaaaagaccactaaagagtgctttgtagattcatgtatcagaatcacatgaaagtaggccaaattcttagtgtgtgtttttaaaataagactttaggaagttcacttatttttttctaaattatttttgcatattcttctttttcatttttttcatgaagaatttaaaatttggctgtagaaaatctctcactccaaacatcacacagcctaaataggtgagtctcaaaaataagctaatgttcatctttcatctgattcaatgtcctgaaaccctttggtttaaatttgttaattcttctcatggcttttctcctagcaaaaccaactaataccacagctatttattactgtcagctctaacttatgcccacaatctcacatcccttttgaccacgcttatagaactattacaacaagtaaaccaaatttattcttcattattaatttttaaatgttctcagcacaaatctggtaacttggagggctacaagttgatatttctcatatgtttgggggtttagtctcaacagtttcttaatggtttctatgccgtttttcttgatccaactaaatattattcccagatgggatcagcttttgaccctcttgttctactctcctagtcttggcccttctaaaagtttcttgctgtggttcctttcttttgtctgccactaatggctatgcctggttacataactcctgtaacaggtgttgaccaatttgaacacattttggtatggtattgagctattcttatggttcataaaaagcttagtgagaacgtaacatctcatgaatagggaaattacttctcccttaaggtttttctcaggacaggcctcatacaagaatttcaaggattgcgagtgacatagtttaacattggaccaggcctttcaaattatccaggatgagtttgaaaacacctgtgccactctgctcaacagcagagttttctgtttactaagtattttccctatgctaattacggaaagtttcaacagtttttttaggccaacttatttgatgctagactagacaacttattttttttttcttgcaaggaatactgaaggtaggagtaactaggaagcttaaataaacataaatataaaatgcttatagtgatagaattgacctcagccaattaaaattattaatagaaaaaacatgtcaatgtcaagcctactacctctgttctcacttgagtaatgaggattagtttatatttcccgacaagaatagatgggaattcaaatttcttcctgacctttgttccccctggaacattgggttaggatcatattagaacataaccaaaaagaaataaagattcagacgaattcacaattaatttttaagccccacaaaagtgaaataggtagcattattttttcaagctgtgaaactttccctcattttagtaatagagaaaatgttcagattataaacttggaaactttgctcctaacatatcaattatgccagaggccaatttttaagaagaagagaaatgcatgctctatattctcagcatcatccttgcccacaatagggaaataattttgtaaaatgtttgattttagacctccaaaattatctctatatgctacctgaattaagcaaataaaaaataatatttagaattccatgcaaggcactggtacaattttgtttatcttggcttcattgtttttgaatgtaagatgtacttttaaggcaaataagtacatgttttaagctggtcgcatacagtattggcaatgctataatcacaaatcagaaagtttggaaatgcttacaagtgttaagaggtgtgattcatcatggttatctgaattggcatctgatcttcttttctttctaaatatccctgacatttctgactcctctgtcttttcctcagtaaaactgcaccacacactggaaagcgaagatacacacatttatttatataatgtcaagggagagtaggaataagaagattggccatagacccacccaatcagagtctgggaaatgagaacactttttccttcagcagaaatgctgacgtgccaatgtgaatttagcagaaaaaagatttgccataacttctaagtgagcagccttcagaatgctagcttagattcctggcattaacttgccaggtattttttcaggaaggaaataaattacaattgagcttaaaaacctgagggtagaactcattttcaagcaaatgtgaagcatcagtttgaagttaacaaagttaaagtttggagtagggttcctccagtcctttataatgtagtacaagtattttttttaaatgtataacactagccttttaaattgtattgtgctactaaaagaaattgtgcctgcattcatcttacaacctgggaaccaacgcagagggtctgtggggtagcggtatccagcttcatgccctctgtcctttattgctttctggttagcctgcgtatttcacatacattaaatattccacaataaactctgccatctgtgctgtagggtagtttgtattggtcatgtgctctgtcaagttgacagaggtgcaaagctaaatgtgtgacactcgaagaatatgcatatatttgaataatttgactatttagtccaacaatttgcaaaggcgctctgaatgatcacacattctgataacacttccaaggaacagatagcttcacttagggggtgggggagatggaagcagggttatttctagcaggaattcttgagttcactgaagtcttgtccctggtacttcactgtgtgaacgtgggtaaattatttcctggcagaggatcggattcttcttttataaaacgggtaaataatttctgtcactagtctttagaagttctaaaatagctaatgttagtgaattcattttgctaactgtaaacccttaggtaaattgaactgagtatgtaataatattatatattcagttcaacagcacattcttggtaaccacaagagggtccaggaaaggaaactgtttataaatctttccctttagcaaaattaatgttggagtctttagggaaattcttacagcaatagtcttcgcaattattaggtcaaacccctttgagattacagaaaaacgcacacacacagaaagctgcctgcagaatttgggtgtgggcttggtgggagattcctctgatacccagtgttgtacccccaagagagtgtttctcaaagtgtgacttcagattgtctgcattcgaattgcttgtggtatttattaaaattataactcctgggccctgccccacccctactaaatcacaatttcaggaggagggaccttcattttaacactcacccaggtgatttttatgctccgaggaggtccagggactccaagttaagtacggtactgctgtcttattctttattctaaattttaaggtctgcacaaattggttgaactaatgagaagaaaattcagctttaaagcagaaacacaggtagacggttgacagagttcatcaaatggataattgaaaatgtcctctggaccctagccatataagttctcttcaagggtcttggctacaggcaaatgagaacccgaaaggctatttgctcttttgctgcgggcagtggtgggggtggagggcgggggaggattaactgagccagttctgcccccaccctcgaatcacctacccccactctggttaaagcagaagactttttatttatcttggctgccctggttcgttattaaaagggttagcttatacgtgtgtttgctggggctggaagtgaaaacatctgcaaaagcatgcaatgccctggaacggaactcttctaataaaagatgtatcattttaaatgcgctgaattttgattctggtaattcgtgcactagagtgtctatttcgaggcagcggaggtatcatatgacagcgcacgtcaaggcaccgtggagccctctcgtggactcccacccactttcccattcaccgcggagagggctgctctcgctgccgctccccccggcgaactagcatgaaatctccctgcctctgccgagatcaaatggagcttctcgctgatggggtgcgagtattacctccgccatgcaatttccactatcaataatttaacttctttgctgcagaacagaaggagtacataccgggcaccaaagactcgcgccccctcccccctttaattaagcgaagggaacgtgaaaaaataatagagtgtgggagttttggggccgaagtctttcccggagcagctgccttgatggttactttgacaagtagtgactgaaaaggtgggtttgttttctttctttctctttccgtttttctgtttggtcggctagaaagcgtgtggctttagcgaggtctgtcattgcctgggcttcctggctggaacaagtaacttggtgtaacgttatctgggggcgttcatcaataaaaaatgctgttattatcttgattgaattcctattaggcaaactctagagaggtcagtgcgcgaactctgtttaagccggcgtgtttaaggcagcagagtaaaccaatagcccccatgctctgtgcgatttcattgtgtgctcgcgttcgcaagctccgtagtgcaggaaggtgcgggaaggtgtgtctgtggcccgggaaacgcacgccctctcccagagaacttgggtgctgggatggggaggaaggggagagttgaaagctaggggagcgagacctcggggcgtgcgattctcactcgctccctcccgccccagcgcccacagccggggtttctgcagagggcgcgggacgcggggttccccggggctgaggctggggctggaacacccctcgaagccgcgggcgtcctgtccaaggcgccccaggagggcgcaggactcgcagggcgatgtcgcggggccctaggggaggaggtgaggacaggccccgggggagcggggagttccgggcgcccctcggttccccgcgcgaggaaaagacgcggcgttccctttaagcggccgcctcgaacgggtatcggtagcgcgggcgagcggggagcggggggcggggggcgggggggggggggcggcgccgtttgaccaatcgaagctcaaccgaagagctaaataatgtctgacccgggcgcaaggcgcagcctggagctccgggtccccgacgctgccgccgccgcgcccgggcgcacccgcccgctcgctgtcccgcgcaccccgtagcgcctcgggctcccgggccggacagaggagccagcccggtgcgcccctccacctcctgctcggggggctttaatgagacacccaccgctgctgtggggccggcggggagcagcaccgcgacggggaccggggctgggcgctggagccagaatcggaaccacgatgtgactccgccgccggggacccgtgaggtttgtgtggaccccgaggtaggcaagcgctgggaatggggcttggtgcaggagctgcccgtccgcgggagagagttgactgggggatcccccaccccaaagttgtgggacgaggccagtctccttctttcctcccctccggtagaagggacgatttggagttactcttggggagttttctcccccatcccacaacccagaaggtcagccggcaccaccagggaaaaagggacccggggaagtcacgaagtagaggagggaaggcctggaggagacccagagctgcgtgatgggagcaaagacggcgacccggggatccctcgcagccctcccccagcccaggagtagtcgagagagacttagggggccagagctgtcgagggtcctgactgaggggagggtgctggggctaggctaggaatccttccagggggtgggtggtccccgcgccgacttgcggggggagtgggagggaagcttgcgccttcagcccgcatcccttccccggagctgcacacggctacctgctccccaggaattgagactgaagtggacttacaagtccgaagccaatgtagcttggaaaacttgggaggcggaattcctaccgctgggaactgaaagggtctgcgacactctcgggcaggccgaacccacatctctacccatcctgcgcccctcttctgaagcgccctccagggaagttaagagttttgactttcggggagtggttgggatgtacgtgggggattcttgactcgggttagtctctggggatgcagagccgggaagaggaatgggtgagtgagttactcctggaaagaaatagctgaggattgggggctctgtgcctgacgggcaagaagaaggggagattacagactaggggcatccctaaggaagaagcctcggggctgcgagggtgaactggaggatgcagtgtttgtgtgttgggggtagagcggggatgagggaccggggtggaggggaggcgaggaggaggaggggacccagagaacgaagctagggaaggtagagggtgccctctgccggccatgctgccaagagcagctactgggggcgggaggctgggggtggggaagtggtaaaggaaggttttgcgggatcccttagagagctggtaggagggacttgttgaatggtgctgctgactccagctcggtggggcgtgcgactcgtcgtcggtggattttgactcctcgttcttgtttggcttctatgcaagttttcctcgcgctgggggagctttgataagcctcgattggcggtgtgttagggcttcttggatcttattttagggtcctctagttatcctgcacttactccttaatgtcagtagcaaccaaagaacattttccgacaagcacgcaggaatgttcttggccagaagcaaagaaaggcatatttctgagtgtttattaatcctcctagtaatcttttaaagcaaagtaatatgtaattgggaacgttgattttctaactgcatataaaaggcgacatgatattaaatgagacccctccctactgactcaatatcctgcaaaatctctctctcccctttattattatggaaaaatctatttttatatgagtttgttgtaaggtcaaaagccattttggtcttacaatttgatatgtctttacattttaacttattgaggcataattacagatttaatttgtatgaacgtgtgtgccttcaatgcttatctcatgcaacataatttttaggttggagatttctgatgttatggcatgtagcgtttcaaggcattacacataataggtaacatagcatgttgaaattacaccacaaagttttgaccctgggaacagcaccttttaaaaacaatcactaaactcctgttcctgttttctgattttgcaaatgccttgcttaagacttttttttttttttttttttttttttttttgggaaatttacctctgggttagcaggagaggtaaaaaaaaggaaagagacacttgttgaaatgtaaccataacctttactggaatttaaaacatgttggtcaccattactggaattccagggccataaagtcgttgtcttttttttcttctacttcattttgtaaaatgtgataaatgttggtaaatatagaccagtagtaagtattatgacactaaaagcattatgtatgtggaactattttaagttattacagaacattttctatttataaatgatataagcagaaagaaatgatttccagataaacaaggcttacgtacatgttttgaagcattagaacattgcagacactcttagacatcacattttttaaagcaaaataacagtaatttttcacatacctttggagcctttcatagcccattcagagctgagttagtagctggaagtttcctttattttaaggtgatattttaaaaccatttaacatgtatagtaggtcaacattggtgcatccagaaaatgaagcatttaggaaatctgtttcagtgtcttttcaatgtgtgtaacttttacttgcaaaccaatggaaccaagaaagtcatcatttgcctaaaatgcagtcatcacctcaaatgattcatttatactatgtgagttaattgccttcatctcattaatggccaaggagggaagggaggtcctggggtatttcttgttcattttgactcaccaggagggaaaatcctgtaaaaaaagaaatgcaaatttctaaaatcctggctcaaagtccgtgggtttcctgtttaaaaggggcgccatgaaaatgtaagctattccctttttcctggaatctttaagagtcccagcttttcaatagtcaaaatgtagatgattgatatcatttcttatatgaatagcactggtttgtagttcagcacgcacagtgagctgggcacgcccacctgatagtatagcagagaacttgtttacattctttttacattcatcttctaaaacctggggtgctctctctctctctctctctctctctctctctgtgtgtgtgtgtgtgtgtgtgcgtgcacgtgcgcgtgtgtgtagagggggagagagagagagagagaactgtgaactgtgaaatataacacagccagcagctttgggtctcaatcgtagacttactcttaaggaaatttacagaatggaaaggtcatgttcaagtagtttattaacattttgagatgtaggaaattaatcccggagtacagaagaacaatttcagacttcctgaataaaaacagacagcatagagagtggatgatagctaaactctgaatatcttttgagaagaaaggcactcccatttcaggtgcccataatatggatttgattttagtgattaaaacattaattttcaacttgcatctccctgtgtggaagagttcaatttgtgtgaggggtctcgcctatccaacaaaagtgaatatgtcccttttatagggtaattgctaacttgtctcaacttgttttcaaacaattgttatagagcactcagtttccactaattgcaaaattgttgcttaattgaaggactctcagccatctagtgcagccattcagccactggcaggctctgtgatctcaaactgtgaattgcattttaaagaggaatcgaggagagaattctgtggaattctaggttttaagtgctggctgttgttcaatggaagaggaaatcatttgaacaagaatcgcatcaagttgtgttgtgataaattttctttattaggatgaataacatgcacagatgagcttcaaaagtgaatgagcaaacttactggttacactctgcatccatttactctgtttagtatggagtaatgttaggcaataaatgatgctggcaaatgaaatccgtatgttatttgcatgtggtatttaaacctaggaaacatagagtggctttggtatttgtaggcttagtcatgtgtgtcctaaacgtcctcttaaacttctacttaaggcatagaattatttaatcctaaataattttatacttaagtgcctcactggatttccagaatatttacactgtaaagatttagaaaggtcatgaacccaattattgactatatggaatcattattgatggcagatgcaaaatggagctcactaatgtactgacattgaaaaccttttgcaggggagaggagggggagtggtaaatgtgtgtgttctttaagtggaacaggaaggtattctcttttctgtagaaaaatttgagtatctggtcagataagtgtggaagctttcatttaaattaagtatttaagttcaagtagaagctctagggcacttatcctcttgatgagacaaatcttatcaaatatactagatgctaagaagtggctcattgccctgatgtctcatttatagattgatgtttgaggatgggttgcattaagtgagttagggggctgagtgtgggacaggagaacgattggaaggaagcaaagtaaatttacaagctttagtgacagccataataaagtaaaagtttatttccagagagcctagagagtaaggaacgttatatagttttccccaaaggttcacttgaaagaacttttcattggttgtcatggtagtaatgtcctgattttgaaatctcccagaacctagtagctcttaaacatgctttcatcttggttcctttggtctgacggaaactttatgacgaccctctgtgtttttgacatgcctctgcatttttggagagaggaggtcaggcaagggaggatttcttaaaactaagacagtatagtaaggaaacataaaattatatgataaaaaatcactgaacttcaaattgacttactgaaataaaacctagaaggcaacctgtcgtttaattacaactagcttgtataaaattaaaatttataaaatgggaattcaaagaaaataaacgggcagttccaagtaatttaagcaactcaccaaaaattgaagtaatagtgccacctagagaacaaaatcaccagctttactagccaaatggcttatttccatatgaaccatttttccaacgctacagttactaggatttccttgttaccatattcagatcttgtgagtgtgtatgggggtgggggttgcatgtggaattacagatgaaattttaaaacaagcagatccacaatttgatatatgcactaaatccttttaacgttgtaatgtagccaaatgtagaatagcatgccaggaatcaacggctagcatcctttttaacatttattattttcatggatatgtaccaaaccgaaccattgagtataaaggttctgattttatttatttgctacaggcaattcattatactttctgagatacaataacaccaaataatttgagtagagagacctttaagaatgttttcgatttatgatctacctttaactttaatgtactcagaagatgtgagaataaaataaagtcaaatataagcaagattttaaacacacacacaaaaaacaaacaaacaagaaaaaggaagaaaattataaggattgccttaaccttagaatagatgaaggtatacatctgagccagcaccaaaaaaaaaaaaaaaaaaagttatggaaccaggaaccaataattacaaattgacttaaaattcttggatgacaaaaatctatatttagttcatttttgcatgcgcccacaacagcatccaaaacagttctggggaggcactttgataaatgttgctgaatgcactaatagattgattaatggctgcttcagattatcactagtgatgtagacagaaacttcatgaaaatggtttgtcttgctggaagaaaggcagaaattggaggaaaaggtttaataatatttttccccagtacctattataaaagtcatttagttggcttagttctataatttcttatgtgtaatttgattcacttatgaaattgtgaatatatgaaatgttaaagttgatttagacagcaactataagcttgtggattttcttttaaatgtcttcaaatttttaaatgccagtggagatgccagcgactgtgcttcagggagtagaatatagtatatcttaaatttgtgccaatttctggtaagcagagaaaaaattgcatgataaccaaagaaagtcatattgtttgtgctttgtgttattcatggaagcaatcaggtgcagaaaactttctttttcagaaaaaaaaaattactaaaataaaggtgcgtgtgtgtgtatgcacatatatctaaagggagagagggagaaggaaacttactaaataaaatttttgccacatgggatttagtctaatcagtcttggttttggagttgctatcatcagtagttccattttgtgattctttctttctgccttcatgtgcctttgaaaactgaaactatgcccaaattaaaacaagtttttctgtcttttcacatgttcacttatttcttgaatgtgtttttaaacacagacaaacttcttttacatcatgtagaatctgaaggtcgagaaatttgcagtcattttgctggagagagatgcttggcggagtcccaggccacattcctaggccaaactctcgaaggtattcctcttatgcaacattgggaaaatacatccagcaccgacatgttggctgataatgtgtctgaaggcacagacgatatgcttatcatatgaaacataaagccagcagatattgcagacattctgttgaatgatagaatctggatcatttacatttacttaaatgtaaaatactatgattaagtacaaaaaaatcaatttaggagagaatagagagttgcgggcacggttttaggggatgacttatcagcagattgtagaaaggaagcttgaatgttttaaattaactgcaagttcagtataagccagtggtgtgacaagaggctgttatcatagctactgaaattttgggctgcactgctagaaatataatactgaaatggagaagctaataattcttcactttttaaatagactgtatctagaatattatcatcagttcaaggaaatgaaataagttgttttaggtacatcatcgataaattagtgtacattcaaatcactgtgaccaggatgcatagggaatttgaaagcattgcatgtgagcaatggttgaggggacttggaatgcatgacttagggacaagaaaacttaggctggaatggcaagtggtttttgaatgttgggttgagaagaattctaaaactgtgaaggattagtaaaaataacattcagattgctaatgcctactgtggctgggagattagagtgtcaacatgtgtgatgtatttttgacatccttattttgaggatgggcttcaaagatttgacgaactgtcataagtgtaatttgtgttgcttcagacagcagttctagaaccaatgatgtaaatttagatactctacatggtagttagaaaactttccattaatttaatttagcaaatattgaatgctcactgcatacagagcactttattagaggaatatataataaagaaaaaagaggtctggtgtggtggctcatgcctgtaatcccagcactctgggaggctgaggtgggaggatcacttgagcccaggagatcattacgagtctggacaacatagcaagaccccatctttacaaaagacaaaaaaaattatccaagcctggtgacaggcacttgtagtcccagctacttgggaggctgaggcagtaggatcgtttgagcccaggaggttggggctgcagtgagccgtgattgtcccactgctcttcagcctgggtgacagagtgagaccccgttggagggaaggaagggaaggaaggaagaaaggtaggaaggctgaaatgaaacccttttagaaatgacactaaaatgggaggttggagtaaggtattttctgaagtgcctttgtacttgtttttttctaatgcattggccataagtctgctccttatttatagtccataaacaatcctaatgagaacagttatatatttctgcctttgaatcatctacttgaagtgtttagcatcatgaattgagtatcagaaatccctcccatttctttgcaaagcgctgtattttacttttccttatttgtatacagattctcaaaattggctatttttcctttgggttagacagaacagaatgtctggaaaaaaaagttcttatcaaattcaggtgcccaaattgcttaagaaattaacttttgaggttatatttttttagggttcagtagctaaactaagaaaacttctcaccgttcaccttcacttttggaaaccacaaaatcttcagatattacagttttccaaagagtttctctttttaaatataaactaaaaggaattgactcctcccccaactccctcaggcctcagcatggatagagttactttttttctttaataatttatttataacttattttgctcttctgtagaacagctggagattaagcaacatggccatgacataaaatgcaagttagaccataagatgagcagcccactccaagtatgaatgagtacttattctttgtgatctctcatactgcttttaggtattaatagtgtcagtcagcaaagcaaacagtttaatatttacatctcctttaggatatcatatagtttatagtttgtatgtgttcttgcgtgtatgttttcttctgtttcaaattcttttttcttaaagtaagaatgttatatgtagcaaatggttctttcattaattcatttgttaattcaccgtgcattaattgagtgcccagtgagtgtcaggcactgggctacttggatttcttttccctgtattgatccatatatcttcaggtgctccttgatatggctctccattgactctctcatataaggctttcattacctattcacatactccctcccaaagaggactggtccaaaagtaaaatcttgagcaagttctctgagttatttcagaacttcttgcccccaaactgtatttttaattattgactggtagcattttggaataacttacctctcttttttaaagattgaagttctttatcctctctgattttcaggtgtcagtttgtgtacaaattgagacaataaaaatgtttgttagacattttcttaaagcattttgctatgtgagaatctttcatgaagaactctttttaacaatgactctatagcagaagccacagtagagggagaactactgaatcaaagatggtgtttgagtctatgattttatgatggattttttttttttttacatacaaggatatgcatgggtcttttagtattcaggaatctgttcttcacttgacagtatttataaattgtgtgtttccccctaaaaaaacttaaattgtgagaatgcttccatttactagaagttggttaatgattatgccaaataaggaaaataagacagaaaaatcagtttagtgaatactattttgcctttaaatttagtaatttagtaacagtatctctttggggtttactagaaaccactttttaatccaataggtctctttcattgtgaagtcaggaggtgattttgcttaaatgtgtagtataggaatctatatgtggtgttcaaggatcatgtaaatatgctgatataatcggagcacagtttggcatcattaactcagaaatatttaaactcttgctatacaacatggaagcaaacttgtgcatagtttgtgtgtgtgtgtgtgtgtgaatctcaaaaaaagaaaaaaatcacaggatcaggaagtcggaataggtcccacttttcttctagtaccaaacctacagccatgttcctagccttctcttttactcccaagcaagacagacaggcaaatgaccatcctgctgcccatttctgtgtatattcacttgcattgagagttgtattcacctgcttgttgagagtattcacaaatggtacctgataaagtagatacttctttaaacatgtgaatttttttgcattgtataatgtttagaaataatcatgtataaatggttgaatattaatacaggattgccttatcaagtattttattaatcattaaaatgtggtgtcattaatacaatttattttaagtgcttttcctaaaataccagattatttttctgattttcacatccctgacaatgactttcttaaacttggtagccaggaacagaaaacctaacactgcatgttctcactcataagtgggagctgaacagagagaacacatggactcagggaggggaaccacacacactggggcctggagcagggggcaggggaagggagagagtgcgtcaggacaaacagacaaatagctaatgcatgcgagccttaatacctaggtgatgggttgataggtgcagcaaaccaccatgacacatatttacctatgtaacaaacctgcacattctgcacatgtatcccggaacttaaagtaaaataaaaaataataataaaataaaataaacttagtagcatctattgttccagagcctgtaattgctcttcaggcagtctcacataaaaacctaggagaaccttcactgtcactgttccatgaggtgttaggaaaacttgctctactgcagtgccccagtaggcattggtactgagaccaaaattcagctggtttgttgttactacgattcctacgtgatttcacttgtcatgtagacaagattgcacacttcaataataatcttgtccaaatgtgtggtattccatacatttttaaaatgcattcacatatctcattccatttgatcctacaaataactctataaaaaagattggcagacattatttctatataacagaggaggaaactggagcttagagaagctaaatagcaatccaaaatgcacagctgtagaaccagagcaaggatgatagcccagtgacttcacctaacctagtccccttaccaccactccagctgtctataaccaaaacctgcagtattcaagtaagaaaccatatcttgcccttgatgcattaatgtgagacctggagcaggaacaggctgatattgtcaccctggcctactgtccacctttgtctccagcagagactggtacccttctgtgtgccaaggaataaagtggtaatgggaagattaaaaatgttttttccaaggagttttttaatttaatttttttaaaaaagaaaaaactcttagagggaaaaatgaatatatgacttttgatgtattgttccttagtaacttagttataattttacttaaacctgagactcttgctaagtgaatgattagaaatattaggtggctggccagatggcaaataggaacagctgcagtctgcagctcccagagagatcaatgcagaaggtgggtgatttctgcatttccaactgaggtaccgggctcatctcattgggactggttagacagtgggtgcagcccatggagggtgagccaaagcagggtggagcattgcctcactcaggaagcgcaaggggtcaggggaactccctcccctagccaagggaagccctgagggactgtgccatgagggacagtgctatctggcccagatactacacatttcctacagtctttgcagccggcagaccaggagattcccttgggtgcctacaccaccagggccctgggtttcaagtacaaaactgggtggccatttgggcagacacccagttagctgcaggagttttttctcataccccagtggcacctgaaattccagtgagacagaaccattcactcccccggaaaggggctgaaggccaggcagccaagtgatctagctcagcagatcccacccccatggagcacggcaaggtaagatctgctggtttgaaattctcactgccagcacagctgcctgaagtcaacctgggatgctccagcttggtcgggggaggggcatccgccattactgaggcttgagtaggctgttttcctctcacaatgtaaacaaagccactgggaagtttgaactgggtggagcctaccacagctcagcaaagcccctgtagccagattgcctctctagattctccctctctgggcagggcatctgggaaagaaaggcagcagccccagtcaggggcttatagataaaactcccatctcatgggacagagcacctgggagagggggtggctgtgggcccagcttcagcagacttaaatgttctttgcctgttggctgtgaagagagcagtggatctcccagcacagcacttgagctctgctaagggacagactgccttcttaagcaggtccctgaccctcgtgattcctgagtgggagacacctcccagcaggggtcgacagacacttcatacaggagagctctggctggcatctggtgggtgcccctctgggacaaaccttccagaggaaggaacaggcagcagtctttgctgttctgcagcttctgctggtgatacccaggcaaacagggtctggagtggacctccaccaaattccagcagacctgcagcagaggggcctgactgttagaaggaaaactaacaaacaggaatagcatcaacatcaacaaaaaggatgtccacacgaaaaccccgtacaaaggtcgccaacatcaaagatcaaacatagataaatccacaaggatgaggaaaatccagcacaaaaaggctgaaaattccaaaaaccagaatgcctcttctcctccaagggagcacaactctttgccagcaagggaacaaaactggatggagaatgagtttgatgaattgacagaagtatgcttcagaaagtgggtaaaaacagactcctccaagctaaaggagcatgctctaacccaatgcaaagaagctaagaaccttgaaaaaaggttggaggaattgctaactagaataactagtttagagaagaacataaatgacctaatggagctgaaaaacacagcacgagaactctgtgaagcatacacaagcttcaataactgaatcgataaagcagaggaaaggatatcagagattgaagatcaatttaatgaaataaagcatgaagacaagattagagaaaaaaagaatgaaaaggaaggaacaaagcctccaagaaatgtgggactatgtgaaaagaccaaacctacatttcattggtgtacctgaaagtggcggggacaatggaaccaagttggaaaacactccttaggatattatccaggagaacttccccaaactagcaagacaagccaacattcaaattcaggaaatacagagaacaccacaaagatacccctcaagaagagcaaacccaagacatgtaattgtcagattcaccaaggttgaaatgcaggaaaaaaagttaagggcagcgagagagaaaggtcgggttacccaaaaagggaagcccatcagactaacagtggatctctcagcagaaaccctacaagcctacaagccagaagagagtgggggccaatattcaacattcttaaagaaaagaattttcaacccagaatttcatatccagccaactaagcttcagaagtgaagtagaaataaaatcctttacagacgagcaaatgctgagagattttgtcaccaccaggcatgccttacaagagctcctgaaggaagtactaaataaggaaaggaaaaaccggtaccagccactgcagaaacataccaaattgtaaagaccattgaaactatgaagaaactgcatcaactaatgggcaaaataaccagctaacatcataatgacaggatcaaattcacacataacaatattaaccttaaatataaatgggctaaatgccccaattaaaagaccacagactggcaaattggataaagagtcaagacccatcagtgtgctgtgttctggagacccatctcacatgcaaagacacacataggctgaaaataaagggatggaggaagatctaccaagcaaatggaaagcaaaaaaaaagcaggggttgcaatcctagtctctgataaaacagactttaaaccaacaaagatcaaaagagacaaagaaggccattacataatgataaagggatcaattcaacaagaagagctaactatcctaaacatatatgcacccaatacaggagcacccagattcataaagcaagttcttagagacccacaaagagaccaagactcccacacaataatagtgtgagactttaacaccccaatgtcaatattaggtcaacgagacagaaaattaacaagcatattcaggatttgaactcagctctggacccagtggaactaatagacatctacagaactctccaccccatatcaacagaatatacattcttctcagcaccacatcacacttattctaaaattgaccacataattggaagtaaaacactcctcagcaaatgcaaaagaatggaaatcataacaaacagtctctcagaccaaagtgcaattaaattagaactcaggattaagaaactaactcaaaaccatacaactacagtggaaactgaacaacctgctcctgaatgactactgagtaaataacaaaaagaaggcagaaataaatacattatttgagaccaatgagaataaagatacaacataccagaatctctgggacacagctaaaacagtgtttaggggaaattcatagcaataaatgcccacaggagaaagcaggaaagagctaaaatcaacactctaacatcacaattaaaggaactagagaagcaagagcaaacacattcaaaagctagcagaagacaagaaataactaagatcagagcagaactgaaggagattagagacacaaaaaacccttcaaaaaaatcagtgaatccagaagctggttttttgaaaagattaacaaaatagatagaatgctagccagattgataaagaagaaaagagagaagaatcaaatagacgcaataaaagatgataaagaggatatcaccactgatcccacaaaaatacaatctaccatcagagaacactataaacacctctatgcaaataaactagaaaatctagaagaaatgaataaattcctggacacatacaccctcctaagactaaaggaagaagtcaaattcctgaatagaccaataataagttctgaaatcgaggcagtaattaacagcctaccaaccaaaaaaagcccaggaccagacggattcacagctgaattctaccagaagtacaaagaagagctggtaccattccttctgaaactattccaatcaatagaaaaggagggaatcctccctaactcattttatgagtccggcatcatcctgatacaaaaacctggcagagacacagcaaaaaaataaaattgtaggccaatatccctgatgaacattgatgcaaaaatcttcaataaaaaactggtaaactgaatccagcagcacatcaaaaagcttatctaccatgataatttggcttcatccctgggatgcaaggctggttcaacatatgcaaatcaataaagataatccatcacataaagagaaccaatgacaaaaaccacatgattatttcaatagatgcagaaaaggcctttcataaaattcaacagcccttcatgctaaaaactctcaataaactaggtattgatggaacatatctcaaaataataagagctatttatgagaaacccacagccaatatcatactgaatgggcaaaagctggaagcattcatttgaaaaccggcacaaaacaaggatgccctctgtcaccactcctattcaacatagtattggacgttctagccagggcaatcaggcaatagaaagaaataaagcatattcaaataggaagagaggaagtcaaattgtctctgtttgcagatgacatgattgtatatttagaaaaccccatcatctcagcccaaaatctccttaagctgataagcaacttcagcaaagtctcaggatacaaaatcaatgtgcaaaaatcacgagcattcctatacaccaataatgacaaacagccaagtcatgagtgaactcccattcacaattgctacaaagagaataaaatgcctaggaatacaacttacaagggatgtgaaggacctctttaaagagaactacaaaccactgctcaatgaaataagagaggacacaaacaaatggaagaacattccattctcatggataggaagaatcaatatcgtgaaaatggccatactgcccaaagtaatttatagatccaatgctatccccatcaagctaccattgactttcttcatagaattagaaaaaactactttaaatttcatatggaaccaaaaaacagcccgtatagccaagacaatcctaagcaaaatgaacaagctggaggcatcatgctacctgacttcaaactatactacaaggctacagtaaccaaaacatcatggtactggtacataaacagatagatagaccaatggaacagaacagaggcctcagaaataacgccacacatctacaaccatctgatctttgacaaacatgacaaaaacaagcaatgcagaaaggattccctatttaataaatggtgtcgggaaaactggctagccatttgcagaaaactgaaactggaccccttccttacacgttatacaaaaattaactcaagatggattaaagacttaaacataaaacataaaaccataaaaaccctagaagaaaacctaggcaataccattcaggacataggcatggcaaagacttcatgactaaaataccaaaagcaatggcaacaaaagccaaaattgacaaatgggatctaattaaactaaagagcttctgcacagcaaaagaaactaacatcagagtgaacaggcaaccgacagaatgggtgaaattttttgcaacgtatccatctgacaaaaggctaatatccagaatctacaaggaacctaaacaagtttacaagaaaaaaaacaaccccatcaaaaagtgggcgaagggtatgaacagatgcttctcaaaagaagaaatttatgctgccaacaaacatacgaagaaaagctcatcatcactggtcattagagaaatgcaaatcaaaaccacagtgagataccatcttatgccagttagaatggcgatcattaaaaagtcaggaaacaacagatgcaggagaggatgtagagaaataggaacacttttacactgttggtgggagtgtaaattagttcaaccattgtggaagacagtgtggtgattcctcaaggatctagaaccagaaatatcttttgacccagccatcccattactgggtatatactcaaaggattataaatcatgctactataaagacacatgcacatgtatgtttattgtggcactattcacaatagcaaagacttggaaccaatccgaatgcccatcaatgatagactggataaagaaaatgtgacacacatacaccatggaatactatgcagccataaaaaaggatgagttcatgtcctttgcagggacatggatgaagctggaaaccatcattcttggcaaggtaacacaggaacagaaaaccaaacaccacatgttctcactcataagtgggagttgaacagtgagaacacatggacactgggaggagaacatcacacactggggcctgtcagggtgtaggaggctaggggagggatagcattaggagaaatacctaatgtagatgacaagttgatgagtgcagcaaaccaccatggcatctgtatacctaggtaacaaacctgcacgttctgcacatgtaccccagaacttaaaagtattattattattattataataataataataaaagaaatacaataaaatagaatgcagcatacagcagtgattctcaaacacattcagcatcagaattacccttgaatctttaaaatatatatacatatgagatcttagtctccaagatttgtaagtttggtattgggtccctgggcctatgttgggtttagaaacttctacagatggtttggatgtatgggacagtttaagaatcgctgaactaaaatcaaataaactgaatatcctgtgatttagagagacttatcgtttatttcactatccaagtacttgcattagagcgtggctagaagggatttgcagccttgtaaataatcagaaattcagacattttgagatgagagaactgctgaagattttattctgacttgaaataaattttctaattagaaacttccaggtgagagcaaaggcctggaacaatattcctgagccagaggaggatcgagtttgactccaggcctaacacttactaggtctatgaccttgggtcagtaatttaaattctctgtatctcaacctctcaacagggtattggtagggattaaatgtgttagtgtctgtgaagtgcttagagcagtgcttggcatagtaaatgcttaatgaatttcagccactgtttttatttttagtactttccagctcccccaaaaagatactttttttagacttgtattaagacaataaaaagtttaatcagcatgcttcatacctaaatatgcttcactttatagcaaagtttacaagactaaaactgttttgttgtaattctctgagtctcatgtgtttattaatgattttttctgctgtttattcatctgaattctactcattcttcaagacctagctggaatcctgtttctagaaagactcttgcccataataataaacctgccctatctgagttcctaggtggtctgtacctcataatttggtaattaattgtatatgcacttatataacaaaacattattgtgtgtctttgctgtatcagattctaggctggaagttgtagatatgatgtttttgtctagaaaaatgttctagaatgtcctactcaggacagtctgttgactttaaagacacatttcctaaacagacacttcatgaggcagccccagcctgtacctgtgttcctggacctgatgatcaagtttgatttaagcctcaccacttactagctctgtgattttgggcaagttacttgaattctctgtgtgtagatagaacaatgttgagggaaatccctttcccccatccttgtgtttccacaagggaacttgcttcctaataagtaacactttcaggggaatattctaggcccttctcttatccccattacttgttctttctgtgaaaagaggagaggttaatctgatggatgaaatccttaatctttcatcttctggactgtagagcctgtgaaccaaagcaatggaccacttgcactgaaattgaggctgaccctgtattttgattcttatttggcaacttatttctattctgttcccaattcaaaatcccaaggggagaaggaagataattgattaccagaagtatgtaatggtggtaggaagttgaataaatggtaactttttaaaagttgcatgagatatagtccttatcccagagaagctaagtttgcttttctttcctctcatgtattttagtattatttctacaattagattgtaaaccctttaaaagcaagaatatttctacattttcttactcctgatagcacacagtagactgctgggcacatacatagtaggtggctctgtaggtacttgctaaatgattcaacatgtttttccctcatggaaaagaaagatttcagtattgttcttatcagctaggaaggcactctgaataggaaatcagttctaggcaggtatccataaatgggttatgatttccaacttacttgccccagaggctcgctaatgttgaactcttcatgggtactttgtcttgcttcatgagctatacatgctaaggggttagcagatcatataatcttttgatctacaaaatatgatctttattgaacaaaaacttgggccaaaggcctttctcctttgccaccttcctccctcttttcattctcttttttgggaatgccctttgtgcatgttagttacagcatgtaccacattgcactgtattgttggtttttgggtctaacccacccttaacactgcagtccccaagggcagaaattcagtctcattcattttgatgtcctcagtgcctgtgctcagagaatatctattatttgaaaaaatagtgcaaaagtaaattttaggagactacatcacactcatctaaactgcaagtttgacaagttgacatccaaaagaaaggctctcctaaataacctcgccacagaaatttgggtgacctttgtagctctggagaaagcagaggcaaaaatgaaacctaaaaattatttgtgggtttttaaaaaatgttttctcatggagtaaaggtctacagctgagttcttttcatatgagggaatgacagaaacacagctggttctgactttcagcttcaactgagcgaccagagctctgctggtgaaacaggaacttgtattgtgcccctgacgtgcaccttgaaggtgtcagctcattgtccctttgttcacataaatagttttttaagaattgtttttgatcttgtgagcctctaactaaatgattaaccatgcaaagttggccatttggggtaatactgaagcacttctcttgagggctattgacaggtgggaatgtgcccacctccttgggtctctggttttcatgtcatacttgcaaatcagtgacagtttaaacttggggcaatcacttagcaagtctattgagttaccaagttaattattcccactttgcatgaagcaaccttgaaaatgattttcctaaagcaaagtacatccaaactcagtaccttcttaataacctttgctgaatgaataaatgactaattcataaaaaatgtaacatatctttaattcttacttacgggcagtttaagcctcttgtgtaagaggaggcctcggcttgagataacataggatagtaagcctcctagagaaatttctatatggaaacatggtctgctatgaagctagaagtgagaggacattatatttgaccattatatttggcttcagagcttctcaacatggggcccaaagtcaaggtcccttgtttcattaagaggaggtccaggagtgcatgacacccatcagactactgagacccagctggaactaggcaccttgcacaggggccttgcctaatcaaaatagttcttattttttctgagttccaagtaactagtttcctaacccagtgtctggatagtagtgccaagtgggagtaccttcaatgaacttcctcatgaggttatttctagcctattggaatgtttcgttttaggagggtgaggaagggaagtcttgaatttttgtgcttagtttaatgttgtgatacagctttgaccatccgtttaatgggagatctgttttccagatgactatacatgtggaaaggagaagttttttgagtgttttttttaaccccttttaaagaatggtttttcatttagtctctacatttgggggtaaaaggtcctctagggagacttttcaaaagtatttgaagtttgcatctgatttcagaggtgagttggaggcctatctgtgtatgacagacacatgtctccaacaactatatgttcacaaggactaagagccatccttttgggtccatcattcaacattgatctcacattcgtgttcgtatcagtatctttacagtgcgctcccagttacatctccctaatttcccttagtaggcttcacagaatttgcagtgtatgcaatggcagatgaccacatgtggagtcatttaaccacatcttccactgcaagtcagcccgctcttgatgtctgtttatgtttagattccatcttttggaagatttcattcctctgcactatctcagtatctcagatgcttttgagactgggtccttttcccctcctatgtttggccatggccaccccctcagggttgtgttgtgtttcacagctgctgtttgtagggttgacctttacaatgtacaaagctctttcccatatgttgacaatccctggtgtgatgctgtgagttaggcagggtgtgtatacgtgtcctcatcatattacagtggtaaggcaacagggtttttgaatttgatcacccatgaatttgtctaatttgttggtaaaaaatggtcatgtatcagccgtttcacagggtcagcttaatagaaagtgggagttaggcaggaccagaattcaggacttcagcccccggtcccagggactattctctatacccaattgtcccaccttgaatcagtttcttctagggaaatatctccaaaactgagatggcacccacaggacttcttaattgtagtcattaccaggaaaaacaagcaaaggaactggtgtaaatctctgtttttggtgattggtggagatttggagattgtcttgtgtcaaaagtaaagccactagattaaatgttttgttaataaattggttatttttaatttaattatttgacagttaatttacattattcaaaaatcaaaataaaatttaaaagaagtttacactgaaaagtcttgccccacttataccctgctcacctcagtatcccccaatacataccatctataaggtgatcatttgtattagtttcttgtgaatccttgatagtgtgttttatatagatacaggtaaatatgagtatgtactattatttcccccccaccccaccctgttttttttttgagacggagtctcgctctgtcgcccaggctggagtgcagtggcacgatctcggctcaccgcaagctccaccattttcccccatttttaaaacaaaaggtagtagccatatatacactattttacaccttgttttatcacttactaatatataccagagagctttccatcattttgtacatatgcacctatatctgtcaattattcccagaagtggaattgctgggtcagcaggaaaaatcatgtataattttgataggtattgcctaattgtcctgcacagggcttgaattgtttgtactcccacctttagtgtatgagaagacctgtttctccatagcctcatcaaacagagtgtgtgagattagatgagaaataggaggtgagcagtcttttaccccatccgtagtttgcagtgggaacactgcacagttgcaagagctggtgcaggtatcagattagttccagtggaaacgctgcctcaccatggccatgggcttgcgccagctctagtgacacacacggaatggacccacgttgccacttgcagaatttcctgtagcagaaagttgaacatgcattcattattcatctaactagccatgctggatctaaagagcacaacagtgttttttagaaccaaaaagaaaattgtttcactacaacacactgtgtataaggctttcaatgctcttttctcagctattaacattattttcaggactgagttcaagagatgtatcccaaatcacagggatgtcttgctaagcttggaactttcatactcaagggatgcttttttgaggaatgattttacacttactcaacatttgtaattaaataattagtactttataagataaatttaaactgtccaagtacaatataaacattgaactatgatgcattattgctagactttttccttaaagttgccaagtggtttcctgcattaggcaaataggggatcatataaaaatgccatgatttacggcctagataacatctccaccatttgagcagcatatattccaggtcatccccacataactccttaccattctcattagaaaggttgattcttagtcttatttttctctgaggacagcaaaaaaaaaaatccccttcagttccactgcatagaaaagtgtggtaaatggagccgggcacagtggttatttaatttaaatggacaatattttttatagaattttgacagggccactgtataggggaaagtcactcctcttcccctttatagaagagttgcacctggacagttgcattgatgactgtatccagtctacacaagaggtcattcctgggcataagaatggactgccaaaatctagctgaaacaccattgacaaatagacattttcttttgttaataatacctgtgaaggctttcataacagacatttccagttttgttctcaggctccttgcagctgctcctctaaaagtgtgctctcttccaagagctgacaatggccagaagcaaggtgttctgtcttttgtgccatcatcatctaacttgccacacacatttgggatgtcagcctaggtataggttttgtatccactcagtatggcttgtgggtctggttgcctttgttattcatgctgagggcctctgggcatcagtttggtgtgagagaacccattccatgaccctccttcctttggctgttttgactcgatggctcttgttggcacagtctgtgagtgtctgatgctctatccatgccggaccatctgttctgctgtctctgtggtctgaagtcgttttctgaactattccttgataataaatttgagatgatcttgttctacctttcttttcaagtcacatcttagccccttagccacattcccgaagaacatgacaaatggatgggtcacaagtcacgtagcatagggtgtcagaccacgaggctttgaagggattctgttgggtgctaaaaagaaagattttgtgtcaccacgattttttttaaaggcatgttgacacttaggccttaattgaaagcgttcttactcaagtagagttgacagaggagtatttggtagtcgcggttgctggtctgaagagcatgtggttctgtttcaatgcccaatgagatcttctcacgggaaaatgttctgacatctcaaacaaatgaccttcatgcatagttttgacaaaataccctattaagtatgcatatatggttggtaccttgtggtaataattcaatactggaaacagagtagcaacaaagaaacattagggttatatttaacctctgtggaattagtgtgtaaacaaactgcttatcagaaatgctcatatggggctttgtttaaataaataagaaactggcatatagggtctgcaggatatttctgccaagtagacctccctcacattataagacaccacatctatgtctgaccccatatggaaagaggcatagcaagccagcactggttcatattccctctccaccacataatgggtatgtgatcttagggaatccaccgaaactctctgggcctcagtttcctcagctataaatggtggataatcaaattatttacctcaccattaataaatgttagctattattttttatcaagtttaatacaaagagaaacattttacttatttttccagctatccagagcatcttccaaaatcctatcaccaacaaatactgtattgtatttattatagcaactatgtaaaaatggagtccctgtcctatgcttagatgaaatatgttggtatttgagtttgcatgtcttctataggaatcagtgtttagtgaaaacgggtggagataaacagatgttttcacagtcctgttgttcacagtaccgccaaattgaatgtttccatataggtgcattctaatggcttaaatgatgcagatattttctggccagccatatggatcttttgtcatctaagatgttaatattttccttatattttatagtagttctggagtacagccagtttcttgaatagggtccacatggctcattatgcacagggcctggaaactgccttactcgtgctgttgaaatgaaccgtgacacttcagaagagctgggagctggggtagagcagtggctaggagaacatattcaattatatttcctcctgcattaagctacaagtaatgagcactttcctgtgctttacagttaagtaattaaaagaaattatagagtgggatgcaaaaataacccgaaggacaactggatgtgtggagccaccagttttctccatgagtgcacaaggttaatccttgttactactcagaatgctgagtttctacagaaagggttgcaggtccacacatgttttggcgtctacccacacgcttctgtatggcatgactgtgcatcccagaagaagggctgtgctgtgtacctccacgtttcagtggaatttaacaaactgatccctgaaaatggtttcataaaggtgagtaacagagagctaatagccttctcttgctaattttatctttcccccaagatttcttgataatagtttgaaaaggagtgttattctttggtctctagaggcaacttacctttccagtttcttccatcacctgttttcatctctcttgtttttttaaatttaatgctgtatgtatttcagaggataggatctaatctagtgcggtcccttcatcaggtgagaattattcatctcattttcattttagcccttctgaattaatgacattgaagcccggcagtttggtcctaagatgggtttaattatgtacagatactctttctataatggaaattgctcagataactaattaaccacaagaatacactgtctatggaaaatttcaggagcaccgtctgtggaaaaactgggaagggcatgctgtcaccacagctctggggtctattaaaagtgtggttatgcagcactggtgtctagtggggtgttggctctcaactgccagaattcccatagcatttcatggcagaaagtcaaggtgtccagcaatactctgaaagtgacctgttgattaaagtcgtcaattctgaagaaagagactgaaataagacaaatgggtcttaactttttttctctttctctctcttgtaaaaatgtgtgattgttctggcatgttcccaatccccacataatgccaacatcttttcttaaagggggattccctttatccttggatctgagaattattgcatgttctccctttagggacaatgaatgcagttgcatcacccttgcttttttttttttttttgtacacagcatgcttattcttggatgcagggacttgaaagacaaagccccacctggctttcacaacatctcctattagtaggtgtgccttgtgtgtaatttgaaggaggcggtcccttagctgtgtttacactgtacttttaaatgtggggctgaaggtagaatcaaccatacttaagatgccacctgggaaaatagggttctgtgtcatctcagccccacccatttgcaaatgacttaacagcagcactattagggttcctagtgtgagtcatttgcatttggactggtgaacttggtgacttcttggtgtttggaaacaaacaacctttgcagtctttcgtaaaaagcctgaacagtggaccagtctccagttctacttgcaaagctgcccccatcaaatccctcataatgttcaacttaaaaaatgttacacttttctctggaaatctaaccttttttccttttttaaaagccattttaagtacttcagtcttgaatcaaatgatcccaaatattggacaccaacctagaaattgggttacctcctgggaactttatcgaagaagagagattttggttggagagggggttttgatgtttgatacttatatttactattttaatatttcattgttgttgttgctgctgctgctgtattattttgcgagtttcgtttgtttaaatttcatggtatttggtaggagagagctggatctgttggtttcaggacaagtctagaaataagaaatctgccttgagtgagtgagttggttccctctgttgctatttcaccattaaggacgaaaggaactcacaaggaccagagacatctggctgaaagcaatactagtgtgactggacatctactacctgccatagttggtcatatcgtttccagtatgattctgattgagtgagtgatattaggctatgttcagggatcagggaggctaattatgcttatattgccttgtagcattttggtaagaattaatgattgtgtagatgtccagatttaggtcagcaatattctaaaagttctcattgaactaatcatgtttataagtagcctgtactttctatcataataacaatagtggaaaagctagttgacataaaaggagcccagattttacttaagtaaaaacacaaaagcaaagatattttcccacataaattacaaaagcaaagatattttcccacataaatgtccccataaaacaagttgaaccaaagaggaaagatgacaggtaaccgtatgacacgctaagaaagtatcataatacttaagttaacttcaaccttttatttccttatcctaagcagcctcttttctctttatcatttagtcctgtgcttctcaactttgataagtaaaaaagttattgcactaaataaatcttattgaaatgcaggatctgattgagtgggtggggtaggtggaatgagggtggggaagttgagattctgcatttcttagaagtttctactttatgttaaaatggctaatccatctcaacattgagaagtaaggtttcacttaatttcagcctgtgtaagtttatcccatatgtacatttcctaaaactctaatctcaggccccaggaatttctcctttagttaaaatatttttaggaataaatttgaattgcattaatacacaatttataaatttaacacaaaaaattatttgaagtttgagactttaggttgcatgaaatcaatttcatacttgaaaattttctataaattcaaaagtctgtgtatttaaatacaatttaaatacctgtgttacagtgacatttgtttttctgtctctctctccaccatttccagagtcatcatccctgtacagaaaaatttttcccacatgatttcaccataaattcattaaatatgatgcttacttgataatttctccaggttctttttttttttaattatactttaagttctagggtacatgtgcacaacctgcaggtttgttacatatgtatacatgtgccatgttggtgtgctgcacccattaactcgtcatttacattaggtatatctcctaatgctatccctcccccctacccctactccatgacaggtcccagtgtgtgatgttccccaccctgtgtccaagtgttctcattgttcagttcccacctatgagtgagaacatgcggtgtttggttttctgtccttgcgatagtttgctcagaatgatgtccttgctcactgatggacatttggttggctccaagtatttgctattgtaaatagtgccgcaataaacatacgtgtgcatgtgtctttatagtagcatgatttataatcctctgggtatatacccagtaatgggatggctggctcaaatggtatttctagttctagatcctagaggaatcgccacactgtcttccacaatgtttgaactagtttacagtcccatcaacagtgtaaaagtgttcctatttctctacatcctttccagcacctgttgtttccggactttaatgatcgccattctaactggtgtgagatggtatctcattgtggttttgatttgcatttctctgatggccagtgatgatgagcattttttcatgtgtcttttggctacataaatgtcttcttttgagaagtgtctgttcatatccttcacccactttttgatggggtcatttgattttttcttgtaaatttgtttaagttcttttagattctggatattagccctttgtcagatgggtagattgtaaaaattttctcccattccgtaggtttcctattcactctgatggtagtttcttttgctgtgcagaagctctttagtttaattagatcccatttgtcaattttggcttttgttgccattgcttttggtgttttagtcatgaagtccttgtccatgcctatgtcctgaatggtattgcctaggttttcttctagggtttttatggttttaggtctaacgtgtaagtctttaattcatcttgaattaatttttgtataaggtgtaaagaagggatccagtttcagctttctacatatggctagccagttttcccagcaccatttattaaatagagaatcctttccccatttcttgtttttgtcaggtttgtcaaagatcagatggttgtagatgtgtggtattgtttctgagggctctgttctgttccattggtctatatctctgttttggtaccagtaccatgctgttttggttactgtagccttgtaatatagtttgaagtcaggtagcgtgatgcctccagctttgttcttttggtttaggattgtcttggcgatgcgggctcttttttggttccatatgaactttaaagtagtttttttccaattctgtggagaaagtcattggtagcttgatggggatggcattgaatctataaattaccttgggtagtatggccattttcatgatattgattcttcctacccatgagaatggaatgttcttccatttgtttgcgtcctcttttatttccttgagcagtggtttgtagttctccttgaagaggtcttccacatcccttgtaagttggattcctaagtattttattctctttgaaacaattgtgaatgggagttcactcatgatttggctctctgtttgtctgttattggtgtataggaatgcttgtgatttttgcacattgattttgtatcctgagactttgctgaagttgcttatcagcttaaggagattttgggctgagatgatggggttttctaaatatacaatcatgtcatctgcaaacagagacaatttgacttcctctcttcctatttgaatatcctttatttctttctattgcctgattgccctggctagaacgtccaatactatgttgaataggagtggtgacagaggacatccttgttttgtgccagttttcaaagggaatgcttccagcttttgcccattcagtatgacattggctgtgggtttgtcgtgaatagctcttattattttgagatatgtcccatcaatacctagtttatttagagtttttagcacaaaggctgttgaattttgtcaaaggccttttctgcatctattgagataatcatggtttttgtctttgattctgtttatatgatggattatatttattgatttgcatatgttgaaccagccttgcatcccagggatgaagccaacttgatcatggtggataagctttttgatgttctgctggattcggtttgccagtattttactgaggatttttccatcgatcttcatcagggatattggcctgaaattctctttttttgttgtgtctctgtcaggctgtggtatcaggatgatgctggcctcataaaatgagttagggaggattccctctttttctattgattagaatagtttcagaatggtaccagctcctccttatacctctggtagaattcagctgtgaatccatctggtcctgatggatttttttggttggtaggctattaattattgcctcaatttcagagcctgttattggtctattaagagattcaacttcttcctggtttagtcctgggagggtgtgtgtgtccaggaatttataaatttcttttaggttttctagtttatttgcatagaagtgtttatagtgttctctgatggtagtttgtatttctgtgggattggtggtgatatcccctttatcaccttttattgcatctatttgattcttttctcttttcttctttattagtcttgctagtgatctatcaattttgttgatctttttaaaaaaccagctcctgggttcattgattttttgaaggagtttttctgtctctatctccttcagttctactctgatcttagttatttcttgtcttctgctagcttttgaatgtgtttgctcttgcttctctaaattgtgatgttagggtgtcaattttagatctttcctgctttctcttgtgggcatttagtgctataaatttccctctacacactgctttaaatgtgtcccagagattctggtatgttgtgtctttgttctcattggtttcaaagaacatctttatttctgccttcacttcgttaagtacccagtagtcactcaggagcaggttgctcagtttccatgtagttgagtggttctgagtgagtttcttaatcctgagttctagtttgaaagcactgtagtctgagaggcagtttgttataatttctgttcttttacatttgctgaggagtgctttacttccaactatgtagtcaatttttggaataagtgtgatgtggtgccgagaagaatgtatattctgttgatttggagtggagagttctgtagatgtctattaggtccgcttggtgcagagctgagttcaatttctggatatctttgttaattttctgtcttgttgatctgtctaatattgaccgtggggtgataaagtctcccattattattgtgtgggagtctaagtctctttgtaggtctctaaggacttgctttgtgaatctggtgctcctgtattaggtgcatatatttttaggatagttagctcttcttgttgaattgatccctttatcattatgtaatggccttctttgtctcttttgatctttgttggtttaaagtctgttttatcagagactaggattgcaactcctgcttttttttgctttccatttccttggtagatcttcctccatccctttattttgagcctatgtgcgtctctgcacatgagatgggtctgctgaatacagcacactgatgggtcttgactctttatccaatttgccagtccatgtcttttaactggagcatttagcccatttacatttaaggttaatattgttatgtgtgaatttgatcctgtcattatgatgttagctggttattttgctcgttagttgatgcagtttcttcctagcctcaatgatctttacaatttggcatgtttttgcagtggctggtactggttgttcctttccatgtttagtgcttccttcaggagctcttgtaaggcaggcctggtggtgacaaaatctctcagcatttgcttgtctgtaaaggattttatttctccttcacttatgaagcttagtttggctggatatgaaattctgggttgaaaattcttttctttaagaatgttgaatattggcccccactctcttctggcttgtagagtttctgccgaaagatgctgttagtctgatggacttccctttgtgggtaacctgccctttctctctcgctgcacttaatgttttttccttcatttcaactttggtgaatctgacaattatgtgtctttgagttactcttcttgaggagtatctttgcggcattctctgtatttcctgaatttgaatgctggcctgcctcactagattggggaagttctcctggataatatcctgcagagcgttttccaacttggttccattctccccatcactttcaggtacaccaatcagatgtagatttggtcttttcacatagtcccatatttcttggaggctttgttcatttctttttactcttttttctctaaacttctcttcttgcttcatttcattcatttgatcttcaatccctttcttccacttgattgaatcagctactgaagcttgtgcatgtgtcacatagttctcgtgccatggttttcagctccatcaggtcatttaaggtcttctctatgctgttttttctagttagccattcgtctaatgttttttcaaggtttttagcttctttgctaaaaggttcaaacatcctcctttagctcggaggagtttgttattactgatcatctgaagccttcttctctcaacttgtgaaagtcattctctgtccagctttgttccattgctggcgaggagctgcattcctttggaggagaagacgtgctctgatttttagaattttcagcttctctgctctggtttctccccatcttattggttttatctacctttggtctttgatgatggtgacgtacagatggggttttggtgtggatgttctttctctttgttagttttccttctaacagtcaggaccctcagctgcaggtctgttggagtttgctggaggtccactccagaccctgtttgcttgggtatcaccagcagaggctgcagaacagcaaatattgcagaacggcaaatgttgctccctgattgttcctctggaagcttcgtctcagaggggcacctggccgtatgaggtgtcagtcggcccctactgggaggtgcctcccagttaggctactcaggggtcaggaacccacttgaagaggcagactgtccattctcagatatcatattccatgctgggaggacccctactcttttcaaagctgtcagacagggacatttaagtctgcagaagtttctgctgtcttttgttcagctgtgccctgcccctagaggtggagtctacagaggcaggcaggcctccttgagctgcggtgggctccacccatttcgagcttcctggctgctttgtttacctactcaagtctcagcaatggtggacacccctcccccagcctcgctgctgctttgcagttcgatctcagactgctgtgctagcagtgagccaggctccgtgggcatgggaccctccgagccaggcctgggacataatctcctggtgtgccgtttgctaagaccattggaaaagcacagtattagggtggggagtgtcctgattttccaggtaccgtcagtcatggcttcccttggctaggaaagggaattccccaaccccttgtgcttcctgggtgaggtgatgccccaccctgctttggctcatgctccgtgggttgtacccactgtctgacaagccccagtgagatgaacccggtacctcagttggaaatgcagaaatcacccgtcttctgcatcactcacgctgggggctgtagactggagctgttcatatttggccatcttggaacctccctttccaagttctttattacagagtgggtcactgaaacttcatggaacaaattggaaattatcttcttaattaatgtcactgtctaccatgtatgggaatttggtaaatattatatggtttcaataacatagtagatagaacattgtcaaatctaaacttcagtgaattgtaacagatcccacctgaaattctaaagaaaacagaattctaattgaagaggttaaacttttacagggaatgtcaactgccatttgggtcctgtaaacaaaaaactgttttttaaaaaagtaaactttaaaagtattttcagatgacctcatttgctatccaagtggcttgagtatgcttgatgctaagacttctttgttacagactggagatgtgtgctactggggcagtgttgctctgtgacaaggaggcagaggatgagggcaaggttcgatgtgactgtgaattctgggtggctctggctatcgggagccttcattgattacagcaaaacagttgctttcctagggcaatagtgtctctgtcacccaggctggagttcagtggcatgatcaatcgctcactgtagcctcaacttcttagactcaagtaatcctcccacctcagcctcccaagtagctgaaactacaggtgtgcaccaccacacctaatttttttaatttttaagtttttgtagagacatggtctcactgtgttgcccaggttgatctcgaattcctgggctctagtgatcctcccgcctcggcctcccaaagtgttgggattacaaatgtgagccactgcacctggccctttgcaaccttcttgacaatgcattcctttattccctaactggaagtaacttctttctctttataaaattgtatctgtaccttttctgggtcatttctacctttatattctagttacgtatgtcctacctccctcctagggagggaggtaagtaagactggaaagtagacttcatgtgtgatgaatgaatgaacaaaaggaagtctaacatatggatatagtcaactggatgcaaattaaaaatttttaaatattgatttgcaagatttcattaaggtcaactcttaatagtttgtatcatatatgttaggaaccaaatattaataacttcttcagcattaccattatctttataggactgtctaaaatgagcagccatatctttaaactgtgttttctctgattacacgctcacaggtaaaacccaaaggggctgggaacaaacaagacttttttttttttctgtatgcctgaattatctgtactgttgcttgttttcccacctttggccatagaaacttagttctaacatgctacaatttttgcagttctttctcttagaaaaagaccacattgtctgaaatttcatccatttaagtaatcaagccttaaagttgaaggatcttggtcatgattaatctagacctacaaagtagtatcttaatggcactccttttagaaagttaggttccaggacacacatagctgcagtgtccacattttgtaagctccttcgttgtcacagccactctcttctctgtggctgatattctaaaactggcaacacatcctgatggtaaaagcttggttcaggagacaggtgacctactagctttatggcatttgacaggttacctaacctctctgacgcataattgcctcatctatataatggggataataatacccatcctgtctccttgtaaaaatcaaattagatgacgcctgtgaatgttctatagtctcttagacaaatgtaagttatgactacagcaagagtaaaagagcatgttgttatggacattctttcagtgaaatgtctaagacttgtgagtcacacttaaagctaaacttgatatctacttcattgattttctttttagttctatgtactatattgaatttcctgacagtggggctatgaaagccttcctagcattttatagatgtggttgaattaatggctgtaagccttaaagcagaattagacagcatcaatgaatttattaagtataaataaatatataatctgcttagcaatattacacagcctctttatcttatgtgtgataaagagtcatccgaaggttgaaaatgaagaattgtcctggaagctcttacttaatcttttattatttcctaatacagtatataaaattactcattgaaagcttagcagaataagaaacaagaagttaaaaggctgaaaactacaaattttgctattattattgttattacttcccaagtctcttattgatctgttagaaatagagctacacaggaaattgtaggacagttagtatgtggtagtgttatctgctttttaattattcaagtaaggttttattccattagaggaactcaagaagttggtcatggctgataattgctatctgtcaaattccttagagcagggatccgcaacacccaggccatggattgttaccagtccctggcctgttaggaaccaggctgcacagtaggaagtgagcggcgggtgagcaaacattgccatctgagctctgtctcctttcagatcagcagcagcattagattctcatagaagcatgagccctgttgtgaactgcacatgcaagggatctaggttgtgtgctccttatgagaatccaattccttatgataatttaactgatgatctaaggtggaaccatttcatcccaaaaccatccaccctgctactcccagaccgtggaaaaattgtcttccacaaaactggttcctgctgccaaaaaggttgggaccactgccttagagtttataatttggggttagcacagcctatatttacctgagaatttcaatgggttcactgatctttccaaatgaaaaggcttcttacgaaaattatatccaaactgtcttttctcttagtttaataaacctatcagtaagtttttactgagtactgctattacatttttctctgttaagcattatgggggctcagacatgatccattccctcaaagaacttacctttcagctgaagactgactagaatgagcaaatacggttaacaattaacaagtgagtaggccagctcggccaacatggtgaaaccctgtctctactaaaaatacaaaaattagccgggcatggtggtgggcgcctgtaatcccagctacctcctgctgaggcaggagaattgcttgaacccaggaggtggagattgcagtgagccgagattgcaccattgcactccagcctgggcgacagagcaagactctgtcttgggaaaaaaacaaaacaaaacaagtgagaagggaatcaagtactacgtaagatgtaatgtggaattttagggaaggaaggcagtgtatgctggagtaattagagaaaggggcatgcatgatttgatgcttgaactggatcatgaaggataagcaagattttggcagcaagtgagagggagagaggagtttgtcagaggaatggaacaagtcaggaggcagtaatgtgtacggcactccaaggactctgtcctgatcggagcagaagtgatgaagcattgagtagtttgagaaagttagctaagaagggtgagggcagatgttggagagagttgagtatcagagagaagacattagatttgagcagatagaacaaaaatgccattgccagtttttgtgtaagagaatagtattagggtggttacccaggaagtggtcatcagagttgaatggagcagaaagagtgtctgatacagcatcgggacgttgtggtcacaaaatgaggtggtgagggctgagccaagatggtggcagtgggatggataaaaagggatggccaggacaaatattttaaaggaaaaattaacaggacatctttactgactggattggaaggctatgcaggaaatatattgtcaaacttgattccaggatttctatcctatgcctgggttgcccaaaatatcagggaaccattgttagaaaaggtaggagataccactgttccaacaaaaagtattgagtttggtgttgcacccacttaacttcaaggccttacaagtgagtagacagttagttagaattgcagaagtgccactcagagagcagggcttgcaatgtggggttggactttgtcaccattgtgttaattcctaattctatgcagatgctcagcttgaggaatacccatgtttgggcttcagaatgaaagccaagtaatatttactcagatgccaattttccctctgaaatatttgctcatggaactgagagaacaatatataaagcattaattatttttctcataaagttattaataaaaagataagatcagtgaaaggcagagtaaactagaagccaagtatagaaaatggtatcattcaaagactcattactgtagtggtgaaaacaaaacaattttccaacagcttaagatgcctcagtattttggaccatttttaagtagttagtgtgggcacttagtaaatatgtattaaactatagttcattaattcttttttttttttttttgagatggagtttcactctggtcacccaggctgcatttttgctttcttagtgatatataaaatgtcgagtttcacaatgatggtatcttagatttgattaaatatggtattaaaaaatagctgatcacagaaagtctctaccagtgtgatgtagatggctaaagtattccacatttgcaaacttttattgacctaaataagaggtgccccttgggttgtttttatttggactgggaatattaggagaaagctttttcattcagtgtgtaagtacaatctaccagaaatagaaacccccatggacgatctatttctttgatggtacaggactcagaacattcacaaagatttagttgttagcggaatagacatctgtattttattcaaaccaattttcccttcctaatctgagaacattgtgcaatctaagcagttctaagcatgtttgctattcgtgcaaagtgagagtaaatctaaaagaaatttttttgtgtgtttagggatggtaataaagtctcttagtggttgaaaatgttatttcttacaaaagtggagaacatttgcttttcaataccagagttttcagccatttctgcattctgacctattgactggaggtaggttgcctttgaattcagtaaaacttcatgggcagaaacacagttccttttcctacttatttggatatcatgatggccattgcatgtatgtgtctttttgtaagtccatgcctcagaactgagaagtaggaataaaattagggtcagggctggggatgctactctttgctgctgagaaacacaatgcttcaggtaagtgattctgaagtccttcaccacctgacggtaaccttgggttggtccataggtatgttttcattttgcttgttcatccattttaattggcttcctagagcatgcttgtagatgtagagccaaatttagagtagagcaaccctctggcaaacaggaagagattaattttgtggtatgcttttaagggacttcccaggaaacttcaaaagcagaaaaagaagcactagctgcctattccaaaatgtgtaaaacaccactcagctttttaaaagtaggataaactcagagcgcgcgcacacgcgcgcgcgcacacacacacacacacacagagagaacatctctagtaaaaagaaaagttgagctttcttagctagatgtgtgtattagccagaaaaagccaaggagtgaagggttttagagaactggaggagataaagtggagtctgcatatgggaggcatttgaaatggacttaaatgtctttttaatgctgactttttcagttttctccttaccagacacattgttttcatgacattagccccaggcatagacacatcattaaaatgaacatgtcaaaaaatgatttctgtttagaaataagcaaaacattttcagttgtgaccacccaggtgtagaataaagaacagtggaattgggagccctgagttctaacataaactttcttcatgacataaggcaagtcttctatggcctttggtttccttacctgtaaaacaggatggctcaatgaaattatctttcttctttgctataatagagtatctctgtgggaagaggaaaaaaaaagtcaatttaaaggctccttatagttccccaactgctgttttattgtgctattcatgcctagacatcacatagctagaaaggcccatcagacccctcaggccactgctgttcctgtcacacattcctgcaaaggaccatgttgctaacttgaaaaaaattactattaattacacttgcagttgttgcttagtaacatttatgattttgtgtttctcgtgacagcatgagcagagatcattaaaaattaaacttacaaagctgctaaagtgggaagaaggagaacttgaagccacaatttttgcacttgcttagaagccatctaatctcaggtttatatgctagatcttgggggaaacactgcatgtctctggtttatattaaaccacatacagcacactactgacactgatttgtgtctggtgcagctggagtttatcaccaagacataaaaaaaccttgaccctgcagaatggcctggaattacaatcagatgggccacatggcatcccggtgaaagaaagccctaaccagttttctgtcttgtttctgctttctccctacagttccaccaggtgagaagagtgatgaccatccttttccttactatggttatttcatactttggttgcatgaaggctgcccccatgaaagaagcaaacatccgaggacaaggtggcttggcctacccaggtgtgcggacccatgggactctggagagcgtgaatgggcccaaggcaggttcaagaggcttgacatcattggctgacactttcgaacacgtgatagaagagctgttggatgaggaccagaaagttcggcccaatgaagaaaacaataaggacgcagacttgtacacgtccagggtgatgctcagtagtcaagtgcctttggagcctcctcttctctttctgctggaggaatacaaaaattacctagatgctgcaaacatgtccatgagggtccggcgccactctgaccctgcccgccgaggggagctgagcgtgtgtgacagtattagtgagtgggtaacggcagcagacaaaaagactgcagtggacatgtcgggcgggacggtcacagtccttgaaaaggtccctgtatcaaaaggccaactgaagcaatacttctacgagaccaagtgcaatcccatgggttacacaaaagaaggctgcaggggcatagacaaaaggcattggaactcccagtgccgaactacccagtcgtacgtgcgggcccttaccatggatagcaaaaagagaattggctggcgattcataaggatagacacttcttgtgtatgtacattgaccattaaaaggggaagatagtggatttatgttgtatagattagattatattgagacaaaaattatctatttgtatatatacataacagggtaaattattcagttaagaaaaaaataattttatgaactgcatgtataaatgaagtttatacagtacagtggttctacaatctatttattggacatgtccatgaccagaagggaaacagtcatttgcgcacaacttaaaaagtctgcattacattccttgataatgttgtggtttgttgccgttgccaagaactgaaaacataaaaagttaaaaaaaataataaattgcatgctgctttaattgtgaattgataataaactgtcctctttcagaaaacagaaaaaaaacacacacacacacaacaaaaatttgaaccaaaacattccgtttacattttagacagtaagtatcttcgttcttgttagtactatatctgttttactgcttttaacttctgatagcgttggaattaaaacaatgtcaaggtgctgttgtcattgctttactggcttaggggatgggggatggggggtatatttttgtttgttttgtgtttttttttcgtttgtttgttttgttttttagttcccacagggagtagagatggggaaagaattcctacaatatatattctggctgataaaagatacatttgtatgttgtgaagatgtttgcaatatcgatcagatgactagaaagtgaataaaaattaaggcaactgaacaaaaaaatgctcacactccacatcccgtgatgcacctcccaggccccgctcattctttgggcgttggtcagagtaagctgcttttgacggaaggacctatgtttgctcagaacacattctttccccccctccccctctggtctcctctttgttttgttttaaggaagaaaaatcagttgcgcgttctgaaatattttaccactgctgtgaacaagtgaacacattgtgtcacatcatgacactcgtataagcatggagaacagtgatttttttttagaacagaaaacaacaaaaaataaccccaaaatgaagattattttttatgaggagtgaacatttgggtaaatcatggctaagcttaaaaaaaactcatggtgaggcttaacaatgtcttgtaagcaaaaggtagagccctgtatcaacccagaaacacctagatcagaacaggaatccacattgccagtgacatgagactgaacagccaaatggaggctatgtggagttggcattgcatttaccggcagtgcgggaggaatttctgagtggccatcccaaggtctaggtggaggtggggcatggtatttgagacattccaaaacgaaggcctctgaaggacccttcagaggtggctctggaatgacatgtgtcaagctgcttggacctcgtgctttaagtgcctacattatctaactgtgctcaagaggttctcgactggaggaccacactcaagccgacttatgcccaccatcccacctctggataattttgcataaaattggattagcctggagcaggttgggagccaaatgtggcatttgtgatcatgagattgatgcaatgagatagaagatgtttgctacctgaacacttattgctttgaaactagacttgaggaaaccagggtttatcttttgagaacttttggtaagggaaaagggaacaggaaaagaaaccccaaactcaggccgaatgatcaaggggacccataggaaatcttgtccagagacaagacttcgggaaggtgtctggacattcagaacaccaagacttgaaggtgccttgctcaatggaagaggccaggacagagctgacaaaattttgctccccagtgaaggccacagcaaccttctgcccatcctgtctgttcatggagagggtccctgcctcacctctgccattttgggttaggagaagtcaagttgggagcctgaaatagtggttcttggaaaaatggatccccagtgaaaactagagctctaagcccattcagcccatttcacacctgaaaatgttagtgatcaccacttggaccagcatccttaagtatcagaaagccccaagcaattgctgcatcttagtagggtgagggataagcaaaagaggatgttcaccataacccaggaatgaagataccatcagcaaagaatttcaatttgttcagtctttcatttagagctagtctttcacagtaccatctgaatacctctttgaaagaaggaagactttacgtagtgtagatttgttttgtgttgtttgaaaatattatctttgtaattatttttaatatgtaaggaatgcttggaatatctgctgtatgtcaactttatgcagcttccttttgagggacaaatttaaaacaaacaaccccccatcacaaacttaaaggattgcaagggccagatctgttaagtggtttcataggagacacatccagcaattgtgtggtcagtggctcttttacccaataagatacatcacagtcacatgcttgatggtttatgttgacctaagatttattttgttaaaatctctctctgttgtgttcgttcttgttctgttttgttttgttttttaaagtcttgctgtggtctctttgtggcagaagtgtttcatgcatggcagcaggcctgttgcttttttatggcgattcccattgaaaatgtaagtaaatgtctgtggccttgttctctctatggtaaagatattattcaccatgtaaaacaaaaaacaatatttattgtattttagtatatttatataattatgttattgaaaaaaattggcattaaaacttaaccgcatcagaagcctattgtaaatacaagttctatttaagtgtactaattaacatataatatatgttttaaatatagaatttttaatgtttttaaatatattttcaaagtacataaaa

SEQ ID NO: 36855 - DNA, 30639 bp, Homo sapiens
gggggcgggacgtccgtggtccttgtcgcacgtcgcagcgcctggcgcccgggaagaggtggttgtgaggcagacgaactcgcggctctccggcttccgaggcttccgagttgtcggaggaagggggcggcgagcaataagaacccgccgcacccggtcctcagcgactcttctgacctccgcgcgacgtacccgccgccgccgttggctggaggtgtgtacgggcgccgggaggggaggtcggtgtggtggtcggaaagggacattccattcgcgctccgcggcgcgaggcaatcgtccggtgtgtgagcccgggagccggaggtgtagcggcagagacattgttcttgccggctccctacggtgccgtgtgtgcgtgagagaagaccagtctttcctctaggtgaggggtgggaggccgcctgggaagggaggtgacccgcgagcgtcttgcgggcagagggctccgagtgcacaggtggggttgaggtttattggggatgaggtggcgaagtggggggggaggcacgcagcagctcccgaaggcgcgctgatggaagcttaatacaggaagtgtgggagcaggctttctggaggggatgttttagggtgggtagcccaccgttcctgtttccgaatcgttttcggctcttgtaccttgttccttcggagcggagaggccgtcgccaccccgcccgtggggggaggggaaaagaggttgtgtcgacggaggcagaagcgacgcagatgcgaaagtggcggcctccgggcaccatttctgtgcacggaaacagaatccgggtttgaaggcagccgccgcttcgcttacccagtacctagtgttccgtcgtgtttgaccaacccccctctccctgccaccgcgggtttaatccgaacgtgttcggatactggaactgtaacgtgcgccttcttcgtccccctcttatgcagacgatcccttattgactcgggaatggcttttgggggatgggttcccgcttttgttgggatggggggacagaaaggaacagaagcttccctagattgtgttgattttgttagtggaatctgatagaatttttcctgcgtctctaaaagcagatttcttaagatggccctttgccgctttggggcgaatatagattttcgtctataatttcctgcatagatcagcttttttccccaagacatacttaatgttctaacggatttggggggtgggaggagagtgccttttccttcataacaacaacaaaaaaaaggcacttgcacttttagctggaatagtaaagtcctgttctccctgtatgattgttgtgggatattaacttggattaagatactgtggttttaggttcaaggctctgtaccttgttctggtctttcaaacgttagtgttgcaggtacctggatctaggaaacattaactgtcgttaagagagccccggtgtactagagtgggagatgatggcaatttttctctagctccatatttggcagttaatatagccttaggcatgtgaaccaagtttctaagtaaacttttggccctgttagcatccagtggtctttttgataatccaagattcctggtcttaggagataaacggtacgatgagtttgaacctcaggattgaattatcctttctttggcagtaacatttttcttaaatgtttaagattactcttatgggcctttatgttatgatttaatctttacaaactaattctgaaaagcagtcaaggaattgtaggaataataaggacctagaatgaatttcttactaagagctgtcatagttcagattgatattcagggtcgaaatattagtaatagtgaaaaaacatcaagagtgaaccagaatgcttgtgggatggatggggataaaaattagaaggtaaagaagaaaacacattatttgaccatttcgtagagtaactaacttaactgttcagttagcagctgagcagttgatttgtcagcaggcaactcctggtttgaagaaagtgttggcactgtgtctttagattctgaaaacttccctccttatcctgcaaaattatcgctgtttattacgcataattaggattgaacattttccccctagattgctttaaaaagactttccacatattttgagtgaatatggagacagtgaatgactccttttcaatgttgattttgaaaggcacaaactaaagtgttgcgtctgaacttaaattcagtagaatttaatggacaaacatgacctagttactctccactggtagacacttgttttatatccgatagaataaattggtccacccaccttcaggaaggtcctggcctaccttcagaagcaatagaattagtttcttgactgtcgtgtttctgcttacttttatctgctaatttccaagtattttaccctatcttgaaaccataggtatattgaaaattattcttggattttctgttgctgtcctgctgtattcctttgcttttcactcttctcaacagtttcacataagctaacaattgcttgtttaaaattaattttttgtattgttggaagagctggctgctcttccaaagcggttgttcctaaccaaagtgtaatgaaaacatcagttgagtcaggagtcaggagacctgatttcaaatcctctttctttttactgtaactgaggaaccccaaacacctttccttaggctctctaaacatccttttctgtaaatgaagataatgccctatctattttaaagacaaaagaaaatagtaggttacttgttaaactttaaaacatagtataaatacatgctttatttttgtggacagcaagcatttccatttcttactgcttggtcacttttaatagcttctgaattttaaaactagcctccctcaacttctgagaaggacagaaaacaaaaacaccttttggagcctgaataagagatttaatccataacttacttttattatttatttgtaccactatgattcttagatcttctttgtgaagctttcattcaatggtgtaccacaaaagattgaaggtcatttctttaaaaaggtatagtgttccttagattgtttaagttacttcaaacaaaaaccatctggaatttcagaaagttccagtattaatatgcatttagctgttggaaatggatatagtccatggttcaattaaaataaataaacctgactagtttgagcccagctatgagtgagggactccagaggggaaaggggtaagtatcctatagtggagataagctgtgtcttagcacccacataacctttggtaacagtatctggtaaagagaactgcctcctattactagaggtcttattctttttataataactaataccaagtacttacaactcagctcactgcaacctccgcccccgggttcaagcgattctcctgcttcagcctcctgagtagctgggattacaggcgcccgccactgcacacggctaacttttttgtgtttttagtagagatgggttttgccatgttggtcaggctggtctcgaactcctgacctcaggtgatccacccatctcggcctcccgaagtgctagaattacaggcgtgagccactgcacccggcctctttttccttttgtagtttctggtacatacatagtagccataaaataaatgttgaaatgaatttattttgtataacccattgactcagcttgtggatgggaatgaatgaagtaagacaaaggcgcagagagtgaaattgcagagaataatattaggtgattaaaatatttgtatagaatttgatacagggatgagaaagtatagtaggagataaatttgaaaggttggttatgacattgaatgtcagactggatttctgtgtagggccttagatgccaaactgaatgcaggtgtttggattttactcagtacagtatatactacacgtgatacaggggcttgaaagacttttgaagaataaaaggtctgaacagtgggagtgaaaaggagggcacaaattccaccttctgaattgtaaggatttcacagtttaagtggcaaagctaaaggggagaaagtcacgactgagctttcaagttgagaagattatgacacttttaacagaaataaggaaatagctttctttggtgcatgcgtgtattgggacatatgtgggtcatgtctaggtgttcagtatgtggtgacaaatgtaaaatttgaacttatggtatagactagatacacgtttaggtagacatgagaccagaagctgaaattgccaggttagaagacagaaccttgagaaattctgcgtttggatgagaaggaaaatttgccttatagaactctagaagagttaggaggaggtagtcaacattgataatgcagatgggtggaggattgagaagtcattcgattattgagaagaattgtgatgtttccagagaattgcattcaaaggagagctgagttataatatttgagaggggaatagaagatgaagacaggtgtacagttagtaatttagggcagagcatgatcaataaactgctatgataaaggccaaaagtgctttaagagttaatagagaagagttatattctgttgaggaattcagtaggagtagaaagattttcaaggggacaggatttctgctgggcccagataaatgcatagggtttcaatcattgcagataggaaggtgtgagatgagtattggaggagaagtcaaaagtcctgcttcttgttaacagacttttaggatcttagtgttggaatggcctaatcttacttttttggatgtatggactctactatgtttgtgccaaaccattcagttagtctctggaatacctgtagtgactggctacttgttaagtagctctatttgatatttggacaactcgcgttattcttgtgttatgtttcacccaaatctaccttcttataatttccattcactatattcaattagcaatcaactcattttagatattacatctaaattaatgtagcctaagattgattgttttggaggcagccccattatagtagtgattcactgaactttaaatggtaaacaaaaaacctaaatgtttcttacctaaaaggtgacgttttagtcaaagtttgaggaaaggagagtgataactttggtttttacgttattttgaaactgaggaaatataagttcattgtaggataatgaagctcaatgtgactttcttttctaatctgcatgtatgtctaccaatgctccactccctctcagtgtgtattatctaccaatactccactctctctcaatgtgtataattaatagattcagaaaatatggtgacaaatatagagcaattttccgtgagagctgaagtgcatgtgcttcaggaattaggcaaatgcagaggaaacattttaagaaacaggaatgaataaaatattctgatgaagattcactgggattttaggtgcgataggcagagttggagagtaaaaagcctctaaactatactggataatgttttcggttttttgttttttgagacagagtttcgctcttgttgcccaggctgaagtgcaagggtgtgatctcagcttactgcaacctttgcctctgagttcaagcaattctgctgccttagcctcctgagtagctgggactataggcgcgtaccaccaggcctggctaattttttgtatttttagtagagacgggctttcactgtgttagccaggatggtctcgatctcctgaccttgtgatcctcctgccattgcctcccaaagtgctgggaagtaggcatgagccactgcgcctggccttggataatgttttcatttgacaagtaaaagacggatttgttcatgagagagctttgactgtgtatagagctaatgtatcagataaaattttacactgtgcattcctgtgtgagattcttcacattttcaggtgtcattggaagaagtggagtgtgatatattgtatttaactttttctaaaaaggttgttaggtgaggctaacaaccaccttattgaagatggtagttatctttgaaggtgctaatctaagaactttctaaagatttctttttgtgtataagtatcctttaatcttggctatctttttttttttttttttaaacagtgtctcactcctgttacccaggtttgagtgcggtggtgccatcttggctcgctgcagccttgacttcccgggctcaggcattcctcccacctcagcttcccgagtagctggagctacgcttgcacactaccacgccccgctaattttttgtattttttagtagagacggggttttgccatgttgcctgggctggtctcaaacacctgagctcaagcgattcacccactttggcctcccaaaatattgggattacaggtgtgagccactgcaccaggccttcttggctatctttgtagaactgtatagtcttgtaggcttgaccggggatttcttctcaatttgtaaactaggaaatcgagatccagtaaggtcatgagtttttcatggccatggataagatagttgaaaccttttactcccatattcagaattttgtttcgttttgttaactttttttaagaaatggaaggtcccagatctagaaatggattacctgtaagatgatttgctatgaataataaaaatggcacaattctttcttcttgtaatcacttttattctgaaagtgtaatttggcttttttcctttttctcaaccttcttacgtacactgcatgaattataaatacgaactttatattacttactcaattttcatagtcttatttcctgcaatacccaaaccacgttgtttgatggttgatctctagtagtcattttctggttgatttctatcaattatattttggctctctaaattctgagtcacttcaaatcggagttatggttaaagaagtaactgatgtaattagttgaaacactgttctctcagtaaatcttgattttgttttaccattcctttgggagcctcctctgcaccttaaaagctcagctttctatataacctgttatatgcctgtttagattttaccagattagcattgccttacttatttaccatttgaagttaacttttcaagttactgccttccaatagttctaagtattaatttattgagtattgattaatcaaatattacttctactgcccttccctgtctctctgttctaaattgatggtatgttggccattatacttcagtgaccatgtagatagtgggcaatttgaagctttttttgaaccttgttacaacaaatctttagagcattttgacctgtgatattatatatgtattatgtaccattttattttggtttgagaaacaaatatgtaagtgacaaaaatgatagatcagtatgtactctatgaatatgatgggaaatttgggataaatgacaacagtgttcctgtagaaaatctggaaatccagagagaagaaaacaattcccaaacccggaaattcctaatagtatttctgtcactatcaatttaaagaaaactattttgtgtatagttattttgttcagagagtaatgtagtattttcccatgtgttagtattattttaccatcagtttttatggtgttaaaatacatataatttccatgttttagttatcttgttaaattttaccaggtaagtctactgttctttacccaccctcattattcaaaataaaaatgttagttgcttagctgtgtgtgtgtgtgtgtgtgtgtgtgtgtttgtttgtgtgtttgtgtgtgtgtgtgtgtttgtgtgtttgtgactacaggtgtgcaccaccatgtctggctaattttagatggggttttgccttgttgcccaggctggtcttcagctcctaagctcaagcagtctgcccacttcgacgtcccaaagtgctgggattacaggcgtgagccacagcccagtgctttgttactttaaatgtagcatatgtgagtcctttttgcactagggttgttacccttattgggagttttaagttttctggaaaatcaatgacacctgaaatggcagtatttggatctgctctttgtgaattaactatttttgaaagcaagtgaggcattataaaaaattttaaacagatttggggatttttgtaaatcaagtttgagagtttaagaaggacagttagaggagggatagtttgttggaaaggaagaaacaaggaacctaaaaacataatgtagaagttgaattgtgagtcactagaattatgtaaagctacactctatctgtaagctctactatagttggtatttgatttttattaaaaacagcatcacaattttaatgacctatgcagggctgtctctgaaattgttttagttatttaaagtaaacacacatggaaattgactttttatttttaattttttgtatagagatggggtctctctgttggccaggctggtcttgaactcctggcctcaagctttcctgccacctccacctcccaaagtgctgggattacaggcatgatccactgtgccagcctgcagtgtttttttgtctgtttgttttgagacagagtcttactcagttgcccaggctggagtgcagtggtgtgatcgcggctcactgcaacctttgtcccccaggttaaagtgattttttgtgcctcagtctcctgagtagctgagattacaggtgtgtgccatcagctctgctaattatttgtatttttagtagagatggggtttcaccatcttggtcaggctggtctcgaactcctgatctcaaatgatcctcccagctcaacctgaagtttaagcaggactttatttatttattgagatggagcctcactctgttgttgcccaggctgcagtgcagaggcatgatcttggcccactacaaactctgcctcctgggatcaagcgattctcctgcctcagcttcccaagtagctgggactacaggcgccagccaccacgcctggcaaatttttgtattttactagagaaggggttttaccattttggccaggctggtctcgaactcctgacctcaggcgatctgcccaccttggcctcctgaagtgctgggattacaggcgtcagccaccgcacctggctaagcaggaatttcaactgcatcctgatttacccagtagatacatgcttaggaattatgattttttttttttagtacttttaagtttaataggtctttttaaaataaaacaggtggctgggcacggtggctcacgcctgtaatcccagcactttgggaggctgaggcaggtggatcacgaggtcaggagttcaagaccagtctggctaacatggtgaaaccccgtctctactaataatacaaaaattagccaggtgtggtgacacgtgcctgtagtcccagctactcgggaggctgaggcaagagaattgctctgccgggaggcagaggttgcagtgagccaagatcgtaccactggactccagcctgggcaacagagcaagactccatctcaaaaataaaataggttatatttcatatttttattttttatttttttgagacgagtctcgctctgtcgcccaggctggagtgcactggcgcgatcttggttcactgcaacctccgcctcccgggttcaagcaattctctgcctcagcctccggagtggctgggattacaggcacccaccaccacacctggctaatttttttatttttagtagagatggggtttcaccatcttggccaggctggtcttgaactcctgcccttgtgatccacccgccttgcctcccaaagtgctgggattacaggtgtgagccaccgtacctggccctggggattatattcctacagtaaatgataagttttgtttgtggctcacacctgaagtgagaggatcacttgaggccaggagttcgagaccagtcagggcattgtagccagacctcgtctctgctaaaaataaaaattaaaaaatttaaaaaaattagccaggtgcatgcttatagtcccagccactcaggagatttagcggggaggatcgcttgagcctgagcctgagcctggcagttgaggctgcagtgagccatgattgcaccactaaactccagcctaggtgacagagcgagaccctgtctcagaagacaaaaataggaaattgtatttatttcatgttagttgttcttgttggttttaactttgaggcacattatcatagcacctaacccattctgttaagtttccagtttgcttgtttatatttcttgacagactataaactccttgagggctagagacttatcttgttcactagagtatttcatttattataaacagtatctcatgtagttagatgcttaattagtggaaagaaagagagacataatatcaaaggtaaaaaatgattctctctaagtactgaagttatagctggtgattaatcattgttaccattttgaaaatggtgaaattaattcccagaaggaaagagaatacaaaaacacaagtcatggtgctttgccatgagtgttatctctgagtcttaacttgggccctctgtcttgcttcctaggataaaaccactggaatccaggaatgtagtagattttggtccccaaaggaaaaaggcactgtgaatagaaggacttgtacgtagtctgaggcagcattggacctcctggggataagaaattgaacaaagatgctatttccctttaccgaagggtagggaaatcaagaaagagagagaaagggagacacaaatgttggaggttaccttatggatagtagtagttaggaatgtattgttttgctatttgttgtaagttgctttttaatagtggcattaattttgttcccatttgtatgactaagaaaatttatttcaggttaggccgggcacggtggctcacgcctgtaatcccagcactttgggaggccgaggcgggcggatcatctgaggtcaggagttcgaggccagcctgaccaacatggagaaaccccgtctctactaaaaatacataattagccaggtgtggtggcgtatgcctgtaatcccagctactcgggaggctgaggcaggagaatcgcttgaacccgggaggcggaggttgcagtgagctgagattgcgccattgcactccagcctgggcaaggagagtgaaactccgtctcaaaaaaaaaaaaaaaaaattatttcaggttagtctgatggtagtgggttatcagaacttattaacattagtgtcactaaaattggtatacaactccccactgctaaatttggctaaaaagaaaatttatttcatggtggttgatgacaaagatgactttttaatagttattcttgtgtttgctccctcagcatttgacattgtgcagcaaagaaatggttatggagaagcccagtccgctgcttgtagggcgggagtttgtgaggcaatattatactttgctgaataaagctccggaatatttacacaggtaaattttaaacaaataatttggtatttttatctactttttttcttgggtatgactatatatattttgcatttcctgtctcctcattatctgacagtatctttgtaaacatgtctaaactgtattcaatattttattcatttgatggcaaaaagtgtttttaactgcaactcacagtaataaaaacattttatgtcatattctggtacataacacattcatatctatatatgcacacgcttattcttatatgtactctagtattttatttttagagtcatggtctcctctgtcactcagggtggagtgcagtgatatgatcatagcccactgtggcctcaaacttttggcctcaagcgatctcccagcttgcagcttgcattcccaaagtactgggattacaggcatgagccaccaagcccgacctttatttcattaaaaaaaaaaaaaaacaaactttgggggcaggtgctggagaactatataaggtttacatgaggctggacacagtggctctctcactcatgtaatcccaacgctttgggaggctgaggcaggtggatcacttgagggtcaggagtttgagaccagcctggccaacatggtgaagcctcgtctctgctaaaaatacaaaaattagccgggtgtgtggcaggcgcctgtagttgtatctacttaggaggctgagtcaggagaattgcttgaatctgggaggtggaggctgcagtgagcgagcatcgtgccactgcactccagcctgggtgacagagtgaggcttcgtctcaaaagaccatatcttgggtttgaccaactaatgggttccaatatgcaatttgaaatcaacagcttaaatcttttttttaaagttctcccaaacagtgttgggggatgaatcagttaaatgattatactgtgaaaatttgtatttcttctaatctgtaaaatagtattcctttgtaaaacagcagcaataaccttatttactgttttaacaagaagtggacatctgtaggcttgttttttccagagattgaagtgaaattgatttatattatgtgtagtatttaatttttgttcttcttggtgtatcttagcaagtagaagataggtgaaactcttacaagaattagactttgtaagtattgcagaacacactggccagatgggttaaggataaatatattgccacttactgtgagaaaggctgtttaaaagacttaaattcctttatctgtaggtcatcttaattagcattttagtagcaatttgtcttgctctgttgaacatacgtgtaatctgtcttacttgaggcatttttatatttactgtttgcttggctctatttgtaattactttacgtatgtatattatgtattccttatgacagtcttaaagtgaagttacttttattagctctctacctattagacagttgaggttagtaattcatctaggatcactcagtaagtaaacaagctaaccatagccagtattcaggcccagttttgagtagtgtccccaaccattctattagaatgtagtatatatataaagtgtaactaacatgtatcttcccctcaaataaatgcaaaatgaataactgcatgtcattctctaattgtaaaaataaagatttttttatgacaatgtatgtgagggagtttgggggaagataaataattaatagggccttttgatatctgaaatttggtcttttcatgatacagggttttttgttttctttagtgaccaagaacaaattttaaaacaataaggccctacaccatcatgtttaaacagtaactgacttctgttttagacctagcttatttgaccaatttctttcttaatgaaaattcaggttgttataattttccacttgtggtaagcaacactaatgaatatcctgaaacatgcattatttgtgcacgttgctagttagttattttcttaagatactttcctggaagaattaatgcatcaaagagatgatcattctgaggcttttcatgtgtatacacacacagccaaactgttctgtagaaaacattgccagtagtacatgagagaaaatagtttaatgataagagtagtggttaaaagcatggactctcaagttagactgactaggttcttatcttgggtgccccacttgataggtatattaccttaggggagttaatttaacctcttctgaacctcagcttgtttatttagataatagcacttcatgagattgttaagaaagttaagtgaatcagtacacataatacactaaaaacattgcttagcataaaggaagctcttacatgttttattactataggagttgtgttttcattgtgaaaaaattagcttcacatctttgagcttaatttagaaagatgttaattctaattgctttggataatgccaataaaagactaatttacacatacttaagaacagtacaaaaatattaaaaagaaattagatgctggcgtaattttggattttagacttggtctctgaattatttcagttattttaaatctaaacagtttaagcctttagagttagtaatcatttggagatctggatacagtattaaactctgattcccaaacaaatctaggtagctgagtctttgtatctgaagaaaaaaacagggtcaattactatagcatctgtatttagaatgtactaaatcatcaaaaatatccgatttttccacttaacaaaaaatagatgtgaatatctaatgattgtctacttactgtgccagataaactaagcattctatgtgcattagtcatttaatccttacaacaaccatatggagtagttcctgttcctgttttataaccaaggaagctgaacttgaagaccttaagtaacttacctgtccaagatcacgcaactaattagtgacagagcgggatccggaacctagtctatgacaccagaattctgcttcttaggcttctcttgacaattcagtgttaatcattaattatggttttgcaggttttatggcaggaattcttcctatgttcatggtggagtagatgctagtggaaagccccaggaagctgtttatggccaaaatgtaagtatcaatttcatatgtagtttagaaattttgtgttaagatggagattttaaaaaatagccttcttgtgtccatggctttttttttctttctttctttctcttttttttttgagacggagttttgctcttgttgcccaggctggagtgcagtggtgcgatctcagctcaccacaacctccgcctcccaggttcaagcagttctcctgcctcagcctcccaagtagctgagattacaggcatgcaccaccacacccggctaattttgtatttttagtagagacggggtttctctatgttgaggctggtctcgaactcccaacctcaggtgatctgcccgcctcagcctcccaaagtgctgggattacagccgtgagccaccgcgcccggccggctttttttttttttccccaatatgattgttattggtaactgaaatttatgtttgacagtaattgtcagcataaattgtcaatagttgttcagtttgacaataattgtcaaacatgcttgagttcttaaacatcatttttgtatgaaacatggtgttatattacgatggctacaaaggagaaaatggtatgttttatatcattgatgtattttatacatgagatagttgagacagtgtattaagtttatacaaatctgagctaaaccctatgctataggaatgcacagaaatgtatgtttcctatggcctaacagggaaggaagactttgtgtagaggatgtgagaccacaagatttggccttaccaaataaggaattataagtagacaaaaaatagcatcagcaaacacacagtaaaattatgtgtaagttcaaggagccgtcaacacaatttgtgagaatgaccaaatacttactacagaaaagtgggagaaagctgtataaagcccagattactgcacaatattggagagctattgtgatttcttctttaggaacatcattctggcagtgatgcacagcatggtcgttggattcagttcaggaagattagttaatattgcagagttgtaaggaaatcaatgagggtaggtaatattattgtgtaggtaatgcagtatcacagagtttatatttttccctccctccctaataaaggatatacaccacaaagtattatctctgaacttcagtgaatgtcatactaaaattcgtcatgtggatgctcatgcaaccttgagtgatggagtagttgtccaggtcatgggtttgctgtctaacagtggacaaccagaaagaaagtttatgcaaacctttgttctggctcctgaagtaagtttctcaattcacttagttttcatttatatggttgctagttggttgaagtgtccagaggtttcttctaataggtttagatttgcatattgttatttttggggaatttgtgtttgacctgttgtttgagtgagtgcgtgtgtgtacatgtgctttgactatttggaattaaaaatcaaatactgatacaagtttgtaaatagatgattaagattacattaatacaaaaaatatattggtatatttgaaaggttacatttgaaaacaaaatagaagagttcttttggtttcttttctattaaatagctgtttcttgagttctactaggttggtgcaaaagtaattgcgagttttgctattatgtttttttgagtgacctttttattttatataaacatcatagcatgttcagcattggaaaattatattgagtcaagatctctagtattaaaatgagaaattgtgtatgccatgtaatttgctcttttatataataccagatttctggatatttatggaataaatgttgtttcctatagggatctgttccaaataaattttatgttcacaatgatatgtttcgttatgaagatgaagtgtttggtgattctgagcctgaacttgatgaaggtgaggttactttgaagatatgaagatagaagggttctgttggtactctttatggactaatttctataagtatgacatctacggaaatttgctgctttattgtaactgtgtcaaacatccttttttcatggttttgttgttgttgtcgttgttacaaaaagatgtccattgtttgaaaatatacaaaatttggatgtcaaggaaaaaggttcccctcagtctcatcctctgtagataaccaagtttggtgcctattggagaaggtttttggattctatacttggcaacatgtatttttataaatgtggaattacactgactcaaagcttccttttttttaatgtaataatatgtctttgttggctgtctatgttgtggctatgccgtaattatttaattgatcttccattgatgtacagtggttagtttctttatcattattgctctattaaatatatgttacaaaggaagctaaattgtggctttaatataacttttttccttttactgaaagatttgtttttttctaatagagtacaataaatattaaacttcatccttgctctccagtttttgagagaacaggggatattgtagttgaatgcctttgttattaaaaaaaaaaaaattggagccgagcgcggtggctcatgcccggaatcccagtgttttgggaggccagggcgggtggatcacttgaggccaggagttcgggaccagcctggccaatgcagtgaaaaccccatctctacttaaaaaaaaaaaattagctgggcatgatggtgcatacctataaccccagctactcaagaggctgaggcaggagaatcgtttgaacccagaaggcggaggttgcagtgagccaagatcacaccactgcactccagcctgggcaacagaacaagactccatctcaaaaaaaaaaaaaaaggaaagaaaattgtcaaattttcttttttgctatcataccacttccttaaacatgttaaaaatatgtccgttagaaattgtgaagcctctttaaaaaagatgtgctgtattatgtattttcagaatcagaagatgaagtagaagaggaacaagaagaaagacaaccatctcctgaacctgtgcaagaaaatgctaacagtggttactatgaagctcaccctgtgacgtaagcatactatttgcaaggttaaatttggtctgaactatgtcagcaaggtggtttctgttcctagaattattgttgaaagtaaattcttgataaaaccacctattatgtcagtatttgagtacctattgtgtatatgcaagaaatttggaaagaatggttttatttaatacaaaaattgaacatggcttgcaccaaaacagtggttccttactgataatgtagagtgttgaagacaacacagagtaagcattttatttttataaaagataaggtttatagttagcactaaagtaaacattcttagtaattcagttttgaaatggtgggattaaagaactgctacttgagagtattattccttctgtcttatagctctttttggaattttgctttgaatactttgtagatctagaacaagttattggcatataactagttacacccattggattagagagaaattgaattttttcttacttgaactcctactaaaaagtgaactaaatattttattgtagtaatggcatagaggagcctttggaagaatcctctcatgaacctgaacctgagccagaatctgaaacaaagactgaagagctgaaaccacaagtggaggagaagaacttagaagaactagaggagaaatctactactcctcctccggcagaacctgtttctctgccacaagaaccaccaaaggttagatcaaagaactctttagacttacaacatcacatgttcaaatttggtgctgttaatgaagtatgacctttttctattatgttaaattgtttagtaaattattttatgtatatgaaagaagctgtggggtttgtttgttacctgagaaaatgttattgtttccctgccccgcaaaatacccctctaagagtgaaacttataacttaagatgaatccttgtctgtatgcattgtttagtaacttatatgaaattatttggatccatgtatagagctgtcagttgttctttcattctgtattaaattctctgagcacagatgcaccaggaatcatgcagtttcccaacttaaacaagttggtctataattaaaagaagagatacctgttgtttgtggtttaaatgggatcagtttcctttctacaccaattaaactatcttggaaagatgagtgacatccttagtgtatcatgtaagcctacctgaaacttcttttatctttcttcaaagtcaaaggttaaagtatatttgagtggtgataggaggagattctttgttcaatttgtgaatgtcagagtttccagctaatactctcttctttcctatccttccctctcccgttaacaccatcacacaccctatcttacccccaaaggggaaataaattgtttctattaggttcaggtttttctagcatgtttgttagtggttttgtttgccacttgctcatctacttagagtacgtaggaacttgcttatggttttacttagtagtcagacaaaagttataaataagcttgcataatgagattttgaaagctggcacatagactggcatgtgtgtgtgtgcctttcttttaggagtcttccaatatagagcaatagtttagaaatgaaaagaaaatatatatttggaagtttccctataggaatgttggtggttttccatgattagtagtctaggtttgttgcatttcctgcaggctttctcctgggcttcagtgaccagtaaaaacctgcctcctagtggtactgtttcttcctctggaattccaccccatgttaaagcaccagtctcacaggtaaccaatctgtgaacacattggattgtatccttgttacattgccaattgcttatttttaaaatacttttaaaaatgagtcaatcagaaattatggattaaatatacaaaaaacttgtattatatgtcagtgcacccactttaaatgtcaaatctccattcatcatctacataggtggtatttggggtttgggtgtgtgaaatacagattaagttggtttttaccagtatataatattgtcatttaaaaggcttcttaaaataacaaaaagaatgttcctttttcaaaagcttcaaattctatttagcaaaaatattttaggtaagaaattcggagaggcacaaagtagtgtggcgtaataaagaatcgtttttgtttttttttttttttttaaagcaaaaaaaaaaaaaaccaggaaactttttaacatacgctgcctaagctctcagtgtgtaagtggttcacaccacttaattgaagcctgtaccaacttatgactgtagtgttcaccttaactgatcattctagtattctgctttttgtctgtttgtcatcttacccatttcagagctttcaaaaatgtgaaaataagacactgcctacctaagaagtttgttagatttagtttagaatgaactaaattctaattaagtttatcagcatataaagggtgtccaattttttccctacattttgcattaaacttcattccactagaaaatttatgtttgaaatgttagtatataaatgtatcttttatatgttctaagcagtgaaattttgaggttttaaaagtagtaatttttagttttttggtgttgggacacataatcagctacataaaagtagaatacgcccgtgatacttttttttttttttcatttgggtattcaggcaatgcgtggttacccttatgtaagatggtcacccagagttccatcttaacaaaggaaattagtttgtgcagtattgttttgtgcttttctacccatatgaagacccaataaataacttttggcccttcttttggaatcttcatttcctatcagatttggatttggaacctttggattatttcatttcagagagtttaaacagttaaaagttaaaatagctagtgcttatgcctttgatatgcgccaagcattgtgtgaagcactttttgttcattttcagtgaatcctcacaaccaccctgtcagggtgggtactattgtttctgttttagagatcaaaaaattgaggtctagagtaactcacagacatttatgtacatagtagggttgggctttgaagtcatgcagtgggacatgagtccatatgtggctcatgtaaacgtttatttttttgagacagagtctcgctctgtcgcccaggctggagtgcagtggtagtggcagtggcgttatcttagctcactgcaacctccacctccccagctcaagtgattctcctgcctcagcctcccgaatagctgggattgtaggtgcccgccaccacgcctggctaatttttgtatatttagtagagacggggtttcaccatgtagaccaggctggtctcaaactcctgacccaagtgatccacccgcattggcctcccaaacggtggggattacaggcatgagccactgcgcccagcctcatgtaaaccttatgcaattctccagcaccttgctgcagagtcatgtatcttatctgtatttgcatcaaagaggactcttaagacatgcctgattaaatcctagtctcttgcccagaaaaataccttcatatttatctcaagtagtttgccttaaatatattttcaaagttagttgtaggaaatgaagttgtatttcctatgccacccctttaataaaacaaaaattttaaatgtttagaatttaaactttaaaagaacgttctaatgtctttaggctatacttaaaatggattcatgatatttctacttgatttaataatccttcaattttagtttgttacttttgtgtagtattcatttccttgtactttgaacatagattattgataaaaggaagttaattccagggtattggtaggcattaacttagaagtaggtaagttaatttcttgaataaaatattttgtctggaaattgactagttcacctacaaagcttatgtttaattgaagggcttattatttgtggttatacctgcttttattgacttgatttgatggttctgtacttacttcatattctgtttgaccttcatttgtgggtttgtcatttgatcatactttctggttgcatggaattaattttaaggccctctactgtgtggcatattggccatgttatctgttcagaaaaactagttttaatcatgaaactggagacctgaagaattataagtatgcagctgacttagttaacatatgtcaatcagttactgaaagggacagtgttagctttttgttcttgtatttttcttaaactggcatcatcagatatctacttaaagtcagattcctaaatcaatggcatgaattatttgtaagatgttggaaattattaatatttaactttatctgtttttaattttcatccttaaagaataaggaagaactttattttgctacttgtagttactcgtgttttgataatctgttttgaaaagaatttaaatcagtcaagaccagggcctcaagttctttgataacatttggattgaatgagtctaaggtttttcttaaattttgtaataaaggtgcatttagtgtttttattaattgccagtaatacactcactttattaaactttgacagagtacgtttattctctaattctgtttatattcatactgaagtatgcctttagacccccttagttgaagtttctaaataactgcctttttcagcatcacattttgcatcaaattattatatagaattaaaccccaaatacagatagcggtggtctcagggctgtcacttacgtatctttgtcagacatagaacattatcctgcatgttttgggtcagagaactaaaaatgtaatttaatttaaatgaacaaatagttactgaacatctgtgtctaatagcactgtgcttggttctttgggtgatgtaaaagtaagttaagatatgggccttgggcactggcgtgcctgtagtctcagctgcttgggaggctgaggcaggaggatcacttgagcctaggaatttgaggttacagtgagctatgattgtgccactgcactccagcctgggcaatagagtaagactgtgtctctctaaaaaaataaaagatacagactttataggagtaaatacatataaataacaacaaaacctggagagagttaaaaatattcattttataactagtagaattctagaatatggtaagcaacttcatcttgagggaaataggacattgacatagaggaaaacagaatttaggaagaggcaggcaaacttggttaaactgttagcataggagttaatattccttttggttacagtggctgaaatcatttacattaaattgtcatttttgaaagaagctttttttttttttttttttgagatggagtttctctcttgttgcccaggctggagtacaatgatctgctcacgcaacctccgcctcccaggttcaagtgattctcctgcctcagcctccctagtagctgggattacaggcatgtgccaccacacccggctgattttgtatttttagtagagacagggtttctccatgttagtcaggctggtctcgaactcccgacctcaggtgatctgcccgcctcggcctcccaaagtgctggggtgataggcatgagctactgtgcctggctgaaggaagcatttttgtgtcagaatttgtccttgtaaattacaatatctgttatataaatgattaaagagtttgagccgctgcatggactgaggtcctcagagatgaccacttttttatttatttacttatttatttctgtgagaaggagtttcactcttgttgcccaggctggagtgcagtggcgtgatcttggctcactgcaacctccgtcttccgggttcaagcgattctcctgcctcagcctcccaagtagctggggttacaggtgcctgccaccacacccagctaattttttgtatttttagtagagactgggtttcgccatattgggcaggctggtctcaaactcctgacctcaggtgatccgcgcagcttggcctcccaaagtgctgggattacatggagatgaccatctttaaagatgggactgaaattactagctttctgagttgaggacatgttctccatatcctgttgggtgttttcagcatcctttgtaggctcatatatttgtctctccttggaccataaatatttgggtagtagaaggtctgaagaggttgggaatactgaaaatgctgttgtcttgaggaaaaggtaatagcagacgccgatgtaattttgttttaaaaataattatatgtttaattcagcagttggcagaaacttttgggaggcatcttaaactgtcctattactcccagacccctagttaaggaaaatcgttgggaccaatacttcaaatgcatatttttctcataaggaagaacagtagggagctaaaggactttaactatttgagatgctacatacaagttcctataagtttctgtcatttttttaacatgcattttaaccttacaggtagcaatttcaggtgttagagcaagctaatttttatactttgaactataaaaatactgattttaaggttatgggcagagatttaggcaatactactgagcactgttacatttgaaggatagcaaattagattttcagaaattatgtgttatgtattcttgtctaagatgaagatggcttttaattttgtttatgtatttacatggagtggttcatcttgcatttttgtgatttttttttttggtagcaataccttttatgctatttcagtgttgatataactttaatgaaaaaatgtgactgtaaaaagcaacttattgtgagttacacagcattaagtgggaaaacaaaagctacctacagtcctagattggtacagaatatcttgataaaaatttatttttctcatacataggacactatgttaaaaacattctaaacttaaaactactgttatgtctgctagtgacttgtcgttaggtgctttggttggtttttctccagtggagtgttttttataatgtttttttttctttatattttagccaagagtcgaagctaaaccagaagttcaatctcagccacctcgtgtgcgtgaacaacgacctagagaacgacctggttttcctcctagaggaccaagaccaggtgagtcagctcctttatagcctttagcatttaacatttgtaaggctgtaaaagactgaacttaaacaaaaaactatgatgcgttctatacacagacccatatagtctcaaattgcttaaagatgtgatgtgagcaacctgctaaatagtgtctggggccaaataaccaatttttagggaggattggttgacatgccatggtgacatattttgaaggtgtaaaagacttaagtcttatttggttattgtcacggttttttgttttttttttttgtttgtttgttttttttttgagacggagtcttgctctgtcgccaggctggagtacaatggcgtgatctcagctcactgcaacctctgtctcccgggttcaaatgattcccttgcctcagcctcccaagtagctgggattacaggcacacgccaccaggcccagctaattttctgtattttagtagagacagggtttcaccatgttggccaagatggtctcgatctgctgacctcatgatctgccctactcgtcctcccaaagtgctgggattacaggcatgagccactgtgcccggcctagtcactggttttaagagttcaaaaccaagctgccaataacctactctcttagcagtcttatctctttacagataaacaataagcccattttgattcttaggtattaagtaagttgccatgatttttgacttgtttaccttgttagctacacatgtaatacttttatttgaactctgtaagaatgtttagattgctttggggaggagatgggagagatggagatagtatatatcacatttacaatgtgaatttttaaagtgatatgttaccaaactagaagtcctaaatttgtcagtgattaaacttgggatcttgagtgaaacccttaaattctgagcttcttttatgtcaaatattacacaaattattcttgtattgcctattttcctcactgtgttccttgtgttattgggagaatcaaataagattttatgtatatctatatacatacacacttaatatgtatagactgcataaatgtgatgattgctgttaaaatttactgattgctgtaatgtcataaagccaaagaattttgaatttcaaaaaactaagcaaatatttagtaagctatacctcactatctgaaatctgcttggttcctgggtgatggcaacagtttggttaaggaggaatacctgtagtactaatatttgatttttgtataatccagtagatctagaagaagctattttagcaacctagtcattgtcctcactttacattttagtgtcatgctgttttctaacctactagtaataagtacttttgcctctttttcaagaagctcacctagtcttattaaactaaaacaggaatatcaatattaagtgatttttacattcactcctttgaagtagtttttatgatattgtaaactttagtatctgctctatttctattctcaggcagaggagatatggaacagaatgactctgacaaccgtagaataattcgctatccagatagtcatcaactttttgttggtaacttgccacatgatattgatgaaaatgagctaaaggaattcttcatgagtaagtgatttattttgctgttggagtttttaaattattttaaattaagcaagaggcatatggagcttttttaataactattttttttaaatgtttctctctttatactgtgtccagctaccagacccaccttaattgtgcagaagggagtagatgacttatctcacatgtttctcagtgactgcttagtgttgatttggcctggctcagtagtgtttagaagaaacagctggataaatcagtcataaattcagagataaaggattcatttggcaaatgggtcaatatattaggagaaaatacattgtctttccaaaattatgcagttaactttacttatgaaaggactaccaaagatgcagaaaggtaacacagcaggcgggcaggctacttggtatcttaggggattgcctgcttgagtaaacgtaccttggctatcactgtgtgtagaagcttgcgagttttattttaaaatggatcggggagataacgatattcatcctgaacaattagagccatcaaggtattctgttaaaaatatttaacccttgatgtaatgtatattttcacaggttttggaaacgttgtggaacttcgcatcaataccaagggtgttgggggaaagcttccaaattttggttttgtggtttttgatgactctgaaccagttcagagaatcttaattgcaaaagtaagtgatttaaagggcataattcaagactttattatttctgttgtatatattaatttggggtatttaaaaaccatagaaaatcttttaataataaagctaaaaatagttattaaatggtatttatgcaaagaataaagatttgttagtttgcagatcattttaaattttgttacttgctttgctgaagaaggtgggaaagattgcaagattgcatgttaagaattttggctgggtatagtggctcacacttgtaatcccagcactttgggaagttaaggcagaaggattgcttgagcccaggagagttcaagaccagcctgggcaacagtgagacattgtctctacaaaaaaagaaaaatagccggccatggtggtagacacctataatcccagctactcaggaggctgaggtgggagtatcacttgagcccaggatgtcaaggctgcagtgagccatgcttgtgccactggctgtcaccagcctgggtgacagctgagaccctatctctggggggtggggggctgataaaagtgttttattccttatgcttatctgactgacctgttcagagtaatcatttctattgctgtctaacctgcccatgtaaatatttttcttctcttttataaagccgattatgtttcgaggggaagtacgtttaaatgtggaagagaaaaaaacaagagctgcaagagagcgagaaaccagaggtggtggtgatgatcgcagggatattaggcgcaatgatcgaggtcccggtggtccacgtggaattgtgggtggtggaatgatgcgtgatcgtgatggaagaggacctcctccaaggggtggcatggcacagaaacttggctctggaagaggaaccgggcaaatggagggccgcttcacaggacagcgtcgctgaagctccactgttggcaaagtcttggcagtggtacattattcatcgtgtttgcattcttgttaattttttttttggctttggaatgtgacacagcctttttgatcatttctttgatgtgaaaagcatctttggttatcagttaaattgaggtggacattatttccccaatttcacaacaggattcacattgttaatttataaatctagacttggagaattaaggactgagaaatgaccatatcttaaactatctacgacaaagtgaacttaaaaggacatgcccactgaattcaggtcctttgagtaaaaaaaaaatcttctgctgcacattttgtttaagtgttactgtttctgcctgttaatgctgggaacacaaatagtgcaatttgtgcaattggagaatcttgccttttttcttggctccccccaaaaatacaaaccaacagaaacttgttatgcactcatcaaaatgtactaatgggtactctgaactcattaacattgacatctgcaacaggaggcaacagggaaaaaatctcatcttcttttccagtagaaaatagtttgtgaaatgatgagggcattttatctgcttgctgtgaccagcgtgtgtacacataaaccttaacaagactacaagtatattccagaaggaaatcattttagttatgaactaaataataaaaattagaacttcaaatgcgatggtcttgactattagaccagatttagtagctccatatctaagatttttctacctgcccctcttcagtacagggatggctggctgctcaacacactcctcctccccttttttcctttctttaagctgtgtacagtgaaaattgtctttactgtatttttgttctctggtaatgtaataagcatgatggtgccttctattaatacatcattccagtcttgctggtaattttgtacagtatagtgtatgaattgctgtgctgcaaagccaaacagctgcaaaatgttgaaaaatcatcgaaatgtataaaaattgcagtatctttaaaatcagtaaaatggactagcatattatttatcttgttcttcagttaacaactttgtgttctctgtgggagggagggagtcctgtgtgtttgtggggagagggaaggaggaagtcagttatttgagtaagcctctagttgacttttctcttagcctgaatgtggacgttgaaacatatcacttcagggcttggaaaagtcagtcaacttgacgtacatttttagtgacattttaaaagcagtcagattctataaatggcaagtaagcctgaagtgaggatactgcaattttcggagaaaagaacagcagctctttaagtgtttgcattttctatttggggggcagggaactgtcattcattttgcacaattcttgaactgatgtcagcacccgagtggctcctgaatttaagtctgggacgacatcttttatttttacatgaatctttaaacaattctgtgagcaaagtttgtagctgctggattattgtctgtctttatagcaagttccagtaaaccacaagtatggcaaagcttatccaattttatgcttggagcagtcagtacataccagtttctgatgtttcaggcaggagtggggtaaataagtgtgaccacttaaagctgctcgttagcatggaagacttctccattctatctttgtaaaacagacaagatatgcacttgacatagtagcaaattggttctgaattatgcaactgtttgctatttagtaaactagcaaatgatgcatgtattttgtttttcatgtactgggcaatatgagtaaaatctgtccctttttccccctttgaatgaggtcttccatgtttgagggaaagtcttgcactattgcatatattttggggacacagattttcatagtttccatttttggggggcttaaggattttttttttttctgtttgaaacagttttatactttctgatatagtacttgaaattcttaccagaaaattactttggagttttgaagcctttattaatactacttttaaagaagcagttgttttattgtcaatgttttttttcccccaagcatattttcttgtatttctgtttccatatatatatatatatatataatttccaattcaggatattgccctgccatccatgaaaactgttctggcaccaaaagtaatgacaaatgttaagtgtaataatagaaaagtagagcaaagagccattcagcttcagtctttacataccatgaataaaacattaaaacatcatatggagaagtttacatggtgattgttcacctgcagtactgtggagttttaacattttgtcctcttttcagtgaaacagagtaaaaatattcatctaccattactgttatttgctgattttgttttattttttgatggtaatattctatccttatgacactattgcaaccaaattggctttaccatcttggctttagtaggtatagaagacaatggattaccatctttattgctgtaatgtgttaagcattatatgctagtagaatctagtttaattgtttcaggtggaaagtattctttgagtttccatattgaatgtgtttggactaaacaaacaataaactactgatgtctgcagcattt

SEQ ID NO: 36856 - DNA, 361330 bp, Homo sapiens
ggacaccatcatttgggtttttaaaagcttcagcttctccagcatctttgcattgtgaatatcttcctgcttctagtcaaagctttctctctagtgattggaatgctgctgtaagcctgattagaggtgcctgaggatatcaccttttacaaggaagccgtgtgtgcttgagaggatctttttaaatgcattatggctcatgcagcctcacaattaaagaaaaacagggatttagaaatcaatgctgaagaagagcctgagaaaaaaaggaaacaccgcaaacggtcccgggatcggaagaaaaaggtatctatgtatgccagagcatatatcttgcctggattctttttgttttaatctccctctggcatctgttagaagcattaagggttatttttacatgctgggtagagtgtaaattgggtgtgtaaattgggaacagatgataaaccctatggcagaacatggccataggatgggcaaggcaagagggacggttttctcctgtggggtgattgcagggctatgcggaaagtgtgcttcactttatataggcatgggcatgtttccatgacatggaaaggtgctgtgagggagttacaaaagtagtttcttcacagcccagtcaaggtgaaatgcactgcggtgacttgggttagagggagaggccagagaaccaggctttgtacttcttagaggtttgtctcgtggaaaaagagcttttgtgctggaactgtgtcacatgcgtgcgtttcccaggcagatctgtgaccttagaggagtagcacaaaagtcatttcctgctttgcttttatttcctctttctttccttttgcctcttatttttataaggtgctttttgtcaagttgtgcaatggaaataagctgctagaaataactttcttttgttaaataaagctgaaatcacagaggtttgtttttccctgctgggtgaaagtgattatcctgaacgcaggaattccagtaacctgcaaccttcaacactgattgctttagatcaaagcatgggcattgatgattccttactgatattccaaggcagggggaaaataggaggaatattctgggtcagtggtgatttattatagcccgtgagtacttagagtgcccttaaatatgactcctaggtactgagctgggagtaagaccccaaagcacttttcctccatgataattaataaaaattgactaaaactctgtgatctgaataggaaaggcaggtcataaagcatttttatgtgtctttgtgaaaattcccaaaggaaagatatccttaatttgagcagtaaggcatgtgctttctaaatgacatgcagattgcatctcccacatgtacccctcttcaggagtgaccatgaatattcctggtacctttgccattttcttcagagttaggatctatagaagactctctgccttttgttgcatagctgactttgagattgaagctggagagctgcagttgtttcactgcaagatgttaaatatagatagttcctactttgatattcttgtaaataaacttcttgaatatattttcataaaaatacaaacttgggttaagaaattgtgtgcaggcgtatttcaaagccttgcacagcacagttgttatgaaattgccatactttgctagattctggtctaattttattgtgtgaggtttctctgtgggtaggtcactaccacttgccccctgtccatacatctctgcctacccccaccgtgataaactagcttctaagaaagatggaaaaggtacatatatttgtatgaagatatggtgtcatattaatattgacactatattttagggttgttaggctagctaggtttatgtacagcagttttcggtagcagtgatgacagatctgttacctttgtgcctgggtccctgtttgacttggaagcaaaatagggaaggggtgaggcagagggagtttctggactcaatgagctgtagcaaatgctttgtggaccaaagtgctttgttaccagtacaacagagtctgtccaatgtaaatctcttagcaaccagaagggaacaaggagaaatatcaatatcgctattgtaaatgtgcaagtggatttaaatgttttgttctcaggacactcacagagtagatcctaaaactggctcatggataacactttcattgctgttgtacttgttaattcttaacatagtaaaataggtatattctgtaagatacagtgtattacagaagatataatattcatagtccaattatttcatatactacttgtaatgtacaaagttaagactgaattattttgaaaacactctagatttccttcagtggcatagccatatatgaccctcattcctctataaagtgaattgttatgactttgagtttctttatccccacctttttctaagatcctgatgaaggcctatgggctacttcgttccatgttgtagacctcatgtcaataaaaaatgctgcttctaaatattttgtgggttattatggggatagttgctcttgttcatatgcagaaatattgtataggatttttttttttttgagatggagtctcactcttgttgcccaggctggagtgcagtggcatgatctcggctcactgcaacctccacctcctggcttcaaatgattctcctgcctcagcctccttagtagctgagattacaggcacccgccaccctgcccggctaatttttgtacttttagtagagatggggtttcgccgtgttggccaggctggtcttaaacacctgatctcaggtgatccacccgcctaggcctcccaaagtgctaggattacaggcgtgagccaccacaccgggccaggagcttttaatcacataaaagtaatagtggatacgctcaaaagcttgggaaaatcctaaagagtatctagtttataaaataaggaatttggtccatgacactcctgcagttcaggtttgagcaaggccaaagacgaagctttcttgattaggtgtgatgacacagaatcgtatagtatgggatatcactatgtgttatcatgaaatcataatacatatgtagacttaacattggattcacatttcatcaagtttttaaaaactcaatgaattatacatatggtctattttgaatatgttaatcatgagtacatgattaccagtccaaaaaaaaaaaagcagtacagaacttctaggaatttataattagttgagttttaataaagatgtgttttattcttgacataacttaagtagtgttaagaaaaaggaaatcttcctatttgttgaaaggaaatgcgtctaggtggatgaaactttacttttttattactaatttgtctggcttgaaaaaaaaaagtttgaatgagtatcttctttaaaaggtgcttatcaatgcacttacaaatgccccttagccatactttcccactgcccttccctgccatatctttttcccttcacacttctctgctcacgggccgcttaggttggcaaccagtgggaggcatgccaaaagtagatagagtgcctttgggtgggttattactagatccctgccctgactgagcaagtagctgagaagagctgtttatatcccctgctcccagcagggccctggtccatgagcagtggttggtaggtggctcatcctaccataaagccatgatgggctgaagtcacacgtgctctctttgtggtcaggctgcagtcctagcacattgactgtcgttgttggcttctggtaccatgttacctgcgtgtcatgccctctccccacatacactataaaatacgtttcaacagtgagggatattactagaattgaccctaatttgttccataagtgggttttgttagtatatgaatacatgcttgtatatatttaccaagtcctgtcaaaaaatttgaggtgacctaatgaaatttatattaaaaaaggaaacattttggagtttgctctcaacagataggtaagtaggtaggtagatctctctctatacatgcgcctgacacagtgctagatactgggataaaatgacaattaattccatgattaacatcttttctgattattgatgtcaaacatacagttaatcagtgacagagcaggaacaaatattcattgcttcattcttgtattcatgtattcattcagtaaacatttattaagtgacttctgtggatcaggcattgcatcaaatgttggagacaaagccaatcaaagcatagtggcaacactacagtaacacccagaagaggcagggaaggagaaagataagagccactaatcaccctccatagagaatgaagagggagccccaggagcccacagaaagaccctcacctggctcagatgcactcagaggagaatctcaatgaagctgagctttggaggaggagtcagcaagatagtcaagcagaagaacaggagtctcatgcccaaagtaacagaagtaggagagactattaggctgtgtgggaaacagtatttttgaattcctggagcaaaggggacctgagtgtgtggcacgaaaagtaagcaggtgccagagcatgaagatcttcatatgccatcttgcatagtttggaaatcaccctgctcaaagcggggagagaccttaatggtggtggtagaagagaggactgtgaatagctttatggggtagagccatcactcaagcatccgtgttgtagcagcagcagcagggagagcagtcaggaagctctgatggggatccaggcacgaaatgctgagtgtgaaccaaggtggagactatgccagtggagagggggtgttgcataccaaagatatttaggggaagactcagtagaacttggcaatggattgtaggcaggatgtgagagagagatcggattctaggataactgccaagttcctggcttgaaggggaagaggaagaattaaatgtcctggattcatgtcttttctcccaggccatttattgaccacttattctacactaggtagggtattacattgctttataggtggagactaatttagtcttcctaataaccctttgagaagagaaagtatttttttattatccccatcttacagacaaggagactgaggctgagccttgaagctagttgcccaaattttcaccctagtcagacagtggtagagctaagattccaatttggacagtctaactctctagcttgtgctcttaactactgtgccatacaaggtatgtagtatatggcattaatattttcacagctacacatcaaagtgggcttgtttcagaaaatcttctaagtaataagctattttctagacatgtgaaactttaaacgacaggctttatgtctctaattcagtattgtagtgtctgtttttcttaccctctgcagtaaattttaatgttttttcttaagattcttttttaaaattttttggaagttagaaatgaaaattaccaacacaaggatttcaaatcctcagacacattgtgtaatgacaacataacagtgtgttagatgcctgttgtatgtcagcaatgtgcagaggattcccatgggttattcttttttcttccctatgactttcctatgaggcaggcattattttcatctccatttttgtaggtaaaactaaggcttaaaaataccttgtctgaggtcatatagctagtgattggtggacctaggcttgaacttgggtcaaaggactttgggttctgtatttaaccactgggtttattgtaatgagatgctagcagtctcttttaaggtcagccacaatataagggtttgagaacagattttttaaagacatgaactatactgttatttcttgctattgaagctcagtgcttcctgatgttttacaggctttccccattcctaattacctgggtatctctgacaccctaagatgccaggcaagagtaaggttttgtactgcagcagctggacttttatggtagaagattgtgtagatctttatgagatcaaggaaacttgctctgttccctgctgcattgagtatatggactccaggtctccagggagcatggtcaattagcatacttgatattctgtaccataattatgtgtttacatgtctgtcttaccaagagactatgagctccttgaggctggagatggtgtaattatctactacaaccaaactggggcttgctgggtggtgaatgagtgtatgagaggcagtatcatgtaatgattaagagtgtgaactatagagtaaggttgtctgagttcagattctggcactatcaattagctgttgaccttggggaagttatttagtctctctgtgcctcaggctctccacctgcaaaatggatgtaatagtaggatgtgcttaggatagggttgtaatggggtttcagtgagttaatattaaaacagtgcttggcacaaagtaaaagccatagtgttgttgcagttgttgttgttgttcagaatgtacagacaaatgaacagaagaataaacggactatagtgtgagtatttagtgttagccaatgtactgagtcattaaccaaagttgaggtttgtttatgcaacttgcctcaggtcacagaaatacctggtcttggaaccaaggcctgtgtggttgtaagtttcttgcttgggccatcaaaacctctacaagagaggttttcttaagggtgattcttattaatggacatccagggtgaattcttacatcaagaaaaaaattatcacttttgagatgttgaaagttaaattatttactaattcaaattttaataaatcatttaaatttaactgcaaaatctagatttgtatattcctttatacttagtgtacttctgcatttaaaattttaaaatagaatccatttactgaaaaaacaataaaagcattggcatatatatatatatatatatatatatatagatttaggtataggttaaatatcgaaggagaatatctaaatacaacattatattgtcagtcacataattcaaattttattttcaagaaataacaagcaatttgctatagttttgcccaaattgttgttctagtttatattatgtgaattgaaagtagaagagttaaaagcaaaccagaggacatcaagcttgaatcattcacatatacgtcagagttttttctggtacttattccattcacccaggattctgctttcatggaccaaagtggagtcatgaaatgggatcgtccattattgtcaaatgtgggaggtgcttataaaatatatagatttcaatttagatttaattggttctggtaaatgatttctcagtcatgggtgactttctgattaattaggatcatatcctcagttttgtctgaacttagatgtatctcattagaatgggaagaacagagactaccattcatatctgctggatatagcttaccttttggcagaagaaaaaaagtctactaataccatcaccacaggagaagaaggatgtgtggactgcatggtaaaaaatggggaaatagaactaggccctaagagggttggaaggaaggaagttcaagattttgtaggtactgaaagtcagagacactgaggcatttgtaaggtaccatgaaggtacccctgaaatcagaaataccttgtcttggaaccaatcagatgaatagcattcttttaccctaataaagtacaattttgtaagacatctatacagtgaaagaaagtatgaaaacatggtaaattttgtttaatagaagattagaaacattaataaaacaggcaagcaataaggagcgatgtggggaagtatctgggcctaagcattacaattcatggtattgaagagaatgggccttgaggctcaatgtgagttcacagagaagctgctactaattagctgtgtggccatgaactaaatttctttgggcctcagtttgcacattgatcaaatagggatactattttttctttacatacatgttgtgaagagtagagatactgcaaataaatgcatttgccaggttccttgcataaaaagagtgtatttagcaagtttccagcttcccctcctaaagtacaggttcttaaatgtcattgagggattgtagtcaagaatgacgtggaagaactgagaaaaagagggaatatttttaacaacttttgcaccttataagcactcgaaattatttgctgaattgatacagtgaatgaagttttactaagagactgtcattcccaaacaaccatttaagtcccacagttagctctttgcaaactttccacagccctcagggaattaaatctgtcattttgagaaatactcctgaagactcatatgttaaatacatttttctattcattaacaatagtactaattagcttatctcagtagctaaatgattgctgaggcaggtattaaagcttaagaaccctatgtacagacagaggaagtatcaaatgattcctttaataaatgaactttattttgcacattcaaacataaatgttgaaaaaggaaaaaaaaagactgcttgggttgaatgaagaaatcttcattatatagtttatgtattgtgattatgtagaaggaacaaaatattacttatacaagataagattcattaccaaccaatttatcccccaatctaggcagtgtccatgatagaggcattgttacagttttgggacagtcggggactgggagaggaatgaataatctgaccaatgtagacttatctgttgtacctggtttctgaacctaaggtggcccagtggctgtcttcctttatcggcggattcccttctccctgcgatctgattgctacttgcaagagcctctaaaattttcaatcacatatagctagttaaccttcacctgaccaaactggcccacttccataactgccacttagaattatcagtgtattcaaacgctcccacttgtcttaaacaaaacagaagaagtgagtctgaaacctggacatctttccttagacattttcatcatagaccctctgtgatttttttattgcaggaaggtctacccagtgatacatccaacagcaaaagtatatgaagcagaatttacctgtcctgttatttgttgggctataattcattgagggactacagtgggccaggcattctaccacatgcatgacgtagatcattgtattgaatcttcatggcatggatattattttccagttttctggattagggaagttatactctgaaagtttcaaaaacttgcccaaagtttcacagttagtaagtgtaaagctgtaattcaaaccccagttggtctgatttccagccctgtgctttttccaccactcttcacacctggaattgcctctatgtcacactgagagcatcgtttttacagaatactgagctccacgagatgagtctttcctggaccatgaaatgccatgcaagggttcctccccctaggaaatctcacatagaatcctttttgtgatttatctctttccccctaaagaacattacagaacgggatgtagatagtaggagggtgatattactggatgtaataaataaattgactcaacttcaaatgacttttacttcatttactggaaatgtattctaccttaacagtactataattctattaatgctaaaataaaaaatataaatatgattaattcccaatgtttgtatttttgaagataagtggcaaaatcactttgtgtcagctgatttggggggggttcttcgattttttttaattgacaaatgtacatattcatgaggtaagtagtgatgtttcaatataatgtaaagtgatcagatcaagataattagcatatttatcatctcaaacatttatttttttgtgtgttggacatgttcgatatcatccatctacctatttgaaactatatattattaactgtagtcatcccactgtgatacagaatactagaacttactccccttatctagctgtaattttgtatcctttaacaaatctttcctctatacctccctttcccctacctttccagcctctagtattctgttctttttacttctatgagatcaactttttttttagtgtctgcgtatgaatgagaacatgcagtgtgtaacttcctgttcctggcttatttcacttaacatgaagtcccccatttctgcccatgttgctacaaatgacaggatttcattcctttttatggttgaatagtatttcattgtgtatatgtacacattttctttatccattcatctgtttttggacacctaggttgatttcatatcttggctattgtgaatcgtgctgcaaaaaaacataggagtgcagatgtcttttcaacatactgattttatttcctttgcataaatgcccagtagtggcattgctgaatcatatggtagttctatttgtaatttcttgaggaacctccatattgttctctatattggctgtactagtttacattcccaccaacagtgtataaaatttcccttttctctgcattcttgccagcatttgttatttttatttttatttttttgtctttttgataatagcaatcctaactggggtgagatgatacctcattgtggttttgatttgcattttcatggtgattagtgatgtttagcatttttcatatatttgtcgtatgttttcttttgagaaatgtctattcagataatttgcccatttttaaatcggattgtgtgggatttttgctgttgagatgtttgagctacttgtatatgctggatagtaatcccttgtcagctgagtagtttgcaaatattttctcccattctgtagattgttttttcactctgttgattgttttttattttttttttctgtgcagaggctttttagtttgatataatcaagtttgtttctttttgcttcttttgcctgtgcttttgagaacttagtcataaaatattttctcaaaccaatgtcctacagtatttcctgtgttttcttctagtagttttatcatttggggtcttatatttgggtctctgattccttttcagctgatttttatgtagggtaagaagggaaagtctagtttcattcttcattcttttgcatatggatgtacaattttcccagcaccaattattgaaggaattctcctttccccaatgagcgttctttgcaccttcgtcaaaaatcagttggctgtagatatgtggattaaagtttgcattgtctattctgcttcattggtctatgtgtctgtttttatgccagtatcatgctgttttggctactataggtttgtagtatattttaagtctgatagtgtcaattttttgctttttgaaatgagtctattcccacatttgccagcaccttttattttatgcttatcatttttatgagaaaactgtggaaaaagctggctttaaatatctcactcagggctttaaaacagactaatttttagagtttagatgagaaattaaatgcaatttgtagaatggtaagaaattaacaccagcatcaaaaaaactacttcagctgatgatacagacaaaatgttagaaatgagtcaccttggactttaccacattcttttcttattatcaggatagaaaagtctcacaggccttacgaagtgatggggattgttttcctccttgacaatagaagcaatgaataaaaagttgaatttgaggagggggcttggcaaaaactactaaatttctcaaaaaattgattagacaaaaacagatgcttttagactttgctagcaaacctcagtttggattgataggaaacctgctagcaaaagttaggttcaatttacgataaaaataattggtaggtgtcaaacattgttgtctcacataacagttaaatgaaccctctgagtaaggtgacattattcgcattttgctgatgaggaaatcaaggcttagaaattgctttttatcactattactgataaattcagaggctgaacttgaagccatggctatcagactctaaggcaccctgcccctggcctttattctgttcgcagattattcaccagtcatataagattcatgcatttggagaaggcttttactttcatttttattactttattttctatatataaatgatttttatgtcatgtaatttttatctctccctcatcatcaccagtattgctcatttgttttatgtagtaaaactagctaaaaagtgctttttaaataatggtgcatgactgaagctttatgtttttaacttcaaatattacatggggatgttaaatattattgcaaaagcacaaagctattttgaatcaggtgcataaagctcataattgatattggcactgtgtatttacaatagtctagggaagcaacatttgtcaaaatcataaccttgaacaatgcattttgttttcttctagtaaccccttgaaatgtccagtttttaaaatcctggccacatatctgctacctggctggttaggggtgaaggagacaggacatgctgaaaggaacacagcttcagaggtcactgaatccccacactgttccctgctccctcccctcttctgcaaggacctgctgtccctctgttcagtggcttggccactgcaccccgattcaataacatgatgggtatatttacttagctctgtcaaccctcaaaatacatttgcctgtccttaagtaacaggaagataaccatattgatgtttaaaagtgctgcccgtaattaatttctttcctttgaagcatggccattgttaacgatccctgttttactatgcctcttcagctggagccattctttgccatctaaaaataaatggctttgttatgcacatttattccatctgcatttattccaactacagttaatatattaatactaggaatccaggcagattaagttcacccattcgtttgtcttcattattatagaattagtgatcctgatctcctcaattccagtctgattcgtttcaaaagatattgagtgtgcctcatctttgctgaattgcatctttgagggtgaccatgaatgcatttaaaatatgtgtttacactgctgactgggtcatggcctggccaatgcaagtgctggtcttgattttccagtcctgcccagtggctaaggtagcatgaattttctcttgctccaaagcatatgagtccagtttctggtcttttcctgagctctccatggaagagccttgtcttcagcggcaggctgtaatttgattttacataacatgtttcagtggattttctgtaggataagattcaaataattatatagccatccatttggcatctgatagacattatgttcttatctgctttctggtggattagttaggattctgttgtggcacaggaaaggagggtactcatgttcatttggcattctcagctttgacctgttttcctagacctccatttcagctttagtggaaactaaattattaatacgatctgcattgtgcctgtgcagagagctttatccagcctgttttttaaagtgctaccaggaatctctgaagtaataggaaaacagatttttggaggccctgtggaataagggaaagggcctgggcatgggctgtggaggcagaccggcttgggtttgaatcttgacacaattactactacttctctgtggagtgtgaagtcggttacttaagctctctgagcccctgtgccctcatccataataatgcctaccatgaagagacgctatgaaggctaaattaaattgaacatgaagtggccatcccaatgcagtgattcaacaaatgttaattcctcccacttccccactcctttcttcattcccttgtccacctggaagaaatgagggtttattttatgctaagcatatttagtgatagtcatcagtgaaaatgggcaaagtaaatttgctaaagtgaattacaagctgagggtaaataaataaggaaacgataaatacctgtatgtgtttatgttgggggaagtagggaatatgtattccagaaaggacagttaaaaccagagccaaatttctagtaggaagaaatgtggtttatggaggcattaaacgtggggcaggaggcttgggttctagcgaagtgtggtggtatttcccagatcaaccagtgcagctccagctgcttctgcaccagcaccccgacagtcagtgaaggtgcctcggcctgcttgggagattttctaaattgtgataaaccagtccttcccccctccccccccaggcaggccttaatgggttacctttgagttctcactaaaggcctcccactggcagtgctgcttgactcccagagcaaaaaccacttggaagaaattcatcagcagaagttcagttctagtgattctggtaagagtgctcatatgcagtttctcagggacaattagaagtaggcaaaccatgaattgttgggttttcttgctaaatattaactgtcaatgcaaagaagactgctttcagagcttttgacagtgtttaatacctgttgtgcccctagtactcgtgcttgattacttgtaatgtactagagcattctgtgtattctttggacttattttttctcacatctaaatagatgtccattgtagaaaccacattaaacctagagaggcaaagatcacccagagaaacatggctgttcccattttgaaatagattttttcaatgtttttctgtgcgtgtatatacgtcacttcttctttcctcccttctctttcttttgtttctcttcccttttttcctcttcccaaatgaagatgagataataatagtacctccttttttgtaacctcatttttccactaaaaatataatgtgaacataaaaatgaacatatgtccacttcaataaatatatttctttaaattttcaaaggatctatagcatattactttatgagtgtaccaaaagtaccaacgaatctcttatttttctatattcagtttattttcatttttgtttttatgaaaaatgccacaaaggacaacagcacttcatctttttcctaaacccacagtgttcttgttttctactctcctgggtttctggtgatttttgttttgttttgttttgtttttaacatgatattccaggtcctccatttttaagccagagctggtatttggaactcattttccaaaaatccactagctgaccttagttctggtgagaataactctacttttcaccatccccagagcataccctactttgtcactgtgggtctttgtgttggtctgcctgcaatcactccttctatctcatatatacaaatccttccaactgctggggctcatctcctgcctcaccctcttcctgaaatgctagtttatccagctggaaggaatttctttcatcttaactattattttacaactgtttgtatctctcaggaaaccaaagatactctacatggaagtatagtttttctgaagacatctgatgaaaagtcacaggtattgatttggaatgttggcaaggcccctaaggttgcccgccggatcccctttccttgtctgttttatctcgaggaccctgacactggtcctgagagtccttcccagctccagtagtatcccttgtgctcctactgcaggacacagtaggagcacaagggatacttggagcacaaggcatacaaggagcacttgggcaggactacaaatcacagtgtgtcctcttctagctcccttgacactgtcctgtagaatgaagaaatgatagtgggtacacagctctctgcccagggctctgtacttttcctccagccttcattaactcatctgcaattcttttaggccagtgactctcaactgatgagagaagaggcttcatcaggttcatctggggttagcgtaagcacctggcctggtttgcccaggactgaaaggtttcccaggattccactttcagtgctagaacaaggacggctatatccctcactccaagagcatattagaattcatggagtgtggtggggcaaattgtaaagcaagggagagatcctccatgccacctgtctctaaaaccatctcagccttgcttgccttccgtgaccttgccttccatctgtgactatgagatcactttttttcctctaggagtccatttcccattttgtaatttccagtgtcatcaataggctttattcctacctaaatttcctaccatctcctgactgtttaagtacagtgacatcttccccatgtcatgtcatggtgaatcgattatatgaaagtatataaaattcagctttgggcacaccaactcctgctttcattatttagggtctcacccaggacccaattcttgccttgtttttatctctcttcaactcccaggatcttgtttcttattcatttgcattcttattttgattatttccaactttgactttcccctgcctatactgccttagccaagggacggacatttaaatcttctccccacacaagaggcccctggcctggccaccttctacccgatgagatattggacataaatagacataaagaacattactactttctaatttaattctagtttcattttttcctgtcccagtcagagaaagcccaccattgttttattagaaaatgatgggggatgctacaaagttatgtaactaaaatattgcatgtgcaagaggatcactttttactcaaattcatatgatggagatgacaaacatgatttcaaattgctttacaataaatactggttttaaaaaaatctactgatcatgcctctatttttataccaatcactcaaatcatatttaatgcatttttaatgactttataggctgcagatgaaaacacatgattcagtcacttcattagagtgagtaaatggatgatttcatttattttaagtgaaaagaaaagctactgtagacatctgaatttaaatctataggatttatataaatacatcggtttcgaagggcagagttgtatggaaaattcccaaagaggctctagagtcaaggaatcttagagatggaagggactgttgaggtcagtaagccggggcctctgcagagccagcctctccttgacaacagctctatgctttgtcagtctctgcttatgaattgcctgtgactggaaatgtcctatctctgaacatagcccccattgctgaacagttctgattgttagaacatgctctcttattttgagactaaacctagcaccctgtcatggccacccatatgccagctatttatatagataaagatagtgatatgttggtgctgctgcttctcttcaagttaaacgctccctgtttctttagctggtcttcataagacagagaatcgtgataccccttaaatcctctcttagccatcatgagataactagaattgacactatttcatgtgtggattgtctagatcataatatattgatgtagtacatccacagttgttgccacaattggtaaaaggggccaaagtcacagttgttttggggagaaggcagttgagagcccattcagaccattttcatgggaactttgtttctgtttcacataaatttttttcttcctctttaacttttagttttatctcttggttggctttgaaatatatgaatttaactgatttgtggatatactgcaacatttataaacagcggtaaagtgtagaattataaagatgtgaaagctttttccctctaatattctatcgtctgtgttttccattgtagtatttcccattaccttatgcctcacacttagaaattatattctaaatattgattaaggaacaaccctatggtctacattgctttctcttttttctacttccacttggcttccacccttctatttatgtttctgctttcttttctcaccttcttcatcggagaagttttcactaaaattcactagaacagatggaaatattttaatatcagtttggataccagaaaggaacaagttatgtaatgtgttaaaatttatgaaaggctgattttcatatagttcagaataacaaatttaataaacagttggcttcttagggactgaatccttagatactagcaagtatgtagaattatcttgactggagaattaccccataagaaggacataaaaagaacaaaattctgaaacatttgagtatttgttgtagtgcagtgaatatgaaacatacatgttttgattcaacaatatttcaacattttggttcaaatatttttatgctccaggggtacaaaaaaataaaacatgcttccagtcccttgggaactggcagcctattaagagagacagacaactttaaaataattaaaatagtcttacagttgatatagaaaatgtataaggtgcagcctcaccaacatctgatattttttgacttgttaacaatagccattctgactgtataaggtggacctcattgtggttttgatttgcagttttctggtgattagtgatgtggagcgttttttcatatgtttgttggccactcgtatgtcttcttttggagatcttatgaaggggcacatctaccagggcagagggtagagatgagacagatgtgtagattgaaggagtcttgaaaactgagaagtgtggcagatattgtagggagcacagatagaaatgctttgaaaattaatgggacatgatgacttactgaatgtggttggaagagaaaggaaggatcccgaaagaacctgtcagtgatgtcatgtgtgagtgtctgtaaccaatatgtggtgataccttgtattgagaatggaatgcacagggattggtttccacttatttaggttatgccccctcctttcctcccgatttcccctattactttcaactattaacagtatgtttgcaaagtaagaaatgttatctcaggttgatgtttagcttgagttttcagagctagctcacaaatgctgaagttctagatttggaacatccgagaacacggaaatctaccaagctgatgaattagaaacctggagaataattactgaataattttgagaagtgttgaagccactgatttttgtctaagctgtcattcactgggcatgataaatgttagaaatactaattaaaagccttctcagatctagactatggcaatctttgtgataagaactgtgatgttataattgtgttctcccatttactgcgctgtaagtatttgttggattcatgatagggccttcaaaacagtgtcatgttttaatgcattcttctactttgagagcaatatttgaatagtgatttttatatattttttctttttaaattaatttttcaatgctattcatagcgatttttaaaaaatggaaaattagaagaaaatcatccacagtaagctctgcatgattaatataatccatttctttttcacatgctgtaatagcattaaaagtttaattttcagaagtttagagaaatgaaaaaggaagcatcttgaaaaacaattttacatgagaatagtttttcctttcaaatctttttgttaacaaaaataggcacgattacacttagatgtaagaatgcttggaaaagttgccaagctaagtctaaacaacatggactaggtttcacttgtctgaaatgtgctacctttattgaaagattgtttaaagtttgaagctacattttaaagatttttgcaagaacattaaaatgcacttggctgatctttttataaaatacctctgaagaagtgtacataatattttaatgaaaaatgtcaccttaatattaaaatctcaaattaccagtaaagaatgccgttaccccaaaatccatgagactaattttctaactcttcttgtagtttgtgttaatgtgtgtttgtaaatctctctgtatgtttaatttcattaacctgacattgtatatcagtataggcagttaatagttctagcagaaataaataaacagatatctaacgtgataagagtttatcttagataagagtcgaagtagacaaacatgagagagaacagttcacagttcattttgttttaagatgaaacaggtatctactgctcaaatagttatgttaaacaggaagttccctggatggaatgattgtgagatatacaatgacatttaccaatgtaaagaaatctttttataataagaataattgtgtcttgttgtatctgtgtttgaggtcacatattcaattatcataaaatgaggcatacatatattctaaggcaagaggccttcttagactcagccttttgtgctgtagaccacagctgggtcattgacttcagataggactaggaagtcccatagtccctcttgtcagaatggggaatataacaggaatgaatagcccagaacgttagcttgaacttgcaatttaataatgttgagcttctagttgcattctcggcaatgtttactttcatctcataacaataaactgtttatggtaatgtcctagtaaagtgtggcactgaatctgagacatgtggcacaaggaatccttcagctttcgtgtaaatgtgcagccaaagatgttcattttatttgcttatttgctttacaattatatgtccagaaaattctgaaaggaactctgtgcttagatcttgttagtttttactgtttctagggagtttttttttaaaccgaagtataatttagatacagtcaaatgcactgatcctaagggtatagttaatcagctttgacaaatgcacacagtcatttaacctattccttccacaagatgtagaacctttcatcagccctgaaagttcctttattcccttctatagtcagtatccccctgctacttgaagcagtcagcgttaggatttccagcaccaggttggatcttaatgttaattcttagaggttatatgtcagactgacatgtcaaaaaggattttcaaaactatgttttatctgaggagtttttttctccatagagaattattcagaagtacgtgaatggggatttaaaactcagccatgcagatttccattctattgcttctaaaacacatgacagcattctgtgtctaattgttattaaaggaggagcaggtcagtttccagcctgtcaaaaatatttcaagtaattttctttcttgttttcatttggctctattttaatttccacttatgctaaaaaattgctgccaatccatcatgattataccttaactttgtgtggtgtatactccctttgtgtagggcgtagatgatcaatacatgtaaagttagtaagaacaatcaataaacatcatgaataaagccaaacagctcagtacaccccccgcactgagtttggagaagcaatgtttgccttggtatctatcagcctctgtggggtgataggagatcaagtcaaatactccccacatacgtaccttctccatgactatgtgccgttgcatgaaatgtgaagctccgtcatttggatctcatggtagccagacaatacttttgttctttttcttggaaagtgtgtgtgtgtgtgtgtgtgtacatgcactagtgtatagcatcatgtattgcccctagagattttctcttcccttcttttagttaatgtgctcttcttgataaataaatttcagaggcaaggttgtaataaactgaacaatgcagtgagatacacaattctaggatacagggctacttgtatttcattattgcaacacgtggagtatacaatgaaattgcactgctgttgtaatttattctctttattaaaatagacaagcattagacaagccataaaatttccatctgcattcacagcaggctcccaccatctgaaatacagattttcccccttctcttgaaaacacccaggactgaaacattttaatattggggatcaagagaattataatatttaatttctgaaagcgatggttatcctcatcagtgctttcaactgctgcatccattttaaagagaaagctcgccttttatacttaaatgtcactgaggacacaggagttgggtcagaaagatctgcagtgcagcagggggaaatgaatgggttcccagcttggtaattctgctgtagttctgcttctatcaccctaccagcctaatcaccttcagaaggaaaacaaaaggcatttttgcagtgtgctgatgatcaccccagaggcaaggcaacgattgttgttttagcacatttttccccactgcctgaaggagaaaagcttttaataatgggaaattgccaaccaaggcatgtaaaagtgaaagcctccttctctggctagaggaagaattcatttctttctttctctaatttcaaagccaaacatttgcttgacattttaggcatagaaagcatagagtcctataaagatagttaagaaggtaattgtaaattctaatcctctttttagcaaactgttcccccacttggagaatattctgtttcaatttttcataaaggcagtctgatgaaaaatttaaacaaactcttttaggagcaagtcttccgtcagatgtcacgccaagctcccatttggtaggaacggttatgtaaggcagtctgtgccatctatctcagtaatagacatctaacaggaatccagggtccaggaaactctaatgcttgtctctccctgaagacttcatgtttgtggtatttctgcctctgttaacttaagtgtaacagaaaattttaacaaggttaatctctttagaacgatgttgggaaaggaggatatatattctctccttggagagtaaaataaaatgttcacgcagtactataattaggtaaatatagtaagaataaaaatgataatagagcacgttttttcattggataaagggatgggatacagtgctttgagaaggacctccaaggacactgaaggggaaaccgaaaaaataagagttctgaagtcttaagcggtacatattgatttattatttacaaaggactttcatgtacattatcacatttgatccttgtaactctgtgaaaaaggatagtgtcattttcacagaagttatactacttgctcaaggtcagttggctaccaagttactctgaatcctgagtgatttcctccctgcctcccctctttcctccttcccttcctccccaagccccctcacttcctgcctctcttcttcccccttctttcttccttcaatgtattaaacaggaaaagtctagtatctcctcttattctgctagaataaccatttcaggcacatatccatggtgaaagcaggaaagaaaggtctaagcctaaccagattgtatcacagagacctggaggaggtgctgaaagtgcctcctttcctggcagggtcattatcactaaggtaaaaacagagaaagagcagttgggctttaacaaagaatttgtaagtacagtggtttaatttttttgtttttttcgagacagagtctgtctctgtcactcaggctggagtacagtggcatgatctcagctctctgcaaactccgcctcccgggttcaagctatcctcttgccttggcctcccaagtagcttgggagtgcgtgccaccaagcctggctaatttttgtatttttagtagagacgggatttcaccatgttgaccaggctggtctcgaacttctgacctcaagtgatgatccatttgccttggcctcccaaactgctgggattacaggtgtgagccaccatgcctggcctaatattttagtcctaaaacacaggtattttgcccttaacaggtgagagactaaggtttggtacaacttacagagattaaatgtgtgtgaagttgtttcaacagctgtatgtatatggtaatttattgtcatattattattactgttaccactctcactgctgctgacacaatcatagtttatcttggtggttaggagtcagtcagctctggagtaggattcctggatttcctgtgtttaagtctcacctctgttgcttactaacagtgtggccttgggcttgttaattaacctcagtcaatttcctcatgtataagatagagacaacaataatccgtctctcaaggggatcattggaaaaatttcctgaaatggtcaacgtaaattgttttagaagtgctaaataagtccctgatgtttttctctcgttccatttaaagagtatacttctgattaaatcttggttgagacttttaaagtttctcaatacttgtcaacagcaggtatttcttaaacactagacaaccaagagagaaatgcttctaataactgttaaatgcttataatgtcatgcaatatcatataattcaattttcccttttaagagcagattgattgccctttattgttttagagatttattttacaacaaacatgaaaactgctcaaggaaaatggtgataggtgttatcagatttggattaatagaatttaaagtggaatttgggagtaatcttcaaagcatggggatctataacttcataagaaagtattttttatagtttttgatttcttgaatatcatttagcaacttatgtatcttttacattgaatgatatctctgtaacagaaaaggctaaaagatctttataaagaatatcttgctaatataagaagtttttcatttccctcatctcattttctattctttccttttttcaataaatattttagcatctattttttaggcaccatacaagatgagggaaaatggcaaataatagccaaagccttgacttggaatttaaagtctgtgtttttcattccttgaaatgtattacacaaatatttcacatttaagtgtgtggtaatttgggggtatttgttctcaaaaaaaaatccacaaaaggtggatgttgtctttaccctttggaaatatagaaaatgtctctgaatttatgtttccttttttttttgttatttgtttaaaacatacagttcttccccatttacttacagttttgtaaattgtccacattaaaaattgttaccttattttctcattacattaggaaacagtttactagtaggctctatggctatattgtcttatttttctaacaaattacgtccattttttaattatactttaagttctggggtacatgtgcagaatgtgcaggtttgttacttaggtatacacgtaccatggagtttgatgcacccatcaatccaccatctacattaggtatttctcctaatgctatcccacccgtagcctcccaccccccaacaggccccagtgtgtgatgttcccctccctgggtccatgtgttctcattgttcaactcccacttatgagtgagaacatgcggtgtttggttttctgtttctgtgttagtttgttgagaatgatggtttatcattctcagcaaactaatatatccattgttattattaactcttctcttgagatacctctttacatcatttctagatcacttgagcagccttaatcattttctctttttttttttttgagaccgagtcttgctctgtcacccaggctggagtgcaatggtgtgatcttggctcactgcaacctctgcctccgaggttcaagcaattctcctgcctcagcctcccaagtagctgggattaaaggcacccaccaccatgcccggctaatttttgtatttttagtagaaacagggcttcaccatgttggccaggctggtcaggaactcctgaccttcagtgatctgcccgcctcagcctccgaaagtgctgggattacaggcttgagccactgagcccggcctgttttctcttaaagttaaaaaaaaaaaaaaaaaaaaaaaacacttctccttcctcttttttaactacagtgggctggtaacacctttgttgttagcttaaaaataaattaatcctatctttttataaaaacttacgatgtttttctataagaaaagggatttagaaaggacattatatgcatatgttccattttcctggttgtactgcctttttcattctcatttttgatatgtacatcatatttactcttttgttctgtgattcatgttaaggttgttttgttttggtacttttgacattggtgtgacttaaggaaattgtaatgttttgaatttcttattgggctgtgcccttataatttctaatgaaaacatactcatatgccctttggggccatcacagtcggagaagtgttgccctgtacacttagccacgcgccccaacctagaaagggtcgtgtgttgagaacctcagatagttgtttaagttgcacattctcaattctatggaatcttccctattttgccctatctgggccctttattctcctctaattttcttgcctctatccagatacaagtggttggaggagtgatatatttgttaggaatgtctttagctacaaatagcagtgcgtctgactaacagtgaggtaaacaaagaggggtttctttttcccccacaaaacaagcaatctgaaggtagacagctgctggtgctatttcggtttagtgatgttggccttcgctcccttcgttccatgctgcaaatctgcattcaagatggaaagaagtgaacgacagggccagctattcagtgcctttatcaaaaaaagcagatgccttcccagaagtcacaaccaacctgggtttatatcccgctggccagaactgcatgttgtattgcgccccccgcccccctcccccgcccgcccgccgcaaccccagctgcaagggagactggaaaagtaagtagttggcatttctgctggaaagggtagcaaaagaaaacggcttgggaatatccaatggatgaacagagaacaagtcatctatgtccaggatagcccaccctatctactctccaggaccagctctaatgtccccgggtaaagcctttcccaaattcctcagacagagtttttctctgtgaatccacctggttctgcggtcatcatcaactagactgagtgtgctctctgggcgagggctccatcaccgcccatggtacctgagagatggtgctcagtgaaggtttgctaagaaatgaatcaatgtgtggggatcctctcagtgttacctgaagccagctgctggaggtatgcagagtgctgaatgaggaactctcctttccacctgacattccatccttgtccctggacattccctgatgaaatgcaaaaccacagccctgaccactcaatcgtattcattaagatcctatggggagcttttggccaaacccctgcaggctcacgtgcgatagaagtattctcatttgggacagtaagctttctgccttcctaaaattcttacacagttttaaatagtgatagccatttagtctcttgatgatataaatcttagctcagcataacaatcagtgcggttttctgaaacgagaaaatgtacaaaatatctattcataggaattattcttggttatgtctgaataggcatataattcaaaatatagtttatacttcctggaatttacccaaataagatagttaaacaagtgtgcaaagatatatgtacaaagttgttttttgtttttttctagcagtgttttttaatgaaatttggaaacattccagctcttcactatggagttaggttaaatggataatggaacactattgaatcattaaaagtgaccacataggacatcctgagagtatagatatgttgtggggcatatcaagtaggctgtgtgtatgtgagaagtaaccttctctgcttacaaagctgaaattatgcatatataggggtggctgttcaccaaaatgttaaataatgattatctcttcatggtaacatttttcaaccttaaagttttttgtattgttttatttttgaaaccgtgtgtatgtgttttccaataagaaaaagcagttttcacaaaacataattttcccaaaaaatgctttaggttaatgaaaaaaaaagtctgaagaactatgtacaaaacttcaacttacttgacccaaattaacaataaaactggattaacgacctttctcttctaattcacaagaatggaaaatcaggacaaaaagtgaactataactaggaatatattgtaaataataatcctcagaatatttcttggactacatctcttccacttcccccataccttgttccactacaatgaatgatatccctgactacaaactcctgccagttcctttcttactgaataaagtgactgaactatatgaaatacaagtggaataatacattgatgaaatattttcaacatcaagatctaaacaaaaggtattttctgaaaagtcttgagttaaaccgaaaattaaattcacaattctattccctaaacattccaattaataaagcattcaccatagaaactttgaagaagtggttttaaaactctcactttgaaattctagtgtatcaaaggactattactgttaaccacaaatacaggtgaaaactcccgagagcagttcactcatactattgtattgccctgctttttggtaagtagaataattgttagtagcaaaattccgataactcaagtggaaaatatattcgaaaggtaaaggtacacattaattctgtggaatactgaacagcttccttagtcgagaaagaaaagaaaaccccagaagaaagatttcaaaaaatagaattgatccaatgtcttgattctggaatatgtccagtatctctcatcttcttgttgataaaaacctgcatgagttttcagactagtaaagatttttacattgtattaattcagaaaatctatctggtctattgtttttaataataatttaagcaggtgtggcatttttcattttcaccaatctttcttagaaaaaaattgataatctttctgtgtaaatcttcctttttctttcatgggtagatcataggtagaaatcaagaaatataattgtttctctatttaaataagggttttacacgattagatttaaaggttaaatgtgattttttattcaaaaaaaaatctttaagcttcaataaatccagctcctgtctcccgggatatcctgtcactagaaggaaaagagagtattttagacagtacttttttttttgacactggtctcactgtcacccaggctggagtacagtggcgtgaactgcagcctcaacctcctgggtttaagcaatcctcccatctcagccttcccagtagctggaactacaggtgcataccactatgcccagctaactttttaatcttttgtagagacagggtcttactatgttatccaggctggtctcaaactcccgggctcaggcagtcatcttgcctcagcctctcaaagtgctgggactacaggcatgagccaacgctccaggccctagatagtactctttatttttctcttcacatagtaagaaatatttcataccaactttattaaaaacaaaatgaaatagatgtcccactgtaagtttcttgaccttttagctgagcactcttattcttttagctccctggaataaaagaattgtttctgataaaagtagatcctcacttaattccttcagattttggtcaaaacaggcaaataaagtaagcctaaaagcgcagttgtctctcactctgccaggcacacatataggcacgcatgtacacacagagtaccagatgcaacaagatttgaaactgtggttaagaagctctataactatcaaaactattttatggatcctaaaaacactagatattttagatatcttttaggaatcagttaatgtactattttattatactagttcagaagtttggagagtactgatgccaaatagaaattttagaaacgaatagtagagttgtgcttaatcctttaagtttggtctaatttgattacttagtataatggttaagaatttttatattttagatagtatggctgaactcttcattcaaattggcatgtgacttaaaagagctttgactgattgataatcctttgattagttttagagacaggggctttctctgtcacccagtctagaatgcagtagcatgatcatggctcattgccttgaactcctgtgctcaagcgatcctcctgcctcagcttcccaaagtcctgggattacaggcatgagccaccacaactggcccaaatagctttgtttttaaagggatttttaaaagaccaattagtaaggatttagatcaaattactctaaggaaatcataaatcacaccaataaaatataatctgaacttaagaatacatgtgacaaatgcttaaaagaacctcaaactgactggtatatgatagggtgctttagtaaataatagtagttaatttatgtgtgaattggaaagatgttattagctctttgccaaagttgggcttggtatatatttgtagagagaaattgatccaagggagccactctgactaacacttccaaccaaggtgtgaggcatatgctttagctggagaggagtgctattgaggccactgacatcacagggtctcaatcaaattgggagagtgagggcagcaggtgcttataaaagaggagagccagatgtctttatgaaccactgttatttctcattaccatgtatgtagacatggcatgcaagcagacatcaggcattccttgagcacctccctagtgtcagacactgttttacacaccagggttacagtagtgaataagacagcatgagaccctgcaagaatagggcttatagctagtggagatagtcaaacaatcaacatgtgaacaataagccaataagataactgcaggtccaaataaatgtgtgaagaaggtacactcggctaaggtgggtaggtagtaactagaaagagttgctttatttatttagggtggttaggatagacctctcagaagagatgacatttgagttataatctgaattactaaaataaaaaatcttttccaaaaaaaaaaggtttatcaaacagaaggaacaacaagtgcaaagaccctgtggattgatctaagctggtgtgtgttaggctcagaaaggtggccagtgttctagaagtaaagtgaacagaaagaatggcagcaggtgaagttaaatttgaccttgatgggtctgttctgcagccagctgtagctacatcagcaagtcagtcagatatacaagtagggatgtcaatcaggagcctaaatctgagacatgagacagccatctgtgagtgtattgaattttaaaccaatggaactcagtgagagggaaactaaagaatagaggatgactgagcacagagcaccccatcatttagagatctagaaaaggaagagaaaccaaatgagaggctgagaagtaaaacacagtgaggcaggggaaagaccaggtaagcctgcatgattgtctagggaggaaagtgatttgtgaaggagggtgtggccaaccaacagtgtctgatacaagggaggtgctcaaggaatacctgacatatgattgcatgccctatctacataatggctttgtaagatgtaggttactggcagtcttgctaggtgggttaaagagaggagcaagataaagaagtaaaacaatatattggagcattttatggtgaaatgcagcagataaatgacatagtagctggaaaagtgggataagagagaagttttgggtgtgtgtgtgtgtgtgtgtgtttgtgtgtgtgtgtgtgtgtgtatacatatgcatgttttaagtatgagaaggataggaaaagcatctccttgatgggaagatgactgtagagatggagaaattgacaatgtaaaagggacaggagataatggcaaaagctgagtttttgagagggcaagagaagcccagaatgatgtgaggaagttagcacccacattcaagggttggccttagagaaaggcagggatgcttctgccattgcagaaggagagagagtagggtgcctggaacagattcagaaggttggcagagtggcagtcagagatgaagtagtactcatcacatcgtatccattttctctatgaagtatgagggatggctggaagtgaaaaatgaagagggtttaaagaatggagaaagattaggtatgaaataattttcttatttggctgaaaaagcaaatttgctaagtaagtttataagaccttctggcactgttgagggtccattcaagattcatagtaacaaatttgaagtatgcccagtcagcaaagtcaggtggttttctctgggattattcaactgtgcaactcgatttccttatacatattgaaggtatggctgaaatgctgagagcaaagcatataaaggaagtgattacagaggaggtcatagaatataagctgataaggaggaaactgaagataagagggaggtgatcgatagtggaagataagagggaggtgatggataggcggagtctggatatgaaggtctgtatggaatggaataccagaacaagtgagccaagagacacaagggaatggttaactggaaatacccacaatagttactttggaggtgacgcagctgttggtgattaaatttagcatgtgcccacaccagtgtatggctgaagtggattggagaaagagccttggagtgaaggaggtcaaggatgtaagaggccagagcctcagaaacatcactacctgaatgttgaagctgcaaagaaagccaggatcaatagtggagtaaaaacgatgggccatggaatgtaatcaccagtgaccaagggcagtgatgaggataggaatagtagggtgatcagaaaacatagtaattgtctggtgggccaggcacggtggctcacgccggtaatcccagaattttaggaggccaaggcgggtggatcacttgaggacaggagttcaagaccagcctggccaacatggcaaaaccccatctctactaaaaatacaaaaattagccaggcgtggtggtgcatacatgtaatctcagctactggggaggctgaggcacaagaatcgcctaaacccaggaggcagaggttacactgagctgagtttgcaccactgcactccagcctgggtcacacagtgagactccatctcaaggaaatgaaaaagaaagcatagtaagtgtctgggaaacatggacttttgatagtgatcaaggggaccttggatattaggtgaggtgagactgctcctggaaatctctccgggaggatggttggcaatccaatagagtccaaagcatttagctggggccaatgtgcaagtgttctaacctccagctactgcacagttggatagacagggatttttttctctgagggagcttcatgagctaggagtccccaagggaggaattggaatggtcattctcctcaagccagtagatgccacaccttctggggacatagagcaagtggaaacctctgagcatacaatctttccagagtcagtagggttattactgactgtatatgtagactgaatccagtatatagatacatgcacagaggcagttctcagctcccagatgactttagaaatctatgtatgtgaactcagaactcaaatttcctgtgaaaattgtgtttaacaacagagggtgtcattctcagggaagtgtgtgaagacatttcacatgcaggatggctaaaccagaggtctaaggagactacagtgctcaccatgcctcagattatttctactggaaacgtgcattctacttactgctacttccctgggctctcacataagcagcccggcacatattttgttcgttcttgtgaacttcttatgtgtgtgttgctgttactagactgttaagatctttgaatcctaccacgatgcccacattaaattgccctgaaaaacactccgaaataactggcttctgtttctgccctgtcctttttggcagggcaagaaaggaatcttgagaagacaggaaggataaatgaaggaaggaagaaaatccttactggcctcatttttccacttgtgtctgaaatgtagaactttgtttaaagttgtgaggtggcaaaatacgactgactaattgtaggcacattaagaaaaggagcctggagggagatgttggggaaggtttgaagtgcaccttataatcgacaaacaaaggaatattgcactatgaccgtggaggtgagcgagcacttcatggtcttttgtgagtaggttagaagggggagcctttggttgttcagccagcttgtctttttcctcaatgagagcaatgttttccaaactatttttggcttcagatacctcatagtgactaaaagtgataaagccatatggaagaactttgcccaatctcctagctctgtccaacaaggtcatgggcaatgacaatccaataaaaactagtggtgccactaaaggatcccgagggaacaggctattcaagacagtggcacaaaagctaaacttaggtttaaaaaaaaaatgatcactgattttcctcccttttaggtctttgagaaggaagtaaaggtgttgactttttgataaggttttgtttttgtttcaattaaactttttggagaataccattgtttttcatttgttggtttgtaaatcttgaaaattatgagaaatgtagattattgaaagaaaaaattagcaatacagattataaaaagaagaaaatagcaatcatgaatagcctcaatacccgggattaaacattgttaacaatgtagcatatttccttctagtcttttttcttatgtactatttcttaagtggctaaattatatactataaatagtcttgataaaataaatttgtaagctgtccttagattaagcaaggaaacaaaatcttttagttgtaaagttaactatggagatgatcagactcagggtatttatttagcagaaataccaaatgtggaattctctggaaaattcaaaaccatcaatatcaaaaaatacaaaagaaaatttttcttatatttaaaaattcataagcataagataaacgtgtattataataacattccactttttatacaactgcattgtaggggggtagttcttctaaaataggataaaaacaaggaattaacattaaacacaacttgcatcttatcttccctctccttatcagtaagcaagagccaggaagaactggggcaagagctatttttatgttatatgttctttatttctgggatttgcaagtgaaatggcagcaaacggtttcctaactgctgttcttaactctggtttatttggaaagtgttattaaaaaacaacactggtttggttatttttcattaaggacttactagacaatatcaaattcagtattctattgagtttgaagatagtatctgtctttttttgtggtaatgaaagcagtttactactgaagacagcgtttcaagcaggtgaagatgtaatccatcttgtgtctttaaagacagctataattcctggagaaccattcagttatcaaaaggcataaagcactcagacttaaaggtttctcagatcttctctcacatttcttgtggcagatgtgccatgcatcttgggaagcactcagacttaaaggtttctcagatcttctctcacatttcttgtggcagatgtgccatgcatcttgggggaagggaagaatcgcctaaactctaaggcttgattttcacaattctgaaacaattcacaattcacaaagtactcagtggtcaagtctagctgattgtattggagaaggtgggatggaactgaaaactgggctatttattcaactttgatagatagtatacaatgctgtgcaggaggcaacacggcctccatgacatcatggactgcacgtggatatggagatgcgcaagccaagcacagccatttcgtgcctggtcacaggctgagctgataacaatgcacgtagctctgctggccctgcctgctgacaactactggggaaaattaacaggctgggatctccctggggaatcctaagagaattgagtcaaaggttagtggggtgaaacagtaggtttctgaggcaatgtttattttagaattggtcttcattctaaaaactgcccgtgtgatctttgtattcctttagtggttactgaatgttcctggtttcccctttccccagaacaagcaacagcacatgcagggaatagaatgagagatggcgcctgttatcttctgcctcggctgttcagctggggcagtgggccaaaggtcttaactacatctagcatcttcaaaacagagttccctcacaggagagtaggctcagtttctgttaatgagcaaaattaatgacaaaaggaagattgtgtggcaggaaatcctataggcagtaaatagtatgagaatctaaagacctgtgttaggcaggggtaaccaaggaaagtttgacacaggggcttataattaaaataagtaatgaaaagatattctattcatggcttattacagtgcatattacaagagttatggtgaactcatggactaaagaaatactagatttaagattcacagttcctccaggcaccgtggctcatgcctgtaatcccagcattttgggaggctgaggcaggtggatcgcttgagctcaggggtttgagaccagcctgcgcaacatagtgaaacccagtctctaaaaaaaaaaaaaaaaacaaaacaaaaattagccaggtgtgatggtgcacctttagccccagctatttgtggtccgaggtgggaggatggcctgagctggggaggtggagaatgcagtgagccgagatcacgcctctgcactccagccggggtgacagagtgagaccctgtctcaacaaaagaaaaagacaaaaaattcacacctcctatttttcatttgtttcttcatattctctctctttctccatccctttttgcctcttttttccctccctctcctaagagagtctagttccatttactcacgctaaatacaagtataatttaactgtactgtgcacatatacatagcacaacatagaacttaccatccttgagtcttcaaattttagtttctaagtagaaatagaaaagtaaatggctcaacacttacatcttctacttgctaagaactttaccctctgttcttttgggaatgaaagtaaggagaggagaaacatgtgttggaagagttgaaagagagtccaaggatggtgtagagttattctgaagaacatcataggaagttctcacctgtgctctcaggggccatgataataccaatgtatgccaaacaccatagtttccttggatctggtatcatacttccacagctaccaattaacttgaacttctaagtgctgcagtaactgaaattagattatacatctgtctaaatgagagctcttactttagccagtcccatagcgtgttcaggactagcatctgtgtttatgtgcatgagtgaatgaagtccaaaggcaaaccttcagcaaggactttattatcacaagtgagaaagagtttctgttttgtttttcaatttgctatttatttgagacggagtcttgctgtgtcacccaggctggatggagtacagtggcgtgatcacagctcactgcacccctccgcctcctgggctcaagcaattctcatgcctcagactcctgagtagctggacttgcaagcacctcaccatgcctgactaatttttggtatttttagaagagacacggtttcaccatgtttgccagactggtctcgaactcccaacttcaggtgtctgcctgtgtcagcctcctgaagagctgggattatcagcatgagccactgcgtgctggccttgctatttattttaatacagaattcaaatgaacatgagaataaatttccattgtgcacttatacttttatagtggtattttttttttcattctaaatgcatttcttggtctttttaatgcattgttatctgaggtacttgttttataatccttattagaaagaaattttaaaagtaacagggaggtgtacctttacattctgggttcttgctgaactgttctctgagaccccgatggcctaagcagtgatcctctgcccatctgtggctgcccagtccccattaaattccctgtgacttgtcttgattgtttcagagtctgaattgtaggtagctgcacttctacctgagcctgtcatacagtttcccaataaagttcaaaatagaacttaacacctttacatggtccggtagtttgtgttttaataaaagaagctggactaaaaaatgcaaatgagtagtcttttatttttcttcttcaaataaggaacttccccaatgctcctgccctgggatggagcagtctgtgatagcactgaagtgaataattctagacttggcagttctatgtcaaagcaagtctcataaacacagcagatgtacgttctgggtgactgccattagcgtgcatctgaggggttattgactggttatgggcagatttgggggtagaagatagtgaaggaaggggaaccaggactttaccccttgttgttttattttctgagtgattgcccccaaagaaaaactttcccagtctgaatctctaaatagatcttctctatttaaatgcttgtggtcctattaactattgggagcaaaactttctcagtctgaatctctaaatggatcttttctatttaaatgtttgtggtcatagtaactattggaagcactgaattggaagattttcactgaacagaaagaagtaagcctggcctttgtcattgtttaaattccaattgtttctttaaaaaaatgaggaaatatatgccccctgaatggtattgtctggttttataaaagtcggcttaggagatttttttttttctctatgaaaccaataaagcagttttaagtaattggagctaaattattcttcctggaacacagccaggtcagtggccctgggaagtatcaaagggcacagggaactctatggtgggcagcagcagcatcattacctttgtccacctggtgagccaggggctgctgagaccctgtggaacccagctcacctttcctgggatccttttcctttttgatggctgacctaaaaaactgctcacactgtggtatttcccctctgcctgtaccagcaaccttcagttgcttttatcttggcaacagctacatttgtagatctccacagctgctgcttttcctttagcgattagagctgaggtttaagagaatctcttggttagatttttgagtctctttcctggggaaataggattgagaggattggcctgaacaggctaagggactggcttcattacatgagacaaacttggaatagcttctgtaaattacttcttatctgtcctgtctgcccacatttgtaacatcacaagagttagaagaccccatattgcttgagcttttcgtgacctgaagtttttcaaccacatttatttaaaccatagctctttcctctgtttgtttaagctgtctcattcctaattcattccctcccccatatcccctccactgctgtatacaactggtctccttaaagccaaaacctttagctaccattttgctcgataattagctagcctacatttattggctgttgactatgtattctactatgcatattatagatatctacatacattgaatacattgtcttatctcccctcctagagtgtaaatttcttaaaatcaaggacaaagcattatctgcctttgcctctccttcgtgtagtgccttgcacttagtaagtgctgaataaatgaggccatcactgtgattatcactcgacttgaaatatataggaaatggatatgttagctattaggtgtgtattctcaccattgtatcctattccattcatttccaggaaaatgcttattaactagacaagtccgttactttatggtctttccctgctattttcttgtcttactgttccctctaagtctccactcacttctaaaaattatgacttgtccagagacccatgttgctctgaagtttcttattcttccatgaatatttgtgcctattagaagggagaacagagggtgggagtctctatttctaccctcatttcaacttttgttccaatgattgctactatttatatatcctctcctctgtttctttgtgcttagaaagaattagggttcatgtggctttttgcagataaatagagttattcgtagccaaagaatttgagttattttgagtctctctttatgaggagcaatgattacaagtcaagggtaaggattaagattttcatacattttggagtttttcatgtttaaaaaaaaatgtggttctagatgcactgaatatttcatggatttgtttactaagcagttatcttccttagcatcaaccgattatccttaactaatctttgcttactattttcatgagagctaaaattcctatttgcttcagttttgaatttcctgccagagctataacacatgaggtttttgtactctttctctagtagttgatgaaatccagaattcaagctgtctacgtagacatcttgcagaaaaagatctttttctgatttctctggttgaattcatgggatcacaagttgaatgaaaggttaagttcaagtagcaaatgaaaagcaaaatgcaacactaaacagtttgcagcaaaaatgttctgcatttttctccttcaagcagctgttgctcaactaagttgtggcggtactgatgctcttccctctctgtgtttctcatgagcccatcttgttaccacttactcacccttggagcagggcttcttcaagtacagttcatgctggggaggctgaaatggcagtagagagcttataaatatgtatgagagatgtacacattgctttagcatcccttctgtcttttgatgttatagtctaagatattttagcagataatggatatacccctttcattcaatgtacaattatggagaccttatcatgcgcatatcatttactgtaccagacaatgtggtcctatatggtctggatgagactactataaattgatttcttgtgtggcttatgaaatcacattttcttttaaaggtacccttctataaaatagaaatataatgtatcatgagtgtaaaaaccaccactaccacaccaccactactgctgttagccgctaccaaatacaagggctttactctatgccagacactataatgaatctttcaaccctctgaagtgggtaatgtatttgtatttagcagctgggaagcctgaggctaatagaagttaaattacttgttttgagttaaatatctaatttgtttcagagctgaagttcaaacccaagtcgatcttaccctaagtctgtgtctttagtcactatctactgctgtctccgggaggttttcaaatgccagtgcttcctgagacagccagttagttcgttttttttgttttttgtgtttttttttttttttttttttttggctagtgatagggttttctttcatatgacagataagacatagatatgaataattaaaaccctacatcccagcaggtttctgtgtcacctagacttagaatgggctggctggggtttcaaagatgtaagactcaaatatgagtctgtttggtatgaaatagcagaggcaagatggaggagcctcctttggccctttaaagaatttgtgatccatcctcatcctattgccaatgaggctggagagaatataaggccctaaattagtgtaggaaacaaagtccactttctggctgacacttcaagtacaaggcaagcaaacaaagcaaagcatggtggtggtgaggggttgggggttggggctaagaagttcaaagtcacacctgagactcagagcccatctgatgctctcatgctgtaaagctgcggtccaaatacaggcacactttattgagagtttaaggcagtggttctcaaaacttggtccctgagccaacagaatcagcatcagctgagaacttgttggaaagataaattctcagggggtgagtcccagccatcagtgtcttaacaaagaaattctgatgcatagcaaagtgttgcaaccattgatttaaggtacacctctttatatcattacgaataggtctagtgatataagaaaaaagcaatagatttatgattgtatcaattcaccaatttggaacttaactattcattcattaccatttattgagtgtcaggcactttgataggtttcaattgatttcatccttaaaacaaccctgtaggatatttttatcctcattttacagatgaggaaacagagattcagaggtgttaggtgacttgtccaacatcacacagcaaatacttgtcttgggatttgactcacatttctggaaacatgctctgaaaatatccaatcccaaggaagtgcttcatagtcaagcagaaagacagatacacaagcaaaaattggaaaaccttactatctacgtagtttcatggtgatgaaattaaccttttcagcatgcaaagagttaatcaagctgatgttcccttaaaaatctacataaactcttctagactaggggggtttggtaaagagactaagcaagcagtctttctatgtacagtttataatcatggaatcctgtataaattgttatatttgaagaccatgacatttttgaacacctgctagtgtgcaaatcattcagtaaacatgtatctagtatgtatgtacagtactgcattaggtagtactaatgcaatatatatatatatatatatcatatatttcttgctaatgcagtactgtacatacatactagatagaaactaaaaaagctactaatagatggtctcaagttgtttaaaagactcttatgtatgaaatcattaggaaacaataaaagatagaatatcagggcctaaacaacatgacgtaatagtggttgagtaaagggtgagatcagtgaggctcagaacacccattctctgtaaataattcaagccaccagtgttttccagaagaataagtctgtatgattggtaaaatgaagttagttactctgggcctagggcaaaagacatgaggcatagcttactctgtgtgtgtacttttgtgtatatatgtttgcatatatatttccaaagtatgagagttggttatgtatgtacatgtaaaacatcaacagtaattgctgaattgcccccatcccctgcaagcagataattctctaacaatgtgtgataacctctctttgtattccttaacatgggaggtttattattccttaatgtggggcatttattatattttaatctttactaatttagtaggaaaaataatattgtttttatctgaatttataaagagttataagtttgagtacttttttgtatgcctatttcattttatgtcctttgcagatagttttgattgaagggtttccttaattgttaagagttctttgtactgtatggatagcagcctttgttgtataagttgcatatacttccttttgtttgttctttttttttaaccttttttgtgtgccatatagaactgttacatattcatgtacacaaaagtataaattatacattccctgtggcttttgcatttttctcctacttagaatttcctgcttcaaagcaaaattatccatgttttcatccagttgttttctggttttattttgtatacatgtatttttaagaaatctaagttgtatttgttacaaagagtgaggaaggaacttagcttcattgttttttcttctagtggccaaccacatgttctcgacccaatcattatgaataatctaccttttcccccactgatttcaaattccacctctattatatattaaactcccaaatttacttgagtgatttaattatttttgaactagtttttagacttcctggcatcttccccatatcagtctatgctcctagaatcaattgctagttaataagggaccacatttgtccaaacagcttcctcttaacactgcctccagtataatttacagaaaagaagtgagatgcagttttaaagagtatttttattaagaatataagactcgtgatttttaatgaatatattctccaagaatgtaagatccatgaggacctagagcagtgaacagagaagagcagattcctaataaacatgtgttggatgaatgaactggagctttagtattgtcttatcttctttactttctaaaaggctaacatagttcatccagataagaaagtaatacacctaaatggatataattcagccattttgtgttgggtactatgtgttaaaagccataaaactttctgagaatctatctgaagaaaatgaatcaaacaggaaagggaaaattacacttaaaaaattaccctttcagtactctttatatttgcaaaatgttggtaacaggtaatctaaatgaccaataagatgagtgactgataagataatttagaagcaaatacaaaagtagggatatggcatgccaactattaaaacacacatacacacatgcacgaaatgggaaaaacctagaatgagttacatgaaaaatgataaattgtgctgggaggtaatatttcagaccccatttgcttattttcaaaatgttaatgcagttttttgtttctacagtaataaaacaaatagcaccatgaatctagtttaatgctcagttgaggcataggtacatgtacagcatccttagttgggctttgtttcacaatattggctgctgattcaatattttgagctttatgcagcaagaaaggggcaaaacaaaaggacatttactagcaaacccatggacctgggcctgtatttgaagacccaactatacaaatgtcagaagttctgttagccttttcagaatgaatgtgtcccaaaatgatgcctactttccattctgtgtgttcacacgcaacacatttctttaaatctcatctttccaagttaaccaaatatttcatttgaatttgcagatcacagagtgaatttgattgatacacatatctgtggattctattgtggctacaaaataagtgaagtacctcccactgatagtcactttttaagctctgttttcaatgttgtatattctaatgaaatcttgttcttggtaaaatatcatagccatatattttgatctaacattttttaagagttttgaagttgtgtacctagtgccaataacaaatatgaaagatattttcaggagggtggtggcaacatttttaagaggagtgttctttataatggcccgtgtgcgtgggaataccttggggatgcagaacgcttttttatacctctttgctgtgcgtctttgtagtgttcctcaaacagagctgttgtctgtattgctcacatctcctgtgaaatctaggcactcccatagcatctttggcatcgggataatctggattagtaactatattattgttttattcttcagttttctacagctataaaagtaccttttcagatcacatttgtcttagcatccaagaaatgtggaatacagaattaagaattaatatggaatatgaaattaggaacattaactaatgtggaatatgcttaagatatagacatgatattagatggcctgaaattagttcacaggtgattttcagtgttctcttttcatttgttacctgttggattttggatgttggaagcaagtgatttaggtgaaaatggcaatggcgggcaggcaaggcctgcttctatgagctggtttagtactaggctgttattagatctgcctctcccttttccccttcacatgttcaaaaaggagtaagcatgctagaaaaatataggcccaggtccatggatgtgcagaactggcacttgccgtagcaagggttctcaaaatgtggtctctggattaactacatcagcatcacttggggacttgttggaactatagattctccagccccgcatcagccagactgaaccaggaatgctcgggtgggtccagcagtgtttccacaagccctccaggtgactgtcatgtatgctggagttcaacacgactcttacaagaacagaaacttcacccacaactgtattctcgctgtcatcacctctctttatgactgcttaatacataaaatccaatttcaaactttagagaaaggtacctctagatctgtctccattctcactcctcagaggagccatttctgatcatttctgggtttagatatattggtagtccttcccaactcttaaatattttctttatgtatcatctctgataaccatttattgcaacctgctttgagagatgaggatttagcttacttatactcccctttctttcctctggctcctcccaattgtttatcacttagttttttgaaattttggttcttccagagattacgtttataactttaaattcctaagtctttactcattgaacttagagagtactatgtaaaataaatggatatccacttccctactcccccttttctccctcccttcctctttcagataaaccattaatttttattttatttgttatgctgaatgcaaaaccactaactttagattattgacatttttattttactgtgataaattatctaataatgtatatatacattgcttctgaaaattggaaatagtgtttgcaataggatgattgtataaatattattcattgcagaataaagggataggactgatctttgacttaataactcacccacgagtatgtgtcctcctgtccttgattgcttgcctgtgtttggtctgcagccttacactgtatcataagaacatttcccaaagtgttttctataggtttttaaggaaaaacatggcaaagtaagtttgggagacacttgagtaaacaaacacacgactgtagaactcatcaaagcctttagtttctaatgagaattgttaatcttcaagagagggattggtatatagcatttctcaaatgtactgggtcatggaacccctttttcacaagttatctcaatgacttcatcttatgtagaaaatattttggaaagcactgccatataggatctctcgattccagatccagatgacctcatttctgcctagattctacatccagcctattacctaacttgtctggttcaatgctcagacttagtgaaccactgctcactgagatcctagccctgacttcgacccaagaaaatacattttctctcagctaccgtattagtttcaaagagctaatgtgtatgatccatgatgtaattaagtactgccaataccattgcctcagtcagagtgtcccttcactgattgtcttttatcagatcatatgatggtgatatgcatgtttcctaaatgcttggtttctcttaagttttcctccaaattgtcctagaagtagtaaccttaaccagccttcccctctgaagatattttctttctgaaaagcagagccatctaataataaaacaaattgactcatttaataagaaaacccctgaagtgcgtttccagttcttaaaattttatgattcaatatccgaattcttatctactgaaataaaaactttttttattttggaaaggacttttttggaatactgcagtgtaggagatatttaatttcagtctgattcatgcttctcaagataaaatataccatcctgaggacaaaggttttgtcatattgcagcatactgcaaagtctaggcaagcacacgaaatggaacacagagtagatgcttaataaaaatatttattaatttttaccaaatgaaactttcctaccttttctcctacaaatttggttcgcttccaaacccactccctctcatgaatgtgtaggaagctggtttatatttatctttctggaagatatctccagctaaaccaccattgagatacttcttttttttgggaagatgacaaccatttaccctaaaatatgatattataacaaaaaacctatgcctcttgtgaattaaccctatcgtggtctacttaaaaaccaatctaaacatttttaacctaaaattaggtttcttttgactaaactgtgtattttgcataaccattcattcaaaaaccaatcactcagtgctgactctctttaaagcactatgccaaacacagaacagaacacaaaaaggaaccaggcacgatctctacccttaaatgccccctctttacttgggaaaaatggacaggcacataagtggataaagtgcaaagcagaagcctgccatgtaacaagaccatgaatacaattcttttggagttctctgaataaaaataatattcatatttaggttattttagtgggacctctgatattatctacttatatcaattaattatgagccctaattggtagcttctgggaagaatctagggaaacataaggcctgttttgtgcccttgaaaaacttaatcagaagacaaggcatgaatgcaaataacaataatgataataataattgaggaggtaaccaacataagccagaagatacatgagctcttataaagtagagcatgactaatcaccagaagaacagatttgagtttcagaaactctccctactggctttgattcattttttatactttctcaagaaatcagaatgtcccagatgcttagtaataacaatgtagagttgagtagcccatgtcaagactggagagaaaagaaagatcagaattctcaggagcagcatcaatgactgaggaagtggtcagatggcagtggctttgagcagactctagaagggataagagacagccaacacagaatgacggcttagaagttctgcactggagtcaaataaccctgggtttgagtcccagatctaatactttgctcattttgaaaacttgggcaagttttttaatctccttaagcctctgttttcttatcagtaaaatggttacgataatagaattcatagagtcattgtgaggatacagcaaaattttgcacatgaagtgtttagatcagtgtttgcacagattaagtgcttagttgatgctggctgctcagcgttgccaccgtttgtactactgcctctatagtatcttctctgatctgtaagaaaaggtaataatagtatctctggccaggcacagtggctcatgcatgtaattccaacattttgggaggctgaggagggaggattgcttgagcccaggagttcgagaccagcatggccaacatggtgaaaccccatatctactacaaatacaaaaattagccaggtgttttggcacatgcttgcaatcccagctactcaggaggctgagacatgagaatcacttgaacccgggaggaagagattgcagtgagctgagattgcaccacttgcactccagcctgggcaacagagtgagactctgcctcagaaagaaagaaagaaaaaaacaaaaattagctggccctggatatatacaacttgtagccccagctacttaggaggctgaagcaagaggattgcctgactccagtagttcaaagatgcaatgagctataatcacgccattatagttcagtactctggataattcagtactttaaccaatacttagaccagtggttctcaaatatctgcatgcatcagactcacttggaaggcttgtttaaagcacaggttactgggcctcaccctcagaggttctgcctaggcaacagagcaccctagcctgggcaacagaacaagattctgtctctaaaataaaattttaaaaagtacctcttcatacatggaaaatttttgtgagaattaaatgagaaagtatgcagaaagcttagccagggctgcagcttcctattgcatgacttctacactgcacatttcaagggaggcatcaatctgctcactgtcatcatagatacatgtaatcatcagtaccttttcttgaggaagtgacaattattttccaatttgcaaaaagtcatatttgttggcagagagctgggaaacagcaagcgcgttgtaaattctagttagtaccgctactgctgctgttcttgccgctccagtaattcctagtatttttacctccacttctactcatgttttctgttcaccaaaagcctcaatcctgccctgggaggagaaagttgtctggacaaatcagaagagctactctggttttattatttcatttactattttcaaaaacagtgtaagatacatttgttttgcattttatagagaaagaaaatattctgctccttactgaaaagcctcaaatggcctcaagtgatagactgataaagttggaatataaacttagctttgtatatatttttctgataacacatacagcctgctcagatgaagtgcctgtccttgttttacatgacagggagaactgattcagagaccatatgagaggattatggtgaaataggtatgtgcatgggacacgatgacatgtttataattaagagagacatgtacaggtattatcgtatggtatccatcctttcctcagagaagagttataggattctaaggtttgctgatgctttatctctctattaacattttaattttattccacaatccagaaatatgattggcctctgagtagattgcattttcatcgcaatgcagaaaattaaactcccacagatgttagtggaaaccatatagctatgcagcaatttcaaaatgtaccacttaatgtctgaaccttttaatcatgctagaattttttttttctatcaaataaacacaaatctattttggtactaacaaagaaaagaaacaagcacacattctatttcactccactcttggagtatatgctaattgtctttggaaacccaccaaacatctgtgaagctctccccaagacttcatggcttccagacccaaatacggctcctatttatttggagacaaccaaacaaacaaaactttcaggtaactaaaatttttctacattaaatatgtttggcctctgagtagattgcattttcatcacaatgcagaggattaaactcccacagatgtgggattaaactcccgctatgggggaaaagattctaggaagtgtttaaagggcaagcctgaattagggatttatttagaaaagcagtatcacagttttatcaaaggggagaactttcagcccagtctcctctaccttataaatcaccatgggagatgatgaattggggaggcaatagttcccacaagggctggggggacacaacgtcatacacatccttgaatttccattgcccaatacatgttgacataccatgcacgtgtcctgatgctgttgaccttctgcattctactgaatttgagaaatgtctgcttatagcccatttctcttacaatatcaattttgtaagtgtggctcctaggccagcagcatcagcatcacctgggaacttgttataaatgcacattcttgagctccagtccaggtgtattgaatcagaacctctgaggtgtggggcccagtaatctgtgttttaaacaagtcctccaggtaattctgatgcaaatggtctaagtactggctaaagtattgaattaacctgagtactgctttctatgcctgctggatgggggaaggtttattctagcctattgcccaatctttatactagttaactgtttgtactttaagtcaatcagtactctgtttcacactatactgaacctcagagtgcagagaagtgggagccaagactcgggaagaaatcagagatggagagagtaacaggaacacaggtacatctttctcagtacaggtgagagaggtcaggcatccagcttcttcctcatagttcacaacagcaattcaagcatttgtaaacagtgggactgaggttaaaaagtggagccaaatgaaatgtcatatggaaaatcaaatataaaatcagataatgggataaattcaatgcttcttcactggccagtcatatacaaaatgctttttcctaatatggtactccaataatatatttttctactatagcactcaccaggatgtgtgagtaataagaattacttgttaacctatgtttataaaactgtgaagtcagggaatatcttgctttattcatttgtggtatgccttagcacctacctaacatatattagggggcttaatggatagctgtggaattgaatcaggcacttctggtttggggcaagctgcatgcttgccaattatgagataaaagagacgtcactgagagtgaaggggaaacatactaagaagacaaactaggggaaagctcaagagattgtggggtcaaagaggagacatggaatttaatagggaaagtattcagtcggagcctgataagagaaaatgctatgattgaaagtaggagtctgggattgaaaagagaaaggagaaatggtgggaaaatgtgatgtttggaggaaaacagagagggtcatgtataaggatcagaacttagattatagggcttggcaagaatggagaattcagaaaacagaatggagcaagatgggggcagcaaagaaaaaactacatggaagacatggaactaccttgagcagtggaagaggagaggataaaatcatggggctggggaactagtattttctattttacttgatcatctggacttaaggactttaaagttcattgttatcttattgtttcataaccaaagcgaagtccaactcataattaaaccatctgttagtgtccccacactgcccaactgtcttcccagagagccccactgcataatttggtcttggcaacagaaattctttatcttccactgtttgtttttttttttaaagcctttttcttgatgacaagccactgagcagcaattcctttctgcagcctgaaaaccaagaggccaggccagcaggttcaggggtcagttcatcattcaggtgccatcctcatctgctggaccgcaaagagaatgtagatgcacacaaaatggtccgagggacgagtccttctctttgtctaaacattgggtacttttcttactgaatatacactttgttctgtgaaggtgctctcaatcttcaaaggggtctgagctagttaaaagcatcatctggcatcagtagatatgctggctattcatttacagttgtcttacgtaaaatgcacatttaacttctttttttagtaaaccactgatagctttttcttaaaatgcacattcattttagaaaatatagataagccagctagctaaatatgtaaatagatagatagatagatagatagatagatagatctccagattccaccatacccgaaatatgcaactactatgaccattttggcattgtgcttttctgtgtgtatatgtgtttgtgtcctagcaaaaagaaatgcattcctgcaggaaaaatgcactgggagaagagcatccagggcttacagtttacattctgtattgtgagctatcagttgctatgatttactgaattgaggggtacgttatgagaaagtgaaatctgggttttcatctcttccctctcactcttacattttaaacttttctccttctcaagagttttcacattctcctgcaaatatgctcaactctctcccagcctaattaagccttagttgcccccaggacctccaatgcctgcttctccccttttaacctcaccttttgcaagagtactctagtttggcctcgactccccaacctgccccaatgtgacttttgcctgctccttggcaccagcttcccccccccgccaaactatgttaaaaatcctctcaataatgcaccagtgatcatcaaacttccgcatccgaagaatattttctggtctttttcttactgggcttctgaattatagtgggcacttacggttattgctccttaaaattctcgtctattggcttctgtatctaagcctggctggctttccatctctgccacctagaggtagctgtgtaattttggacaagtgtctccacctctctatgctttgtttgcctcattggtaaattgggcataataatagaatctgctaggtagggttgttacaggattagatgaattaaaaatttacaaatcaattatactattacctcaagaaacaataataaatgatgatatggatgatgtcctgccatacctgcccatttttaaggttagtttttaagtcaagaccgatgagctcattaaaattctgatcactccatctgtagttgctcaaaatcctaagttccaaaattgccttcattgcctgtgtttatatagtttgatgtcttgccctggtttgctattctgcagctgtttgtaaaggctgcaatttaggtgggccaacctgccacattcaccctgccaaacagcaggaatggtccaggcctgacttctcatttgcagaagagaaaattttatagatggtctagaaaagaacaacctcctggttaaagcctaccagaaaaaaattccctctactatgcagagatcatgtgtttacagttttttttttaatgtcccacagtagctttattcctttgagaaaacaaaaactttttttctagctgcttggagattgaatgtgaagtagagcttgtctttaagattcttattagtaaccctcgcttcccttactagccacaacctcattcttgttcttgagcatccaggagtctctactgcaaactcgggaagcattccataccgtggattgtaatcattttttctatttccttaacccccagacatacacacgcatgcacatttttcttaaaatccattttctcaacatggtgtaagttgaaatagaggacctagccccagtgtcaagtgtctccttgaaactagcctaatagtgggaatataaatataaggtcgtataaagccagtacagtgtttcaaacctcttaaaacctgatgaaagtgatagactccaccttccactccagatatacgttaacacccagtaggcacataattgtttgaggttcatgaatctcctgaatttgtcccatggagtccagtttaataataaaaaactcaagtttagattattatttttatgcccataagatgctaagttataataaatttatcactagaaggggactgtactgggctcttgttctcaattttaggataaaacatttcccatttttttagctaagaaaaattttactgcatcataaaagacttcagaaatccatcatcttacattagaaaacttgctgcgaagttatgcaaggccactgctttcccttaaacctcctggagtcaaggggagagaccctggcccagcaacttgggatcaatcagaaaattagcccaggaaactcatctgggtcttccagctctgctcctctgcacctagatagacttgaacctctctaactggcagatatgtaataaagtacagtgatgctggcttgctaagagtgcaaattttaaccacggtagtaaatattttatgaggtgcggggggaagggaggattgtggtgtggtggcttttgggtgctattaatatagatcacttttatcaggggaaacatttgtcattgaagtacagtttcaaattaaataaattacaaagattattttatgtggtcaaaataaacatgtgaagcccatattcattgtattaagtgttggtaaaaatctttattaggggaaaaagtataagataattagtaaccaacatattcaagactgcagacattgtggaagagtctatgtaacagactaatagagattacccaattgccatcacctgggatttttaaccttttttagtgtagtgttaatttctgctctctgccgaaattcctgtgagcacataggtaggaaatgaaacacaactaaccaatacatgtatacatcattagtggacaactgatggaagtaaataaaaaaatataattagaactaaatagtatcccaggttcagaataacaggataatatgtgttttcattgggttcatctgtagaaaagaaaattttctttaaaaacactatgagaatggcgatcattaaaaagtcaggaaacaacagatgctggagaggatgtggagaaataggaacacttttacactgttggtgggagtgtaaattagttcaaccattgtggaagacagtgtggcaattcctcaaggatctagaactagaaataccatttgacccagcaatcccattactgggtgtatacccaaaggactataaatcattctgtaaaggcacatgcacacatatgtttattgcagcactattcacaataacaaagacttggaaccaacccaaatgcccatcaatgttagactggttaaacaaaatatgccacatatacaccctggaaaactacacaggcgtaaaaaagaatgagttcatgtcctttgcagggacatagatgaagctggaaaccatcatcctcagcaaactaacacaggaacagaaaaacaaacacagcatgttctcactcataagtgggagttgaattatgagaacacatgggcacagggaggggagcatcacacactggggcctgtcggggggttggggtctaggggagggagagcattaggagaaatacctaatgtagatgacgggttgatgggtgcagcaaaccaccatgacacgtgtatacctatgtaacaacctgcacattctgcacatgtatctcagaacttaaagtataataataataaaaagatgctcaaaaaacacactatggaaatttggagactttagatgtatatccatatgtcccattttatagttctttatcaaaataaaaagattaaagagactttaaataacctataaaattgtatgtttttatacttcaatgcctgaaaagggtatatatgtgtacacacactttaaatagaccctgctaattagcctaaaatttgcttaatgttagaatactggaatggtgtggtttattcttatttctattaatcctcccaacagatccattatttttgtcttgtaaccactttttacggttcagtgatttatctgatactatcttaaagcatcgattcttggaatggtcaaaattaaaccacatagcagcaatttcagaggcggaacagagccatcaaaatatactgatgccttcatttaatactgtttagaaattagaatagggtgctcttatttatatatttatttttggcctttcccaaatatctgttgtgttccttttcttcctcctcagtagctgctgccaaacaaatgtggcaatactgacagttgtcactttacagcagccttgccattcccttctgtccccctccatgtgtccctctcactgggccaactgggaggtgactacaaaggggtgcaactggcagaaattagtaaacatttttctaaaagttagaaaaataagtgctgggtgctaacatcagaacagtggcgccaacacctacatactcagccctttgtgaaattcatactttgcattagaatatgtacttgatatgaggtgagcttctaaaaagaaattgtgtcctattttcttgacacattgtattaaatattatgcgtataattaagctacatatgtcttcaccaggaaattgctagtcgttctgaataaagcccagaattgcttctttatacttttctcaatttagaatcagaaattaaggaaacatgcccatttgcatgtgcttctaatgacagagatggaaggatgtcttaattagttttaatcatgaggagaatggtaactagctgatgtccttttttgctgaggttagcacaatagaaaatgggcttaaaccgcgacaaaaagaaattgagttagccatatggataaatttcctgatgttatgagttgttcaaatgaattactcagagactaggtctgtagtttaaaaaaaaaagaaaaaaagatgttacctaattaaagggagaaaagaatcaatttctttctgattttatctttaaaatggtttctctgcaaaggtaatttaatatttaatattcatttctgaatgaagtcaggtcttcagttctaattggttgcttcttgcaataaattaataggtgttagtttaaaatataaactattttttaaatctcctggagaaaattaatttgttttattgattagcaaattttaactcaaggacagtgtgtttgtcaaaaagactgacctgtttggatttgccttgaaagaaggatgggcaggaaggagattctaggcctcaagcaagcttgaagaatgacctgcaagttcgctgcaatgagagtctttttgttttttttttttttttaattaggctgttttaacttcacaggggggtttcctccaaattattgagatcttaacttttaaaaaatttaatcaatcccattgtcgaaattttttaaagtaagtcgtctgttaactcgtcaaccagagaaaaacactgtttcattttgttttgttttttttccaatcttctgtttaattttggtgtataacacatgtagatacatatttataaaaataattccagatcttgtttattttacttagcattacagcctaggcatttttatcagatcatttaatatttcataaacattgatttttttttattatactttaagttctaagataaatgtgcagaacgtacaggtttgttgtataggtatacacatgccatggtggtttgctgcacccatcaacccatcatctacattaggtatttctcctaatgctccccctccccatgcccccgaccccctgacaggcccagtttgtaatgttcccctccctgtgcccgtgttttctcatagttcaattcccacttatgagtgagaacatgcagtgtttggttttctgttcctgtggttagtttgctgagaataatgatttccagcttcatccatgtccctgcaaaggacgtgaattcattcttttttatggctgcacagtattccatggggtatatgtgccacattttcttcatccagtctaacattgatgggcatttgggttggttccaagtctttgctattgtgaacagtgccgcaataaacatacatatgcatgtgtctttatagtagaatgatttataatcctttgggtatatacccagtgataagattgctgggtcaaacagtatttctagttctagatccttcaggaatcgccacactgtctgccacaatggttgaactaatttacactccccccaacagtgtaaaagtgttcctatttctccacatcctctccagcatctgttgtttcctgactttttaatgatcgccattctaactggcgtgagagctcattgtggttttgatttgcatttttctaacgaccagtgatgatgagcttttttttcatgtttgttggccgcataaatgtcttcttttgagaagtgtctgttcatatcctttgcctgctttttgatttattttcttgtaagtttgtttaagttctttgtagattctagatattagccctttgtcagatggatacattgcaaacattttctcccattctgtaagctgcctgttcagtctgttgatagtttcttttgctgtgcagaagctctttagtttaattagatcccatttgcctattttggcttttgcattgcttttggtgttttggtcatgaagtcttcgcccatgcctatgtcctgaatggtattgcctaggttttcttctagggtttttatggttttaggtcttacgtttcagtctttaatccatcttgagttaatttttgtataaggtgtaagcaaggggttcagtttcagttttctgcatatggctagccagttttcccaacgtcatttattaaataaggaatcccttccccattgcttgtttttgtcagttttgtcaaagatcagatggttgtatatgtgtggctttatttctgaggcctctgttctgtttcattggtctatatatctgtcttggtaccagtaccatgctgttttggttactgtagccttgtagtatagtttgaagtcagctagtgtgatgccttcagctttgtactttttgcttaggattgtcttggctatacaggctcttttttgattccatatgaaatttaaagtagttttttccaattctgtgaggaaagtcagtggtagcttgatgaggatagcattgaatctataaattactttgggcaatatggccattttcacaatattgattcttcctatccatgagcatggaatgtttttttccatttgtttgtatcctgtcttatttccttgagcagtggtttgtagttctctttgaagaggtccttcatatcccttgtaagttgtattcctaggtattttaatctctttgtaccaattgtgaatgggagttcactcatgatttggctttatgtttgtctattattggtgtatagaaatgcttgtgatttctgcatattggttttgtatcctgggactttgctaaagttgcttatcagcttaaggagatttggggctgacatgatggggttttctaaatatataatcatgtcatctgcaaacagagacagtttgatttcctctcttcctacttgaatacctttatttctttctcttgcctgattgccctggccagaccttccaatactatgttgaataaaaatggtgagagagggcatccttgtcttgtgccggttttcaagcggaatacttccagtttttggccattcaatatgatattggctgtgggtttgtcatagatagctcttattagtttgatatatgttccatcaatacctaattcattaagagtttttagcatgaagggatgttgaattttattgaaggccttttctgcatctattgaaataatcatgtggtttttgtcattggttctgtttatgtgatggattacgtttattgatttgcatatgttgaactagccttgcatcccagggatgaagccaacttgaacatggtggataagctttttggtgtgctactggatttggtttgccagtattttattgaagattttcacattgatgttcatcagggatattggcctgaaattttctttttttgttgttgtgtctttgccaggttttggtatcaggatggtgctggcctcataaaatgagttagggaggagtccctctttttctattgtttggaatagtttcagaaggaatggtaccaattcctcttcgtagaattcagctgtgaattcatctggtcctgggctttttttggttggccggctattaattactgcctcaatttcagaacttgttattggtccattcagggattggacttcttcctggtttagtcttgggagggtgtatgtgtccaggaatttatccatttcttctagattttctagtttatttgtgtagaggtacataaacattgatttaatgcctgcagtacattccaccatagagatataatccttttatttaatcacttctctattattgagcattgcttacaattgctcctaagtataaataaagatgcaatgaatatttaatggtaaatatttgtccaaatttaatgttatttctttagcaataacacttttaactctgtctttgaccatctaaaactgccaccatcttataactgatttcataagcctacataattcaataagagagattgaaggtattaaaaatgtcacttagacttctatttcttgttgtatttgcttccattgtttcaattgttgtctctcagaaaagtcaccactgcatcgacttgagttccctatcttggaaatatctagtttaagtgaatcaagcctacgtttgaatagacaaaacagacaaatttgaaaaccactggataccttttagaagggattctttttttttaagaatatgttcactaaagagtttatttaattgatgtcaacccaagagtatgtaaaatacagccaaacttaccaaacttccatttacacacacacacctttctaaaaataaatcattttgactctgaaacagtagtatgcgaacctggatgagactccagttgcctgaagagtgctttaacaatacagtttactaggcctactaaagcagaaagtccaatgagtggccctagagaactggcattttttaaatctgacctgttaattctgatgatcagccaggctgcggagctgtagagtcaagggcatcttttaggttttatcctatgatgctaaaaagatatcaaacagaagaaagaaggcatggaagagtgaggaacgtctactagttaaagtgacacagcctttgagcctctcttttacttccaagaaatcccatagcactctcccatatcctcacccttattcttttctggaccatttaagaggacagggagggactccagatctagaagacagttttactgcggtataaggagaggaaaagattagtagaatgtgggagtcagtgcaaaagtaagtttttgtataggcagtatttaccaaccatcccactgttctaaatttacatattaatatgtattgtatctgtccacttagaaagaaaaaacaaaaaacagcttgctatcttaacctaagagaaaatgtgtcttgtccccttcctatctcaaaagagagaggacagtcaatctccataagtatttatttgctaaatccatgtgcaccctgaatatcagtagcccaagaacctacgaaagaataggcatagaagtgaaggatggtcataactgtcacctcgccctccattgatgccacacttgaatcaatcagtctggctcttccttttatgccttcatcccaccgaatgtttaggaaagctgcatgctccgataaaaataaagatctgacttgctttatgaggccagtccctgccttaagagagcttacttttttttttgagacggagtctcggtcgcccaggctggagtgcagtggcaccatttccgctcactacaagctccgcctcctgggttcaagccattctcctgcctcagcctcctgagtagctgggactaaaggcgcccgcaccgcacccgactaattttttgtatttttagtagagacggggtttcactgtgttagccaggatggtctcgatagcctgacctcgtgatccgcccgcctcggcctcctgaagtgctgggattacaggcatgagtcaacgcgcccggtcgggagctcactttttaataaggagagaagacagggaatccacatccacctattcatttaaatcactgagtgtcagtaggagggtccctgagaggggttgtgagatttggctgatcatttagagaacaggtggcagcgatggtcagagagtcttccagggagactatgactgaaaggagggagaggaagcgttagaacccagagatgaaaaatactttttcaagttcaaatatttagacgtggtatgaaaaaaaagcaatgatagatactcacatcaggatagagaaagatttggaggtaaaagtaaggtacgggctctcactgaaaattgttagaggcaatcatcagaacttcccccttgatcttgagtcaaatgacacatggaggcttgtgtcaaaactgataccagctttggctttcttaagcaaaaggtaatttatttttattattatttttttaacttttaagttcagaaatacacgtgcaggtgtgttatatatgtaaacttgtgtcatgggggtttgttatacagattatttcatcacccaggtattaaacctagtacccattggtggtttttccagatcctctctctcctcccaccctccaccctccaaaaggccccagtgtctgttgttcccctctctgtgcctatgtgttctctttatttagctcccacttgtaagtgagaacatgcagtatttggttttctgttcctgtgttagtttgctaaggataatggcctccagctccacccgtgagctgcaaagggcatgatcttgttctttttatggctgcatagtatcccatggtgtatatgtaccacattttctttattcggtctatcattgatgggcatttaggttgattccatgtctttgttattgtgactggtgctgcaaagaacgtatgtgtgcatgtgtctttataaaaggatgatttatactcctttgggtatatacccagtaatgggattgctgggtcaaatgatgtttctgctttaggtctttgaggaattgccacactgtcttccacaatagttgaactaattttcactcccaccaacagtgtataagcattcacaaaggataattttctgaaagataccaggagcttgtgtctaaggggagcaggagacccagggttggaaaacagagaatcagtaaaagtgtgttgctcattttaggtgtcaggaatggggagcatgaaaatccactcctcatagtttgatccaaaccatcttacaattttatggtcattgcagctaggaaagaaagccctgggttggtggtggaggggcaggggggtggtctcaggctggcagttaagtgttccagctgagaaaggacatgtataatttccacctaccacccattggccaaaagtggacatttgtctcctgctaactgcagagagatgtaatcttctcacaggcacagaaagaggtgaaaaccatgtatagggaagtattcagtgcctctatgatgggagcaagaagcaggacaggtccagagaccaaggaaataggaataacagtaaccttatctcagatggtcttgtctgggcagttccactggtacagctgaagctgaacaatactcagattcattgttgctgtcattaagattcaaatatcagagaagaaatgtctgattagcctagcttggttcaagtgttcaccatctaaccagggtaagcagagtacattatgggtagtgacgggctaagagttaaaccctaaggaaatcaaataattttagggagcagcctaggatatgaatatgagctgtttgtttaacagcaagaatatccacctcaatctagaggctgctgggagtacctcatttcagtattcaccaaatatttattaaacaactactatatgctattctaggcactagggatatagcagtggccacaataaacacaactttactgctcaatgaccttatatttttaatagataatcttggttggtgaatcgctgagtggcatggagaatattctagaattgtgagagtaggaaaagattttatggtctaggcaggcaaagggagagcgctccaaaaaaagaaaaaaaattaggagacttacgggtctctgggcttctcattcctgaaagatttcaaactgcagctgactggccatttaccacaaatgttctagagggattgcatggattctgtgagatagggagactgagaacagccttcacttaggctccttccaggttgaaagttcagggaattaatgagagcccaataaagggacactgtcactgagaaacagaaacatgaaatgagataatttgagcaatattgtaatcagagagaaaatatttcttcttggcaggagcagactccctaggtcactctaagtaaaatcttaaactggagatccagatgagcactcagctaatgatggtactaataagtccctgctgccacacatattcaccttccacttgcactttgtcttctgtcctggcaccaactgtccatgtctaaggacatattctcgacatgtacatgagattcatctattcttgccaactctaggacatcactccagcatttctcccttctctttctgctttcatatttctctctgtagtgggtggttcccattagtatctcacatgcttgtcccctgtcttcttctagttactacctctttttctgtgtccctctttatagtcagatgtttgagttgctcacattcattgcttccaagcctcttctctgggtccctcacgaaccctctctaaacgacattatcccttactacatcatccatgctgcttttgcaggaacacaggtggcctctctaccacaaaatgcttcaatcagttctcagctctggtctgacttgccctggcaggagcatctggcacatttgaccacctccccctctttgaaacatgttcttcacttcacttctaggacacctctttcctgcttgtcttcctaccttgctagctacattttctcagtctgatcttttttcatctctccaacttctgaatgctggcgtaaccatgagctcagtcattaggtgatatcccttgtccatttttcgttttcccttggtcatatcatccactctcatggcttaaaaaacctggcaatatattgataactaccaaatttatatttccattggagacatctcccctaaaccctaaactctagaggtgtgtgtgtgtgtatctctaatagcctactgaaaatcaccacccacatgtcgggataaacaatgctgctgtaacatccatattgctttggaatgcacaattcccatgcattttggcctgacttccagttgtaaatatttataacttagccagaaggctttctctagcactagagcctagtcagcctacttggcctgtgtatgaggctgagttaactccctccataagctgctgtcaaccagtgactgatgggagctaaaggatgaatgctccagctcgttcacttctcagggacttctatgctcctgcacagacatttgttttgaggtatcttctgtttctcagagttccccagagagattgagttccagttgcctatggtatcaactggcttgttaatacaccctttactggagtccgtttcttacccatctcacttcaattccctgtgatgtttcctgggatcatctcccgggtagattacttgcactcaaatgtgtgtctcaaggtctgcttgtggggatatccaaagatagatgtcaaatgggcatctcaatgataacaagctccaaaccaagctcacgatcttcatgcccaacctgctcttcccatagtcttgcctgtctcagtaaatgaagaacttcttccagttacaggtcagaaatctgtgctcacacctcatactcaattagtcagcagatctgcctttaaaatataccccaaattcaaccactagattttttttcccccccataggttttcaccctctggaatagtataatatttgacatttcaaaattgtttgtatccagacaattttataagaaaagcagtgttcatttgttttgtttgtcactgtaccctcaatgcctaaaagagagtctgacatacattaaacacacaaaaaaatctgctaagagagttgcacggatgcttaaaaaagttgattaatgagaaaaggccttggggaagaaagggataaaaggatgctacagagaatgcttggggaggatgaatgtgcttttttccagactaaatgtctttttttttttgacaatatattttttatttttattttttcaaataataccactactgtttaactatagccagcactggctaaaatttttatattttcagagctgaagttggtgaagacattcatgatttaaacaccagatcctgaaaggtgttaaatctactttgaaatgaatctgcaatcagtatttcaaagcttttctggtaattttagtgatcttatttgactagactttttcagaagtactaaagaaattttaacaggtttttattaatgcacagataaatagaagtatagtgaggtctatagccattttattaaaatagcttaaaagtttgtaaaaaaatgaatctttgtaattacttaatatattagttaagaacccatcaagcttataccaaatgtctttattataaaaatatttatacaactagaaaataatcctaagacaactttagatactcaaggtttatcaccatagggcactacagtaaaatattatgttacaaaagtagggaggtccaaaaactagggaatcatttttagtaatggattctgccagctcgcaccccccaccgcaagagttctgtgtgctcagatttacagaaacttatctattcatgtgggtatattgaaaaaaaattgaaatgtccagaatcactttaagtgaattactgtcagggtcaataaatgtactgttctcatgaccctgatgatcaacaaaggggaggcagggctccacagtggttagagaatgggctctgcagtcagtctgctgatttcagccccagctttgacacccacttctgcggtgtgaccatgggcaaagttatatgacctctctaatttcagtttctgcacttataaagtgagactgatagtggtgtctatctaacgaggacactgtgacaattaaatgagctaatacatgcagagttcagagtagaatgcctagcgagagtaagccctgagttagtggaagatactcttttccgtttgggtcatgtccacatatatttacctgtctttctcccaggctatactgtgagttccaagacatgtaagctatgccttttcttttcttttcttttcttttcttttcttttcttctcttctcttttcttttttctttcttttccttttgttttttttgagatagggtcttactgcatgtctctgtgtagccttgagcggccaagttcaagtgatcctccaacctcagcctcttgagtagctgggaccacagatgtgtgccaccaacgctggctaattttttaaattttttgtagagaagagggtctcatgctgccaggctggtctcaaactccgggctcaagtgatcttcctgcctcagactcccaaattgctgggattacaggtgtgagccaccatgcccagccaactatgattttatataacatcattattatgtttgtataacaccttccacttttaatgttcaaaatagcatcattgtaattggaaggaatacctttttgtcctgattttactaaggaagcttagaaagtttctctgtaatagtgattttcaaccagactgggggacttagtgacagagcttgctgggaggattttgtcaccctacacatacccagtagagagtctgaatcactgctgcatgaagtcactcttgcaaatggggtggtggagaagggagggattgtattccacagattgagaacaccctgtttggtggtattttatactggtgtgcaccaaacaaaccttttctctcaactcgaactatcccatccaaaatagatggggaagtcattctataggtggtgccatgctctgtgtgttcccttcagatttctgtaaccaccaagacaattcctgtgctctgcacacagcgagccttcaaacatattgctttgtttgtttgtttttgagatggagtctcagtctgttgcccagactggagtgcagtagcacaatctcagctcactgcaaccttcacctcctaggttcaaacgattctcatgcccgcctcagcctcctgagtatttgggattacaggcatgtgccaccatgcccggctaattttttgtatttttagtagagacagcgtttcaccatgttggccaggcagatctccaactcctggcctcaagtgattcacctgcctaggcctcccaaaatgctgggattagaggcatgagccaccataccaggcccatggtgcttttttgaatacaagaccagagagagctggagccgtgagctccctcctttatccagccttgcatttctatgccttaaggtacccatcatgggcaaagcacatggaagatttgagacaaagtcaagcaaatggttccaagttactccaaaagagaaattgtaggtggtagtagggctgctgccacaagttaggcacaggcccagctccttctaatccaggaaagaaagtggttggaactgaggagaaacaagttttaaggcattcaaggaaggacagcctagcttagttagacatgatctatatgaagaagggacacagaaggctgagggaaactggggtcccttttctccaggaattcctctggagtaccagtttgagaaactcttgtctggaatgtcatggggaaagttggggtgactagggaaagagataacagtatttaggttataagtagtcataatcagtggtgaagaggcatggtttatgggcaagatagagatagaacttttaggccaatcaatatactgtaacttttttttacattttgttagatttttgtggccaagtagagaaagaagtcttcacagcatagctgtttctaaacactttgccagttacctgtgggttgaggcaaggtttcattccttgaatccctaacatggagtgtagtgcctggtgcccagtgagtgatcattaggtacttgttgaatcaataaatgggtgtgttttaaagcatcttggggactggcaaaatatgtgcttaaatagtaaatattgggtacagaatagacgatatatttctttataacaaattctatcttactatccagttgtttttccccaggctggcatttgtcgtgttgtcttattactgttgtcatgatgggagactacgttaatgagaacaagttagaaattaaaaggcctagttctagtgcaactacctgtttggggaaaggtttttaatctctatgagcattggtttcctggcctattaaagaaggataataataataaacctgcccagagtaccttacatctcaggtactagtgatgatcaaatgaaataaaacataacaaagccttggaactagaaccatccctttgccctttgcaagtgtctgttatagcagcctgtgaacagtgttttttttcaaaggcaagaatttacagtccagcaatattttgaagtaattagtaatcatttgcaacaacaatgccagctcatcagtcttctgtagtgaacaagcaagagtgcaagtcctcattaccaagtacattaggctctgcaaggcgctgctgattagtgaagagttcttcagaattcagtggtatcaaatggattcatacttaggatcacagcaacctaaaatgccaccgggcacttggggaaattgtcagtgtttcttagattcaggaaagttttcttccataaattatcatagcatttggcaattttctaatccagttatttaagtatcctatcactatcagcattaagagatgatgttttgtgtcataacatgaagagggagatttaaaaaaagagataatgttttgaaagggggcagggtggcgaggaagtgaccttttcttcttggtgttctggagtgatggttcttaatttgttgaattatgatcccccctcctctccccaatggcctcatgcagaaacacaaaagcaatttgcactctgcttcccagagttcagagaaccactaaatcctgtgacattgaggctacctggtctggtatattacaattgaattttgctttgagtcaatttgtatgtggtcatgaaggatgttcagtaagtcagagctctgttggttttggcttgtgaggtaaagtcgatcccattatctacagccattgatttgagagtctgatcttggaaattcaaattttaatctattaaatttttggaaggatgtattattggttgtatagtctaagtgaaaatgcactgtgaactgttaagaagggcactctaggaaatgtttataaagctgggtgttgagtagataattgaaaaactattatttaaacatatgagctagtatcaggataaatagctaatgcatgccaggcttaataactaggtgatgggttgataagtgcagcaaaccaccatggcacacatttacctatataacaaacctgcacatcctgcacatgtatcccagaacttaaaattttacaaattatgaaataggtacagataacccaaaataaaccatttctataaattgtgcatagtaaatggcatttctttggagcatttgtgtattttttttataatcttatgaatatgtcaaaattctctcatgaaggccgaggcgggctgatcacgaggtcaggagatcgagaccatcctggctaacgcagtgaaaccccgtctctactaaaaaatacaaaaaaaattagctgggcatggtggcaggtgcctgtattcccagctactcgggaggctgaggcaggagaatagcatgaacccgcgaggtggagcttacagtgagccgagatcgcaccactgcactccagcctgggtgacagagcgagactccgtctcaaaaaaaaaaaaaaaaaaaaattatctcatgagttgatgtttggggccatagctacaactcatcatatatctgatgatgttatttcaggcaacttttctcatttgtcagatggagataataatacttactttacagacatgctatgggcattaagtcaaatttcatatatttagtgattttttaaaaatagatacatacaaaagtaagttatgagatgtaatagaaggtgctaagtgctatgagaacaaatcaagcaggctaaggaggatgggggacacaagggagtttaaaaaggcatccaagtaggggccgggcacagtggctcatgcctgtaatcccagcactttaggaagccaaagccagggatagcttgaggccagaagttcgagcccagtctggctatcgtggcaaaaccctgtctctactaaaaacttaaaaattagccaggtgcagtggtgcacacctgtaatcccagctactcagtaggctgagacacaagaatcacttgaacccaggaggcagacatcgcaccactgtactccagcctgggcatctgagtaggactctgagtatacaaagtacttgaaacctatcaggtattcaataaaagttagtatgcatgtatatggatggaatttgcccttgccatgtgcaaatccaagtccatacaatatatggaatatggggccaggcacggtggctcacgcctgtaatcccagcactttgggaggctgaggtgggcggatcatgaggtcaggagatcgagaccatcctggctaacacggtgaaaccccatctctactaaaaatacaaaaaattagttgggcgtggtggcgggcgcctgtagtccagctactcgggaggctgaggcaggagaatggcgtgaacctgggaggcggagcttgcagtgagccgagatcgtgccactgcactccagcctgggtgacagagcaagactccatctcaataaaaaaaaataaaaataaaaataaaaacatatggaatatggatggttaaactatacttacgatataggcatatgcgagacagggttgcagtgtctctaaaaggacaattataaaaccacgttctcttcctttttgtaaacaataacaatggaaattacaactaatatttgttgagtgcctactttatatacattaattaacctcattgtatatattacatttattatattaaattattccttgtagaaaccttgtcaaataaaactgttattatgctcatttttaagatgaaaaaagtgagaagtaactccagaagacgaaaagaagctgagtaactagcccaagattaagagctaggaaggagccaagcaaactttaaacccaggttgtcagcccctaacctgacttttaacatagggaaccatgagacttcctgcttttttgtttgtgtgaggacatctagtttgctaaggtgtcatacatttacctagcatttcttgttctgtctctgcttacttgaacagtttttcacagggcgagcaccaggctgccccagagcctgcctttgatggcagattaggagaatccaaggattaacaagcatgtcctcatagctcaccaagttgtatggagttctcaagtcctccctgtctctctccacagaagctgtggcacaggggaaccttgattttggcaggtttttgatgttgagggagccctgagtctctggaaatgctgtctgctgagccaaaagcatttttcgtgattatttccattgcaattagcccaccttagcacatagagtaaaagctgaggagatttcaaacactcctgaaatataaccatcagaatacactgaattatcaccttatcgctcataatatttgctggcagaatcttgctggaacacttaaaataaatccttaacatgctggttgggaagagaatggtagcaaatggggccagctcactcgtggcacagtaaatctgccatgaattgctgagatgaggaagaagttagagagagtggcagtatatatatatatattttgaactttcccaaatcctgtggaaaaaaaattaaacaagtgaagctaaatcttcagattaaattttaccaaaacattctctccacagtaacaggtggacaggttagacaatttcctaattcatttccattttaattgttagtattttaacaaatgactcatttctaacagctcttttggcagaatcagtgattctggaccgtttttactttttagttgataagtgcttgaatcattgcaaccttagtgagctctggctgggttctatgcccaacttcttcttgggttcttggaagggtcattgcatttactggatttaaccagtgatctactgtggatttcatttgcacacctcagtgaaagttacatagactttaaaacacggtaatataaaaatactttcaagaagaatttacataaaaacctaatattctaggaaatataaaaacaatgtcaagttgggaatccattctgtttatcagaggaagaactcatagctactacttatttatgcacttacaccctctatctctggccctacagttctgactgttttaaactcatctggaccctctcttaacccctaccatcctataaagtgctaagccacactaggaaagaataaaagggtggataatgggctgcgtaaactggaaaattccactctaatggaaagtaccatgagaaagtgaaagatatcatcattcgtctacatttctataattgtgtggtatcagaagtctaagccaacgtaagaactttacctttagacttaaaatcatgtgaattttaacttaactctgagatccagaacacaagcgttttccttttagatcttcccttcatagtttatgtccagtttttttaaattagttgccaatatataataactggagagtggcattttaaaacatccagatttacagcctttcttgaactattagaagatccacattcttgcacctgtcaacttgagccaggtgtgtgctgtcctcctcgaatggagtttgtaccttcactcatcagggtctacactttctgcataaaattttccccatttgatgaaagtgaagctcatgttttcagtcccagttatgcttttacagttgtatattcatgggattgttccacagaaatacgcttatcctctttccagatgagtcatgtactactcatataacacagattcccagaagtgtgccctcatttgcatttcctgtctggcctagacctggctctatttacataacataattgaaaaattgctattttaagggttaatttggttaactcctgttgagattaatgtcctgcaagctctctccagtataacacagtagtaaagagcccttgagtgatttgcttataaaatgaataacaatgactttttacagtatggtgaaaattaactgggaaaatgaatgcaaaatgcttagtgcagtgcctggaatatattgtccgtgttcagttaatagcattagcattatgcgtttctgtctacactgaaaacagtaactggacatcacttgatgaaagctaagacttttgaaaatttttgctttttaacttgattctctcaaaatatcatcctaatcagaatcaccactgtagtaaatgttatttattcaatcactcaaaaaaatatttactgaataccacagtaaccaataggtaactttttgtcttagaagagtgcacactctagcagggagatggagaataaactactagagctacatataagttcagatagagataagagccagtaagcaaaaaaaaaaaaaacaaaaacaaaacagaggcagggacaagggtaatgggtgatgcaggctggaggtgctattttttttagctgagatattcaggataaatctctctgacaaggttacagatgagatattgtcatcaattagaggtgatttataaactttgttcaatgtcaactgttggactatttattcttgtgtttcatttgggactttttgtttttgctaaacatttctgtaaatattgaggatgttagggtagctgagtttaatgaacttggtttgaaactggagaaaagaatattttatgaaagcgctgatagttgcaggagagccaagttcaggaaaagaccaactgaagattcaagaaaatagagtgattgatgactgaagttaaggaggaaatgagtggccctggaggacaggcaaagagataagctgtggacagcagaagatctatatgttccagctcatcctttcctgcaggaaagacaaactaatgatatcatgaagtcagcactttttccttactctctgcacatacttgagtcaagtgaggctcttttttttgcaatctcaattatattttacaatattacattcacatggttctcataaatatgcttattccttttccccgtgactcatatattactcagaagttactggcttcctttaactttgattgaatctccaaactctcttgaggatatctcttcgacagtggtgttgaccctaacaaagttgcagctcatgttatccgcagggtcctgggagtaagcgccatttccagactagacgtgctcaattctgttctggtcagttctgcagacatatctcaggtattgtgctctgtgaaaaaggagcaaaggtgaagaggacacctgtccctaaagattaatcatagctaccgggactggccttcccagcaagagcaccaccctattttgcacactggggaggcctcagatgtcttcagtttggcctcttgatggctctcaatcatggaactgcaaagtccactgtttaccaagacaaggctagggagaactagagcaaactgcagagaaaatgcccagctctaggccatagctgtggctctgatgcagccagttgttgctgcatggaaaggaaggcttagctttgcttaaaacatctgatttttgaaagaaggggcaaaaatctgaactcataaaatctctttatttgtgaatattggaaattaattagctttttttaaccctaataaagattgtaattaagggagatgcgaaacctgttaacaagctgtgtgactttgaacaagctgtttttcctgtatgggttcattatcaggaaaattgggtcccactgactatgaggtcccatctaggcctaagattcaatgtttgatagttggaaggcaagacagaattgctatgacttgacaatgtccataggtaagaggactgtgtccaccttgccaaacccctttaaggtaggaacagaccatgtgtcatgtctacctctctggatcatcagtaaacacatcaataaggagcagacatttctagcattcaacagacatttatcaagagctttcactgtgccaagccctgtgccagtcaccatccatcaggcctctttatgtggataaggagatttattatttctagctgtgacattcaggcacccagcccagcactgggctcagaactggggctcagtaattgttggttttcttctcctccttccctgaagctgctcccatggagaattcttccagaactcattttgcttgacttcttcccttggcctaggatatgtttatctttctttagcaattttaactactctcaaaaaccagctcaagtctatcctgttttattcctgcccgcaaactctgaattctgcttgctcacattcatttaaatattaattgagcatctactatgttcctggtactgttcacaagatggacaaaagtcctgcttttaagaactaaaattctacagggctggaggcaagtaggaaacaaactatgaaccagtaataagtgagaaattgattaaatggtattacctggaaaataagggtgatatggtagtgatttcagacctactttagattgagtggccaggaaaagcccctctcaggaggcaatacatattctgtgacctattgataagaagaaagcagccttgaaagatctggaggaagacagcattccaggtggagggaactgcaaattcaaattctctgagggaggaatacaattgcctttaggaggaatatataagaagtcagtgtgtctggagcataaattagaggcagaggggagacgtactaggtgagaccagaccagagaatttggtcaggtataaaaagaaaacagggaagtattcttcccccattctcccaattggagtaaaattttctagaaggaactaggactattctccctctctctctctttttttttttttttttttttggcttccatatacccaattacttagttactatttagttaattgactgaatgtgaggaactcactaatcatttagtatttagtgtagcaaagtagggttacatttcagtggtttgacttgggaatattcagaaggtttgggctacacataacagcctaggaggtttgaacagccctttcttgatggctagttcggcagtacccatctgaggacaaagtttcattccttgcttcttcattcatctgtgtgctgtttcattgcatgttattttgacccagtagccaacagccctctaatatggtttaggggataaagaagcaggcagagggacacttccacaagtctttgtaattgaacaaccaccaccagaagatggtttttctccactaagtctggcattttaatgagagaagttctttttgtttcctatctctgataactgactactcctccccaatcccccttcatcctttgcctgagggagattaaaggtggctggaatgcaggctggagtcattaagtgttctctcccttaaaacgaaacacatgacatgcaccagtcctttctgcagagtagtggaccgtgatgtgacttgctccacttgaccttttgatttatagagttgaagaaaaggacattgcagagaggagtgatgaatgaagatatttagttctacctcctttttgaatttctgggaaaaaaattatttcagtagaaaggaggaggtaacttcaataattatattatttctacacattttagacattgggagttacttgtgttagaattgattacagatctgtctggcataggcattacggctcctaagtctagattttcttcttaatgcaccgtcacattgatttattaatttgttctcttcctatctcctgaacttttgttaatacatgcatttttagttccttgcattaaactattattcactcttttttctcatgtattcaaatcatgcataattttgtccaaagaacaattttctggaataatagtgcttttcattcatataataaatgcgtgtgagtatttgtttattacaaaagcagtgcttggaaataggatctaagtttgttccttttatttgtggatgaagatctgtcatccataaataaaacttggaataaaagcactgcaattagaatcaaataattattgaagattcctggaaacctgcgggtgagtgtgcacatgtgtatctgttttgctcatgaaatgactttttaaaaaactgcagtatggcacagtggctcaaacctatattcccaccactctgggaggccgaggcaggaggatctcttgagatcaggagtttgagaccaacctgggcaacatagctagaccccatctctacaaaaaataaaaaattagctgggtatagtggcacataactgtactcctagccatttgggaagctgaagcaggaagattacttgagtccaagagtttgaggttacagtgagctatgatcacacaactgcactctagcctgggcaacagagtgagatcctgtctcaaaacaaaaaaaaaaaaaaaagaaaaaagaaaagaaaagaaattgatttcactgatatatgcctgataaaatgccagttataaaactgctaaatgcttgattctgggatgattgattttgcatatgtaactcttattcctttgtttcttacctttgtttttgtttgttttttctgatgctttaaatagataatttttaaagggattggtatatttctacagctgttttttctttaatcacaagtattttaaacagagtatattaattttcaaactgcagacaaaactacctattgcaagttattccaacctccttattcatctccagagatgtgtgttggtgtcatagtttcagaacacccccctggagtaatgtgtcaatgtcaaatgcacaactgtaagctcatcaactttaaaggtcttgttcttctgctaatcaaaccccacagagttcattacattttcaaaatcctccaagcccttattatgcatgacagcagaaatgaacatagtcaagttcatctagctaagaatattatcattcagtggagcccctcagagaaggagaaaaaagtaatcatttcataatcaattgtgagttttgcatgcttcacatttatatattcaagaacatatgaaataatgaagaaatatctcatcattgtgtttcttcaggctacactgagcacagtttgatcgtcaagaaataaagtggctttcctaatgtgatttgggcttataaaaatcagcatgctttcatcattaagggacagcaccttttatgtcttagctgtaaagtgtgcaggtgtcaagaacacacgtatgaagtcctgaaggcattattattgcacatgatttattcttttgtatcttttcttatttctattggcctcatttgcatctagggccatttgcaaaagttaaggaaggggagcaggataggatgtgtgaattcaactattcgaattctcctggattacaagattttgagggaaatgtgagtaggaagctatgaactcagtgggaaaaacagcacccgaagcaaaagttcccccaggcatccaatgccaggggagttatgactgctttctattagggataaaccaggcctcctgggggctcagtaaagtggtcattcccaccttagaatcagtcatattagtaaaagcaacctccaaggtaactgtcatgtgcccctgcctagacagtgtatcgctgggttttggatggtaggggctgaggacctgagggatgggagagaaaatgcagttggaaacagcttccctaaccactttccctcctcccctccctcagcctgttgagtccttgacctcatggtcccaacaacagacatccaacaccagattccggccaggcacagtggttcacgtctgtaatcccagcaatttgggaggccgaggcaggcagatcacctgacatcaggagttcgagaccagccttgccaacctggtgaaaccccatctctactaaaattataaaaattagccaggcgtgctggtgcacgcctgtagtcccagctactcgggaggctgaaaggcggaggttgcagtgagccgagatcatgccacggcactccagcctgggcaacagaacgagactccatctcaaaaaaaaaaaaaaaaaaaaaagccagattccctccaaagtcaagggtctcctgtcaaaactgggtctctaaacttttcttttatcctttgtcttatctgttatcttggctgataaaggaaagtagaatatgttctaatgaagatcacaggaaatattgaatacagtcaatctagattaattggctgcttaaaagcttccttgtagattagatcatttgccctcttacaggctcaatgagctgctttttccatgtgttcctttgaataatgtctgtgtcatggccttagtttgaaagaagggagaaaacaagaaaaagggcacattttgttactacaagttttcaggagtcacatcagtgatataaatgctgttgtcacattttcttttttaaaaagcatttcatagttttactgaatattgaacagagcaaattatatagaatccaggtcctggggctcagcgtttcatgtgtgacacacaaagagtggctagagaggatattaatgctttaaattattacatgaaaagatagtagggtttttttggtcatataaagctaatgggtaagtggactcttctggggcatgtgtggtttctaccattttttcaatctcaggatcacacaacattctaggttcatgggagtccacagcctttcatttaaaagtacatcataggccaagcatagaagcttgtgtctataatcccagcactttgggaggccaaggcaggaggattgcttgagctcaagagtttgagaccagcctgggcaacttagcaagacctcatctctactaaaaattaaaaaaaaaaaaaatagccaggcatagtggcacacacctgtattcccagctacttaggaggctgaggtgggagagttgcttgagccctggaggatgaggctgtggtgagctatgatcatgccattgcgctctggcctgggtgacagactgggactctgtctctataaaaaaataacaaaaagtttacaactatatcatgaggccacgactgccaaactcctggttctagatcagtggtcagaaaactttctctgaaaaggtgagtaatattttaggttttgttggccaaacagtctctgacaactgctaattctgtcattgtagtatgacagcagtcatagacaatttgtaaacaaatgaccattgctgtgtttcaatagaactttatttgtgaacactgaaatttgaatggcatatgattttcacatgttagaatatttttcgtcttttgatttttttcaaccatttaaaaatgtaaaagctgggcagagcatagtggctcatgcctaaatcccagctctctgggagcctgaggcgggtagatcgcttgaggccagaagtttgagaccagtctaggcaacatagaccctgtctatacaaaaaatttcaaaaattagatggatgtggtagctcacacctactactcgggaggccagggcaggaggaccattcataaataccctaagtctttatgcttgttcacggaatacagttatgaattctagacacagcaatatcaactcacaatatgccatcatgcaatcactctgggcttttgtttcttcatctcaaaaatgatgaggttcaacacttttacactgctggtgggaatgtaaattaatacaaccactatggaaaacagtatggagattccttaaagaactaaaagtagaactatcattcaatccaacgatcccactactgggtatctacccaaaggaaaagaaggcattatatgaaaaagacatgcacacacgtgtttatatcagcacgattcacaattgcaaagatatggaaccaacctaaatgtccatcggccaacaagtggataaagatagatatatatatatatatatatatatatgcacatacaccgtggaatactactcagccataaaaagaagtgaaatgatgtcttttgcagcaacttggatgaaggtagaggccattattgtaagtgaagtaactcaagaatggaaaaccaagtatcaaatgttctcacttataagtgagagctaagctatgatggacacaaaggcataagggtgatataatgggctttggggactcaacggggaaggttgagagggagtgagagaggaaagactacaaattgggtacactgcatactgcttggctgacgggtgcaccaaaatctcagaaaccacctctaaatagcttatcaatgtaaccaaaaaccacctttactccaaaaaccattgaaataattaaaaaggaaggggttcagttaaatgggctctgaggttatgtgatttcttcagtttattttctgtgaaaaaaaaatgtatttttacatattgactttccttgaggcagggcgtattattgtcatcaaatgagatggaaaatgttaacgccatatccgactgtgaaagcggcactttcagtccatccaccagagtcccagctcaggctccaccagcctccccatctgcctgggctcaccctttggggattcagcttctgcctccgtctccttttgctgctgcagtatctttgagatgagtgacagtagtttgagaaacaaaatgtcctggccagggggtgggttgaaagacacaattatgggaattattagtcttcttatttcgtataattgtagagtgtttttctctcaagagcaccacagaaagtttgaatgagtagggattatttatcctggagtggggaagactgtggggagggaaatgactcagtaacagcatggagtgtttaaaaagacgataaccaactgctgtctcttctcactaaagacagagattaaaaaattgagagcagagggctaaattaaatgtgcagagtaatatcttgccagtaagcatgattaaactcccaagtgagttcctaggggaggtctcggtggataggaggacacgaatgtcctgcctagagccagacatcttattttctggtttttgttgctggaactaaggtctgcctacaagatctgagggacagacccccaggcctggactcctggccctcagcattttgataaagcaaaggtgctccacacagacataaagaacagaccaaaaaacgcagcaattttcatcagaacaaaatctgcagcttcagggaagttagctgagcttggggtgtgtcctggaagtttatggaagagtttgatctgaattgggtgaagccgggcatggggatagtgaagactttttaagccagcctcaccttctccagagcatcaactcatggcaattcttccctttctgactatctcccccacccactgtgcctgccacaggcagatcagatttgctattttccagagaggactggctccacctcactgtatgtcaattgagaaacaggcacagagcaagcagggtgatggttttccaggcctccctgctaaagcatagtttccagcacatactaagtgcctaccctgtgcatggtgattgtatacataaatgaatgaagcaggggtgggaaagaggagaggggcagtgaataatgaacaacctgtaactggaactctagattttgatgtgcagtctctcaattttcaaacagtggcaaataatttcaatattttttccatctttataaaggtaaaaattaacaaaaattgtatatatttaaagtatataactcaattttttctttttttcgagacagagcctcactctgtcacccaggctagagtgtgatggcataatcttggctcactgcaacctccgcctctggggttcaagtgatgcttctgcctcagcctcctgagtagctgggattacaagtgcgcgccaccacacccagctaatttttgtatttttagtagagacagggtttcgctatgttggcaaggctggtcttgaactcctggcctcaggtgatacacccacctcagcctcccaaagtgctgggattacaagcatgagccaccacccccagccaatgttttgataacatatacattgtaaaataatcacagtcaagctaattaatatctgtcaccttttatagttatttttttgctgtgtgtgtgtgtgtgtgtgtgttatgaacaattaagatctaccctttcagcaaatttcaagtataataaagcatggttaactatattcacattactgtgtattaagtctccagaactcattcatttttcataactgaaactttgtaccccttgaccaacatcttctcattttctcttctactcctagcccttctactctctgtttctatagacttgacttttttcaattcctcatgtaaatgggatcatgcaatgtttttctttctgtgtccggctaatttcacttagcataatgtcctccatgttcatccatgtggtcacaaatggcaggatttatctctctttatgatcaaatagtgtttaattatacacacacacacacacacacacacacacacacatatatacaccacattttattcattagtcaacagacaatttagttcttttctgtgtcttggctattatgaataatgctgcaccaaacacaggagtgcaaatatctctttgaggtattgattttatttctttggcaatatacccagtagtggggtgctgaatcataaggtagttctgtttttaatttttcattgaactcccatactgttttccttaatggctgtaccaatttacattccaatcaacagtgtaccagggttctcttttctctgcatcctcaccaacacttattatctgttgtttttttaataatagctattctaagtggtgtgaggtcatagctcattgtggttttgatttgcatttccctgataattagtgatgtcaaccaccatttcctatatctgctggtcatttgtaaggccagacttacacaccagccttcctgaagtcaacttttgaaaaatgtctattcaggttctttgcccattttttaaattgggttgtttgatttcttactattgagttgtatgaattcattatattttttggatattaacctcttattacatgtatcgttcacaaatattttttctgaatcctaagttgctggttcatttcgttgattgttttctttactatgaagaagctttttagtttgatgtagtctcatttaataattttcgcttttgtggcctgagcttttgacatcatatgcaaaaaatcattgcccagatcaatgttatgagaacttttgccttgtgttttcttctatagtttcatggtttggggtcttacatttaagcctgtaatccattttgagttaacttttgtatacagtgttagataaaatctgatttcatttttctgcatgtggatatcctggtttcccagcaccatttactgaggagactattctttgcccattgtgcattcttggcacccttgccgaagttcgattgactagacacacagatttttttccgggccttctattctgtcccattgttctaaattgtctgggtttttttttttgttgtttgtttttgtttttttggccaataccagattgttttgattacatagctttgtaatatatttttaagccaggtagtctgatagctctagctttgttgtttttgctcaaaattgttttgctaattcaaatttattttaaaatactatggtagtcaagaagacatacgtttactatttgctgccagcgtgtggccttatctttagaatcatgtagaattagatataaatactgcctatttactggttgctgaccttggcaagttcttgatctctctgaactctagcttctttctcacaaacagagaaattgcttcacaacatagctgtgagaactaaaataatgtatgtaaagaaattaatatagtgccttgcatgtttgataaatgttattataatatctgatattataataatgaatagctgatataatatatcatgttgatccacataaaattgctggtatacgcttggttttaaactataaaaatggcaatttcatatggttcaacataatattttgtataaaatcctccccatctacattattgtgacattattgccactattaaagcctatatacccatttcctaaacacacacttatgattcccccttccatgctctatttattcccatagtatttatcactttgaacatattcaacaagttatttattatgtttatggtttgtcatctgtcttcccacatttgctggtgtatataagtttcataaaaaatagggattttctcagttttattcattgtttttcctcccccactgtaccccagtacctagaataatgtctggcacttagtagtctctgtgtaaattatgtgttgagtgaatagacttacacactgatctttctgaagcttaattgagcctaccatggtcatgttccttcaagccttaaaggtttaagagaactattgattagaactgtactaaataaaatataaatgaaggttgttataatgatgggttctttagggctctgattcttgtgtaagaacagtagaaagttatctgaagtgtgagaacagtaaaaagttgcctaaagtgttgcatatctgaaaagctgaattgtattagttgaaaaaagctaagtaaaaaatatttatctgggccgggtacagtggctcatgcctgtaatcccagcactttgggagactgaggtgggcagatcatttgagctcagaagtttgagaccagcctggccaaccaacatggtgaaaccccgtccttactaaaaatacaaaaattagccagacatggtggtgggccctgtagtcccagcttctcaggaggctaaggcaagagaattgcctgaaccagggaagcacagattgcagtgagccgagatcctgccactgcactccagcctgggtgacagagtgagactctgtctcaaaaaaaaaaaaaaaaaatgtatattgtgtgtgtgtgtgtatgtatgtatgtgtgtgtgtgtgtatctgtgcgtgcatgtgtgtgtatatatatgtatatatacacacgtgtgtgtatgtgtgtatatatgtatgtgtgtgtatatgtgtgcgtgtgtatatgtgtgcgtgcatgtgtgtgtgtatatgtatatatactttatatatacatacatacatatatagtatatatatacacacacatagattatatatagtgtgtatatatatatacacacacagatacatatatatatatatatatatatcggaagtattcaatgagttgtttggtttttttctcccacccggttatacacatgagtttggcatagtgctgtatttttaaaaagatgatcatcagttgcatttgccctttgacaaaaggaaattggtttagtaaagtaactctcctcggcagtaaagtatgccctcagagtgtgcatgtgtgtctgtgtgagtgtgtatataactgtaggtatacatgtctacgcagacatatattcattagaaaagctaatacagagaaggaaattaaaagtttaaaaagcccaataataaaagtcaagcctgactggattccagaaagacagaggagaaaatggtggtattgtctttagaaggaatgtcagagtagcgtgagtacagaggaaagtgctgataagcagaatgacaaaagctggtctcatgagtaattccaagcagccagaaagccagggtacaatccccagctgattgccctgctattctcggtattccacatatcatgactaaatccacagagccaatatggtaagtcgtggggaattctgggaggtactatgctgtttataagggcccaggcggattctgtactcttgtctgccccgcccaccctccatttaaatactctagttagttgcttctgaccagctcctacctccttcctaggaagtgggggaaacctttacatttccgaaggcagatatttttagatgtgatgctctgtccaaagtgttaactaattgagttatcaggtttcttacttggccacagagaatggcagtggaagagggagagagcttcccagaacaagtaagcatttacagctcctaaatgaaatgtactttccttatagaagttctgttttgccctgaatagttgtgccttttaaaaaatgtttgttgctgggtaggaagcaaattaacctgtttgcactacggatcacttgagttaaatatgtgtaggacaatggactgtcctttctgttttgttccgatccggactctagatatgttttgcctgtgatgtaatttggagtgagttcagctaaggcctgccttaagaggatgcataacaaaatacaaaaagacagggggcgattaggagtgcaggaaaagcctggtaaatccaagagcgtaaaaaggtttatatggttgcacttttttcaagagaaatccaacagctttaaaattcagctttttctgatgtattaattacaaggggcaatatgaaattttacagttggggagaaaacatagaattaaaatttatttttgaaactcatataaatggtagatgaaggatgtaattagaagttggaaaatgtaattttatttccatcttaatagaattgcacatagatataaataagtcatcttgtttaataattttaaagaattggcatagtaagccatctcccccttaagggatactgtgtagataaagggagtaaatatttgctttatgtttgtgaaattttgaagtatttgattctgagggattcacctaatgctatgtagatcatggtatggttgaaaatggtcatgtgatctcttgtttctacctatatcctttcatctaactgtgtgatgttacacagttaacatcagtgtatctaactctgagaacaccttagattcctgaatattgtgtttaaacatttagtgaaatagtcataatgactagaacgagacatcataaaaatgaggacattgttgcttgttctaatatcaggtggacaaacatgctaatggttttgagaaaacagctgtcatttcacagtgttacaaaaagcaatttggaaaacttacaatttttatctttattttaaatggattcagttttcatctttgtactcttaaagacagaatattttttgcgaaaatattaacctttcgtgacctttatggaatgtggcaatattgcatatgtacaattatgaaattttaatcaagtgagattttataaacattctgtgtgtctcagagaaagagtttttaagggtaatctttgagattcgtaataaagctataagattgtgcatgaatgccagacattaatgtcaactgtaatttactagtaatataagcatattggcaagtgagtcctaaaaatcgtatcactctaaaaataatcaacttacccatccaaaactttcaaactgtactgttaaattttgatgtgtattctgttccattagttgtggatttgaaaactttgcatatgcatgatcataaattacatagttagacagctttgagaaatactcattgctgggaagggtttgagcaataaggcttgctgtaacgagtcttaaagaatgtacctgaagagttctggccttttattaattaataacttaaaaaatctgagatccaaaaggaaagcctaaataaaagtagaccatcttgtttctgcctcctgtcagaatatatcaactaaatggtgaaagcatttgatctcagcccatatgtgcagtgttttctgttttggtgggcatgctgtttgaaaaaacgtgtaataaaatgacagactgaatttgaaattatcatgccgtaagcagtaactctggaagggtactgacccgatacgaatcatatagaagttccatcacaacagagtagcatatactattgctgtactgggttttgctggaaaatgtagaattattcctctcctgccttcatctctgacttgaatggaagactgaacactttatctgcatgagctgaactatggacaaaatccttgcaaagagggtatagtagataattgcattttcatgaatgatcattaatacttcctgctgcttctgttcggcttgtggtttttacagtattgtttagagattttctgtatggaagaactagaactagttttgacataaatgattgatgaaaagttaactttaaagtttaactcttcaataatgctcatgaaaaaaacctagactctaatattgaacaaagcccaaatgtaatccaattttagtgtgcattttagaggtagctaataataagatcattcaacagcaactgatgtgcattaattttaaatcctgtgaagttaccctataatgccaaatagaaaatctttgaatttggatgtttcctatgttatatatatatttttcaatgattgatccagtaataaatacatatttaactgttggaggaatccctcattttattgttgattttcacttaagaaaattgggggcaagtaggatattttatatagtcaaactcaaaaaaagaaatcacaaaacttgtcttttgctgctgagactattatagtgtttgttttgaaatggaaacttttagttatgtagtaaatataatatttacttaccaactaaatttgttctgtgtgacaatataaagatgctacctcaggtcggttataaatttggatgataatcaaatttaagttatctgtaagaccaaaaagaatttacaatataatgagatatcttttcgaagtcattctctttataatgttaagacatttttagtcgcaaagtaaatacgtttgccaattctatcctaatgcaaatgtttattttttaaatgttttatcatgatcctcagaatatattgcaaaacctagtaataaaaattaaactgtgtcttctaattggactgttgataaatatataattagataatataacataaatttcagtgtatttcagggaaatattcatagttactaataatcactcgttaagcataagactctgtaaggaatttaattcttttattttaggagtctctttttacttttgtaagtaagatttttgtaagaatatctttgtagatattcatgatcgcaaacatttccagagaataatgttgggtagtgaatgccatttttttctttagtcaagtgacggtgagtgatggcaaccagtttgaaaagtagaagccaataatgtaaaaatcgcttttcagaatctggatatgtttcagctttatttagtcttgaattattgattattttgtattctaactcaacatcattttgatatattgtaaatttacatacttctgtaattcagtgattattgtcatattttgaaaacacttgtatctgtaagatcagatacattttgaacactgcatacttttttatttatttatttatttctttgagacaaggtctcactccgttgcccaggctggagtgcggtagcacaatcacagctcactgcagccttgaactcccaggttcaagcgatcctcccacctcagcctcctgagtaactgggactacaggtgtagaccaccacacccagctaatttttaaaatattttttgtagagacagggccccactatgttcagcccaagctgatctcagactcttaggctctcatctcagcctcccaaagtgctgggatttacaggcatgacccactgcacctagccctactgtagacttttaaacacagactgtgacttgctcattatttgatccccaaaacctggaatataatatgtattcaataaatatttgttaagattttaagcaaaacttcatctttgaagggtacagcctctcataatcatggccttctagttaccagttagtcctaacaagagactattttaaaatatttaaatatttttaaaaatgtttgaaaggaacatgctctaattaactttccattttagtgaccagaatcaggctgtcattttccatgtagaagtttcccagaacagaggatttgtatctgtagttgtgtttatgcaacaatgacaagttgtccttaaggaattctcatgctatctttttggcagcatcacttgcaatggaatttgttgcttatttgtcacatgtcatttctaaggaccttaagtggacatcctatggacagtgtcatccactggggaagtgtattagtgttcaagtatttcgactgtgtggacatagccacttggaaagactctaggagaactaaagcaaggtagcagaaaagcaatgaataggtactgattagagtgatcctgatctgtactttgcaaaaatagtagcactatatttatttagactttgcttcctgctcagtcttgccttttgcttaaatgttctcttcggaggtgttaggcctttgtatcatgaggtcaatcaagaacccctgggtgtccctgagacccttctagagtaccctgaagactggtatccttgacctacttcaaccaaaacaatacgtacattaaagagatttgcagactcgtaaaacaataccattcatctcatcttttttatttgttttggaaaataccgttatgtttcataagataaatattttaagttagcatgtaacaagattgccattgttaatttaaaataaattaatgattaatttttaaattgtcagctttattttctaatgtggtaaataacaatagttataatcctcataatcaaaagctctttggggttcctcaataatagttaggagtataaaggtaccttgagtaataagtttgagaaccgctgctgtagacagatcacaatgtgagtgttctctgctttgtttgcttcccttacttcctgaaagcactgggcaaatgaggtcaagttcgtgggttcagtccctgtatgtttgtttgactctcatggttataattgtagccaaacaaactagaatattaacttaaaataattttaaagtgataattaataaaggataatgttaattggggaccaactgtgtgccatgccatttctaactgctcggcatgtattatctcctttaatatcaacagccctctgagttaaattttactgctaatttcattttacagatgaggaaatttaactacagtatgtttaagtatcttggccaaagtcacatcctttgtgaattgcagagtcaggttgtgaacttaggcatcctgggtccagagtctgaactctgaaatcactaaactacattgacttgccaatagaaagtgacatattagtctagatctatctgcaaatacttagaaaacacatatcacatagctccttaaataggagtctttgctcctagtaaccctcgtagtacattttagctgttagacggtaacataacggaaagtcaccttccatgttataactacttataatgacagagtccagcggttaccttaaatttggggtaaagtccactcttccttgtttcattttttgttatagaaaataacgtccttccttattttctttactacatgtttccttcgcacttctagaaagatttcttgtgtgtctatgtatgtgctctttctatattttgcccttttgttgtatttaatgtaaagctgtttaagcctcccaattccaaatctagtcaaggaaaaatataaatgtcacttacagattatttacaatcccaaatcagtctatctatctatctgtctatctgacttctctagtgagctaaccttgtttttaaaaatattttttatacattcaaataagaacttctttagctatattttcagcaaggcctcctaaaatccctttgttgattacagacttaagtaaaaatgaaacattttaagtgaaaagaacaatagcattttggtatatttgttttttaaaaaatcagcatgaaaccatcctccctgcaagccccctacctcccaaaaaaggcacatagtttcatttaccaacaattctagcaaggctccagctgcatcagctggtggccaacattttaggatgataaattcaagaactcactagctaatgcctcctctccctctggtgccatggcctcacccttcaactcctctgggcttttaaacctcaggcctctaattatctgaccaggaagctgaagtccactgtattgtaatttcctatctgattcgcaccatatagagtatatttatgcattgcaagaaaatagttatgtttgcagtattaagtctatgcacactaaaaatcaagctgtttatttcctggtctaaaaaaaaaactgttgggaaaatgttcatctattcaaatactttctcttctctctgctacctagaccagttttagcttatcactgttttcagttgctatatataaaatgtgaatagttgcttggattaaatattttaggactcatgccaatgcctcctacataataaggatccttaagcatgaaggcctgaaatccttgttctgattcataacataccaaataaatggaaaaatcgcaaacagttgtcatgttttatataatctaccacgtataatgccagaagttactgctatgtatttcctgagcggaatatagcaatatctcagtattatgaggtacctctctaagggactcagcagtttgtgttgtggtggttgttgtgtagccaagctatgcaaaaaattggaatttgttttataaacaaggatctccgcagactgccagattttaactgcataatactatctcgtttcattttatgtttaatgggacaaagttgtcggtcatttttagccttctttgtatgtgaggagtgggtccaattcattcttgttctgtatcattaggtggtaggaagaacattaaagccagggaacccaaattctattttcagcactttctctagctagttaagcaaatcacacctctcttcgcttcagttttctatctatttgatagagatgatacggtgaccactgcttaccccaaaatataagatgtgtataacagataggattgtatgtatttttttgttcaatacaaagcaagttgtttattaagactaagagttaatcgttactctatctttgcttaccagtttactagttcagcgctatgaaccatgagattatttaatgttaaggtgagccgagggtatgtatgtaaatgactaatgctatcacaagatgataaatgaaggcgtgatgagatgaatgccagcggatccctccaggagggggatgtttaaagcagccactctctctggtaaacaaggaagaatagattatgcatcaaggatttcctaggcagcttggctcgcaggaaagcaaaagagaatttcttaacgacatgttcatgtgggaaataattgagacagatgagctagatgaagcaaagcaaaaagagaggagggggtgactgatagaaagtttaggaccctgggcggggcttggtggctcatgcctgtaatcccagcactttgggaggccaaggcaggtggatcacctgaggtcaggagttttgagaccagcctggccaacgtggtgaaaccctgtctctattaaaagtacaaaaattagtcgggcgtggttgtgggtgcctgtaattccagctactcaggaggctgaggcagaagaatcgcttgaacccgggaggtggaggttgcagtgagctgagattgcacaactgcattctggcctggcaacagagtgagactccgtcaaaaaaaaaaaaaaagaaagaaagtctaggaccccagtggctttatgttttttttgttcagcacatgccttctcccaaacaaatgaaaaatactttaggtatttttgggaaggctggcatctagaacacttacagattagaaaccattaactgctattttattaaacctttgattactatcttattttaactcaatggggaaaataattccctgaaataaacatgattacacttttccaaaggactaaatcttccttatattaacattccattagcgtgtattaagaaaaaaaaaattctccagggctgctgtatgttttgaattgcttagccctgagaatgcaatggatagacttttttttttttccagagcaagatattactatttctctcatgcttctttgtctcaagaggtaatcagaaacaggttcaaacacagaggaggtttcaaaatagtctggtaatgaatacacctgcaaaacatacttttcagaaatggtttctccatctgcggttattttccaggcttacttatttatttgaatctttagatttcagaataaccaaatataaacattttattaattttaaggttgaactgtctgttcctcttgtatagcttaacccaagtaaaggcaaactcatgctgtcctaaaatatcctaatgaaataaagttgaataattcgttttcattttaaatttgaaaaacatcttgagctgagcacagtggctcacacttgtaatcccaacacttgggaggccaagatgggtggattacttgatcacaaaaagtcaagaacagcctgggttacaaggcaaaactccgtctctactgaaaattacaaaaattagtcaggcgtggcggtctgtacctgtagacctggctactagggaggtcaaggtgggaggattgcttgagcctgggaggtggaggttgcagtgagctccagcctgggtgatagagacagactgtctgggggtaaaaaaagaaaaagaaagaaagaaatgtatcttggataaagggctatacttcttttcacatcttgggttaggtactttggccacaatagaacttttattaacactgctccgtctttgcttgtttggaaaattaaacacttaccattagcagtggaagcatttgtgcattgcataatatcatggagcttttagggcagggaggatcttgcttgtcatctagtcaaatcatcctaccagttccttacatcatttatggctttctgcctaatacagcgtagtgactttgtgtctgcagcacagtaagataccttgcaacttccatagtgtaaggaaaatgaaagttttgagtcaaaatagtttgaagtcaaaatagttggccatagcctggtgcaaatcaagacaaaatgttactatattgacctcatattattaagacacaaattctcctctcctgatacctatgattttatatcctctaagagacaagtgaaactggctttttaagatcttactttatattatcagaaaatttgagacaaacacagatcctattttgcagctgaacataatcaagtctatgttgaggaatattagaaatacccacccacccaccagcacctgacatgtgtttttcctcccatgggaaaattttttttcttctctatatttgtttttgttgctaatcagtctccaagagaatttttaggggtctgaattctgagtgagaaaaaatacccccacggcctgaattctagatcctccttttgatgtaaaccagatcatagtggacagactggatgagggtatgttttatcagcatatggcaaggtaaatctcttgaaaacactgcctttacaaaaacaaaagcctgccagcactgtattttttttaactggttcccactcccctctatttaaagataaagttgggaatgttgttttgcctttcagcatgagagtggccactgtgcacagacaccccagcaggtttgaaatgtgcaccagcaggggcctttctggcacaggtcccagtgtaaagatgctaaccatgcctaacatgtgttaggggtcagtgacctcattttcagggatgaactgagggtacttccaagcaaaatccatgcaaaggcagccttgtagctatcagagggaatctgaggagcaagccccttttacttcagttagttttgacagtgattattactaatatagaccacctttagaaatttagaagcattttttttaattggttaagtaaccccctctctactcctcttctggctgatttatggatgagaaatgctggtttatttctaataactggataacagttaagtaaaaaaaaagaataaaagcttaataatctgaggtctttcctaactaaaagggttcaagttttttcaagctcttaccatgaaaaaggcacataaaattcccctttatttaagatctccacacccaaaacacatacttgaaaataatgcatttgctgacatagaccaatctcttaaaaagagaaatatcaatctcttaaagatccaaggtttttactgacagacggcagattatagtatgaatgtcaccgttgttttcgtttgtgtaattggttgcattcttctgaaatcggtgggaaattagatcactgtgcaagatatctataaaaatatcagtgcacaatatcttactctaaaatatctggcaactgagtggtcacaatcgggatggccgtgtcccagtgattcagctctagtctcataggaaaaaaaaatccaccctttggctcccctctcatgtgcttgggcagagccacagccctgtgtcccacacgaaagccttaaacacagaagaatgggcctttcaagtcattagactaattttttgttggacgttatcttattctaaataaacacattttagattttgaaaagttcaagtcccgtttctgatggagaataattttcaaactcatgttactttgttcaccaaaaattacttctcagtgctaccaagcaaagcctctcatctttagtttctggctatgaaaagcagggggcataaggctgggcactgtggcttacatcagcactttgggaggctgagacaggcagatcacttgagcctaggagtttgagaccagcctgggcaacatgctgaaacccatgtctacaaaaaatacaaaaattagccaggtgtggtggtgccaactacttggaaggctgaggtgggaggatcacctgagcctggggagatcgaggctacagcgagccatgataatgccactgcactccagcctgggtgcgagagtgagaccttgtctcaaaaaaagaaagaaggagggagggagagagaaagagaaagggggaggggagaagaagaaagagggtggcataagccagaagctgtggattgcttgagcccaggagcttgaatacagcctgggcaacagagcaagaccccatctctttaaaaaaaaaaaaaaaaaaggcagggcatagatgaaaaagggtcgggggaggtaattatgaagtgaagaatttaaaatctggccttgagatcttaatcttgtatgttaaactagaagtctgtcagtataccttcagaatgcctcttatatcactttcttgtccattccacagctagcccccctaggtcttcttatcacattgtcacatacaaccatattttcacagtaacctacttcagtggctttctcctttggtgaaggagaacttaatgtgccaccaaaggagatcagtttgagcagcattgatcaaaacatcccatctcagaccaatcgaatctgaatcccttggctgtgacgtgtgtgtgtgtgtgtgtgtgtgtgtgtgtgtgtgtgttattcctacctgggagatccttgaggcacggtggggttgacaacaaggacccacagatcttatctccattttctcccacactcaaatctgacatcagttaattgggtcaatatatagctttcaatgatgtcttttcactcctcaaaactctttatttcctcctggtatctttatggcgaagttaaatcagatttatctggtgttccaaacctctcctgaacctgtccttttcgcctactcccccgtcccaggggaatcccctttgcatagagactgtctattcacaattcctcaaacctttctggctctttatttctacctaccttttcttccttttattctccactgaccaaatcccctgttgaaatcctgcctcctcctactggctgttttcccagctgtaacaggatgcagaaatggcccttcccgatgagcttctctgactttatgaacttctgtaggttcatctaccatgaattcaggctccagtatgcacagctagattaggacaaagacctaccctaaaaaagattatcatccatctctgtaggatatgtgatcctaagcagaacagaccaagtgctgttggagtccagagcgagaagggatcatgcctagtgtttatcagggaaagtagcaaatatgaagggatctttgagctggacccagaatttagtaggtgcgtctgttggtcggggagggaaagtgaggagggttggtgagcattactagccgggcattactgttattactaatgtcctgggtgaagtcacagtgccaggaaattatagggggcagttgaggaataaaaagatatctaggttgctttcaagattagtgttgattcatgttttgtttcaggctggaagtatgtgtttgggacaggttttaaagggcctgtgagcctatgccatagaagtggattggatattatggtttaaaagcaacaacgtttgaacaaatgagatatggtataaaacagcaatctattaaacagataagagtagacctattgggggcgaaactgaagataggcacacacaactctgctcagtgagccctacccttgatctcagtggttctaaacttttgggcttcacagaactcaaatggaaaacccctggtgttgagggaagagcctgggcttgctatcaagcagacttgggtttcattccttgctgcttacttattagttatgtgaccttgggcaagccacttaatttttaagaaagttaggtttctgcctctgtaatgagattcctgttttgattgaatacttaagaaataaatgataatgcatgtatagtaagacatagtgcataataataatacatgtaaaatgcttagtgaggtcccaggtatatagtaggcactcatttaattgcagctattttccttatcttgactttcttagaaccctcagtggacctttatacactgttcagtgcttccagcagagtaactagtgccaactacagcctcctggagattttttaaatgatctggacattatacagtaagggcctgaactggccagggagaaggatgaatgaggaaaaagaaagtgaccatattttcagctgtagggaaagctaagaagttaggaaaacaataaaaataagtcttctgaagtacatctttgaactagcactttaaaagtaagaggcctgtagagatttaaaaatatatatatgtgaaagcaaaaactgttttacttggttgtatgagtacagagtacaggagacaaagcctaggacatgcccaaggtggatagtctaataagagaccccacattaacctgggctccaaatggtgagcccccagtataagaatggacaggaaataaacccaccatacagaagagacaggaaaaatattcctctccccatttgtcaccagatggaagggaaaaaagtctgtcctgagaatttgtaaccacaaggaatccctcatatctataccagtttgagatctaaatttatccgtgtagtcttaacaaaaacaaaaacaaaaaacctcaagccaagcatttatttttaaagtaatcttgggttgatagtgcctctaggcaactggcagaaccaatctcaaatttctctttggaatatgacaacattaatccaggcattaaagacttaccaaagattagtttctaaggaatatgaggtcacaagcaacagtcacaagccagggaaatgtaaattggtgcaatcactttgaaatgcaattaactagaaattaactagtaaagctgaataagcacatactgagtgacccagcatttatgatcctaagatttaaaaaactcttgcccttatgcaccccaagtagtgccagaatattaatgacagtatctttcatagagggtccaaactggaaacaagacaaacatccatcaactccacagtggataaatacattatgtcataatcacataatggactattatatgttagcaattataaattacccacatgttacatgtcaacatggatgactctaagaaacacaacattagacaaaaaaagacagaatgatacataatatataattttacttatatagagtgctaagactcttaagtactaagactaagtcaattacataatatttagcctacagaggggtacataaatgttaaaactataaagaaaggcatgagagtgattaactaaaacagaggatgccttaggagaaccactcaagaagggactcgttgggagtcttcaaatccacttgtaacttgcattcttgagctgaaaagagggtatgtgggtgtttatgttatgatttttctttgaactgttcatatatgttttatgtattttttaaatgtatgatatgcatcagataaatactttttttaaaaaatgagaaagaactaaaaaagtccctaagacagaatattgaatcagatgtgtacacataactttctggaagggggtttgagggagagagtgaagaaaaaaaggtaatcagagagttacaccaagattgcatgcctgggtggctaggataatcttcggatatttaaataaaaacaaggaaatctattgttcatatttctgttgttagcgtctggttgcaggcagatgcattatatatctcagcacacttctgtttttgctgttgttgagtgagggaattgtgggacatggaaatgtcttggggtgaggatgagcactacgtggatatggagtgctgagcttagagagaatagtgggagccatagaagcaatgaggtcacctagaaagagcatgcaggaaggaaagaaatgtgagttctgaacattttcagtgatgggttgaggcagtgaggcacagaaggaagtgaacaaagagatgacagaagaaaagctcgagggaagattttcaagaaagagaaggtgattggtactgtcaaacattacaagaggagaaacttaaaagtcatggaacttgatgactggaaggtcattggtgattttatacagagagacagtattgattagtgagagaaactgttttgccagaagtgcaaatatgaattagtattaaggatataagtcagtgtgaacctacaccagtctttcaaaatgtttgatatttaaaggagaactcataaacatctatttaattgagtgcctagctgtgcactcacattgttaattacctgagttatctaattttatcctaacagtaggttattttattctcatttgacagctgagaaaactgaggtacatagatatttttaaaaacttaccaaacactaagaggtagaatagctgaaatgcagattcgggctgtgtgattccagtgctttggttcttacctagtccactgcactgggaaatagaggcgatcatcacttgcaagggggtgctgggtagaaaagtggaaggaaacttttttgtatttttggttttgttttctatgttggtaggcagaagacagggcaccagtagaaaaaaggaatttgaagtttacaggaaggagcatctgacccttcacatggctcacaggtagctgggaagatgaggtaatggggaaagattagagatttttttggcacatcaagtagaaagaggctcctgagattgcccccgccccccagaaaagtttagaagcaaaggagcagagctatgttatgtactcactgggtctccagtctgcattttttcaggtgatccactgttagcctgatcttgagtctcataataaacttaatgaggaaattctgatccatggaagatatacctgaaggtgcctaaaatagttaattcaatggatggagagacaaatggatgaactgatggaaaatgaacgaatgaatgaatgagctaagaattctcatttggaatagaccaaacatgtattaagccctttcttagaatggtgattaacagcctagactccagagccagactgggtttgcatccctgtcattcacaagctctgtgtccctgggaaagtcactcatcctgcagctcaattttcttatctatgaaatggagctagtaatagtacctacttgtgttagtttgctagggctgacatagtaaaccaccacaaactgggtggcttaaaataatcaaaatgtattatctcacagttctggagccagaagtccaaaatcaaggtatcagtagaatcacacttcctctaaagactctagggcagaattcttccttgcctcttcccacttctggtggtccctgccttgaggtagcgtaagtcaagtctctgcctctttcttcacttggccatcatctctcttatgtgtccatgtgacttctcttcttataaggtcaccagtcattggattttgggcccattctaatcccgtgtgacctcatcttaactaattatatctgcaaagattgtatttccaaatatagtcatgttctgaggttcctaatgaacatcagttttggggagacaccattcaacccactacattacttaatggaactgttataaggattacataaattaatataaggacttataaaattaatacatattaagtgatgaataatataattaagttaatattaagtgcttataatcatgtctagcttatagtcaaaggtatgaagtattactgaggttggcactctgaaaatgcttattctttccaataactgctttctgctgaataatatcaatattccactgccggtaaagatgctgagttactagattaattcataataatgcttgactctatccgtgaagctatttccttgaaaaacatacatgattcatatttctagtaaaatgactaagtagacaggacattaaatggtaataaaataaactttcatttccaaattcctcagattttggtcacccagaggaaaaaaagtgctgaacaacctgttcatattcatttttgtgcaactaattccttaggcagtggctttgtctgtgtgactttccatgtggctgcacccagcttgtctttgaacctaatttcctccatagtaatttgttgacatttttggatgcatcttagatatagcatcaaaagaggcattattttgatacaaggttatcaaaaggttaaaaaaaccagctatagactgtgttgagtaactcctagttattccatgaaatgacggcagtgagatacaacccactgatactgagtctaggacaaaatagtgtgttttttacacgaaggatataaacagcaatatattctctatgggcaaaattggtgggaaaatggttaagaatccaatatttgccctgccacttatgcaaggttattttagaggagagagagtaagaagctgtgaaatgaaagcaaataagtcattatttgtgccacatttattttgttccaccaatgtgtatccagatattgacacaatgactaacacatagtagacattcaacaaatatttgaggaagtggtggctgttttgtttgccggtggctaagagtaaaaggaggaacttattggttctttttctgtgggctttgtaatgtctcttcctaagatgtaagttttcttcagggcagtcttcattcgcctcttcttgctttttctctacattttccccctttttatttgaagtgggtggttgttatggttttggtgtggtaagcatgttgatacgtaacagggccaaggaaagtgaagaaaattaatttctgtttctgcgtgtacttcctaaaattctgaggtggtcaattagctatctcagagaattgtttgatatcagggtcattgaatgaaatagatataatgaaggcgtccaccagagaattttgtatcagtagagcaggagttcttaaatgcaagttcatgagcaagcttagcactcctgaaccacatgaaattatgtgcaaattgtgtatgcagatgtagatttggtgtgtgtgtgtgtgtgcaattgttgaaggaagataatttattcatcacctttattagtctcaaaagaatccagatcccaaataggtagagaaccactgaattcgaagatttgttttataccgattttgttttgttttagaggtttggatgggaaaattctgaggaaacttgagagcaaaatggacagtgtatggaattattaaatctttccagatatgcgatcaattcaaaggcttttttcttgaattataatacctctattttaacttctttagccgctgttgttatgtactccatgttggagtttgggatgcttaactcacagttgttatctctggcagttgaaatatccaggcagactgatgtcatttgttcccagaacggcatcagagcccttctgggcaaattcactgataagtcattgaacaggcacaaagaagatgatattttacggtgcaatgagccatccttgcgtggctaatttagttctaactgaacttataaacaaaaaactaacctctaaatagtgaacctctttaaaaactgcattctgtttttctttaaatccctggaaacttttatttgtcctttgtttaagttgaacttttatcttttgtcatctgcttaaccctctgctctgattaaatgattttcatgcttatctcaaattccaattttatgttattttaagtaatagctgtgtgtgctctcagacacctgactcggtgacttagtttataatctctggtattcacctttgtatctatcagattctcaacttaaactgctgctgctgctaataaagcctcctatattattccaggcaatactttaattaatagttatttccacccaatttacttatttgttgatgcattcattcacaaaaaacttacaggcacttgctatatgccaagaatgcttccagttgcgggggaaacagtaagatgaatattacatggagtcacattgccttgtgctgagacaaggcttgtggcaacccaaacaggccaaagagttaagcctcctcaagtgtacaatctttatgtaagttgggttactgtttatttaaagcagtggttctcaactaggaagactttgccccctcccccaagggacatttggcaattctggagacacttttagttatcacaaatgggggataccactggcacctggtcaatagaaaatgcttgtaaacattggacaatgagcaggacagtcccctacagcaaagaattattcagatcaaaatgccaatactgctgaggctgagaagccccaatttagaggcacagtagtgattgagagaggctcattactgtaaaagagaagggggcaggtgactccagaggcagtggcctctcctctgaggttctgagcaagttgactcttagtgaattgacccacactggaaccaaagaccattctgaggggtagaattttcttcttctcaattacatttccatgaaagaattagcattcctctcttaaagactggcatcctggctgctttccagttgcctactccttaatctgcctcctctgcttattctgaaggggctcataatttagggtggaagaaggacaggtataccaaaatctgtgatgttgtgtagtaaatacgaagagagttcaatgaaattaatgctgggagcactgagaaactaaactccacctggggggtctgggcaggcttcacagatgaggcggcatgaacaaagcctttgaaggcggtgtttaccatattgctgaaagaagacacttttctcttttaagccataccctgcatgattgcatttataactggtgacaagatgtttttggctgctctttcaggaaaacctgcttttgtattgtactgtattaagcaagacttctttacaaattttgcaggcccagctttgcagtgtctttcctctcaccatctttctatcagagatttcaatagtaggtggtttcaactatgaaattatagatgttagagtttagcagtagttcaatgttgcaagctttcaatgagtgaattacatgtcttgttgttctaaaattgtatatgtatttctttctgctgctgctcctacatatggctatgtactgtaggaaaatccagtagaacatcattgcctgcaaatatctgttagactattaagtacaacatataatgggttaagttgggatcatgcctataatcccaacactttgggaggccaaggtgggaggattgcttgaggccaggagttcaagaccagcctgggaacatagtgagaccccgtctctaaaaaataaaaaagtagcctggcatggcggcgcatgtccatagtctcagctactgaggaggctgaggctgaggatcacttgagcccgggagttcgaggctgcagtgagctgtgattgcaccactgcactccagccagagcaacaaagtgagaccctgtctctaagaagaaaaagaataatgccattttgaatccattaatggaaaaaattgctgtggtagatatggataaaaggaatagatgttacatttctgctacaagaaaatagtggggtcttcataatgtaattatcaataagttatagaatttctcttttccctctggaaattgtgtgttgatttaaggtgcctatactttataggaaattttatctctcaattcagaaggaattctgacatcacacaagggataacattgtacccttgaaactaacttttaaaaaatgtgtccttttcttggttctttttacaaagaacttttattcatattttcatgttagaaataaaagagttcaattattttagtttggaccttaagctggatagtttataaacatgcatattagcttcatttttcatcaaaatgtgtttcttttttattttagtctgatgccaatgcaagttacttaagagcagctcgagctggacaccttgaaaaggccctcgactacataaaaaatggagttgacatcaacatttgcaatcaggttagctggagttattattgaattttttacttaaaattctaaaaatccagacttcaagctccttaaagacttcatttatttgtggggtttttttccattgaattttatcagcttgtcattgtcaaattattctctgttagaggaacattcagaaatgtcagcatatgtcccttaataattaatttctaaaatttagtaaataatgataacagaacaacccatccagttttgaagtactttgattcctaattcaagattcaagttcctgcacagcatacatgcaagtgatcatcaggtgggactttataatatctcaggagttcttggtcggttgtttactgctctattttcaacctgctgagtagagcttttcctttacttttaatcagaatgggttgaacgctctccaccttgcttccaaagaaggccatgtagaggttgtttctgagctgctgcagagagaagccaatgtggatgcagctacaaaggtcagtatcacatatttaatgctttttgaaccactcgccatgttctgtgaggattcagccctcagtaagaatgggggcacatatctcataagatatttgtcaaatttgttctctttggggagaacaggaaaattcaaaagatcgatgagttgatatatcttgactttcatttcacagaaaggaaacacagcattgcacatcgcatctttggctgggcaagcagaggtggtaaaagtcttggttacaaatggagccaatgtcaatgcacaatctcaggtaagcctacaactccatgccacagacattttgttatcatttacaaacaatgttctttgggtcaggtgcttgcttagttcacatatcctctaagaacagaatacttaagaactatatttaaaaagttatatttggcacactttggaaggcaaaggcgggcagatcacttgaggcaggagtttgagaccagcctggccaacatggtgaaatcctgtctctactaaaaataaaaaaaattagcctggcatcatggtgtctgtaatcccagatacttgggaggctgaggcacgagagtcacttgttcccaggaggtggaggttgcagtgagccgagattgcaccactgtactccagcctgggtgacagagcaagcctctgtctcaaaaagataaattattgcagattatttaaattcatatgtattttcatttgcaatatatatgtgtgtgagagagagatttttaaagcggcctatctataaaagatactagtcatagacacaaatgtttaaagggtatctgtaatgcagggtcttacactattttatgatgctagcttaggttcaatctttttaaaaacaggcagaaggaactttaaaagtcctcaagtttaataaaaattttcagattctttgtaatgaacataggtcctcctataaatcttacatggtctttcattgaatttctaagaggaacaccaataggttatcatttatcatttgatagactttgaatctaaaagaattaactttgctttattatgtttaaaaatataggtcctcattattcaagtattcattatttgagtctccacagacaggtcatgtaggaaagcaaacatcatcataattcaaaaatattcactaaggacatgaccacatttaaaactggttcccactcaaacattccttccagtcgaatgctgacttccatccttatttgtcattgtctccccaggggtgttggatattgaacaaattgattgcagaacaaaactgcaagttttgacaaagacactaagtttcctgaagtcaaggaaagtgatattggagaacttctgggtgcacagctgagctgtgggtacatggcacactctggcagtattaggctaggaagcatgtgaaaagttaggatgatttcctgttagcggtttcatataagaatgatttgaaaatacatagattaaatgaagacaaaaagataagtgagatctttggatggcaaatacttcttccaaaagatggtcttttttgcttatgctatgaaaattaaaaagtgaagaatgtcaacatatatcattttgttgggaaaaataacacttggtttagtctttgttcattctgagaacatatatgaatccagttataacttacattttattaaatcatataagcctatttttataatttccagttttatcttttaagagtaagtctgaatcaaactttacaaaattatttactatggccttttgctctccattttaaatgcacttgattttaccaggattttctagtatgattatctttggatattgggagtctcctctgttttatgggttcacagaattgtagtgacttcctcccctgcttactaccgacatagcagtgatagctctgatgccatcaaatgtcagagtcaaagaaaaggaactgcacagtgcttccaactgcatggttcttgtatatttgctctaaattaattctagatccctgttacatgatctatgccaattattctgattccctaggagagttctcttggagtaataatgcttttccagaaaggaatgatgtaaaattgaatagcaacaagtatggtactttgagagagacacagaccagcttactacaatagaagcatcatgcttttaaacggatgtttttcaaaataccccaataatattttactgaaatgtggctaggtagttttaggctctgagatagtgggaaaactctttaatccattttcatttcttttattattttctcaagggaggaaaaaatcaacctaatcaacctcctcctttcaaacatcacatccattattgactattaatggttagagtagccatggttttaaactggctcggcaatgtttgggagaaactgcagttgaaataaaatcctaattagttctaatttcaatttatacgcattccacacctatgatgcagtaaggcagaagaacatgtgaaattccctgttacttacagttgtgctcggaattaccagccacacatggcacagcaaagcatttgccccttcatctgaacacctgccctcatatgccttctgaactgcattgttctgtggatggaataagtaatgagatgaccctgcagaggaatggagtttcaatgataattcctggtaacaactcttcagtaggaactgttataaagagtaacaaacaatgatgtcacctccatttaggaagcagcacataaaacaggacagaaatattaatattcaagacagcatctctgttgacatgaaattttaacctgtaagtgatatttaatagccaacaaaaaatagggtaaaaagagccccttactcttctttactataaaaattctccttatcttaaatataaaaatgacattgggcaatatcaagttctcatcttataaaccaaggctctataaactaggaatttgtagattttaaagtaatttttgtcattgccttgatcttaggtcttaacaagttaactctttcttttagtacttaacattccagtaatcatttagtcctactctgagaaagaaattgagttgactaaattgtgattataaagaattctattattaagtccttaatactttatattagatgtatcaacaatgattaacaatgtttgctattgaaaaaatctcaaactgcacagtcaaatgacatcccccactcttctctccttctctgtctttataatataaaataccaactgaatttataaagaagcaaagtctgtttccaataatattttaactaccaaagtatttttagtgaacagatttttctagtggcatttgcaaaggtaagaccctttaggttagccagtgcctccttggtctttctgggtactctgatattccctatggtgggaaagtcggatcctgacaaagttagacagtacaagtatgggactttggttatggttcagattgagcctctgtgaccttatattgcacctctaatctaactgaccttcatgaaaattagtaacgtatatgaatcaatgcaaatctttcaccatacccttaacatcttagttaaaaacagcactttatgatgtgcaaaggctggccatagaaaactagaatgagtagaaaaatttcatggatgaaatttaagcccttttccaaatgaagtcataggaatacttattatttcattttgatgtgtattagacagcatgcctcagtactatctacaaaattataagtctgcagatttgcatgcttataatagcaccactataaacattcagagcagaaggtattgaatatattggataaaatcagacttcaaacagcatactcgttccatcttaagctgctctgccttttgagaatttaatctgttgttgctacagaaaagaaaatgcaaattgggcacccatatattcctttttagctacctttgttttggaaatgttctaagttaggaaattgttataaaaacagtggtgtacttttttctcttattttgaaatctgaccattctcccaatccatgtgccatttcacagcaaacagttatggctctaggttgtctaatgacaacacattgagttaatgatgcctcaacctctttgagctagggagtgatggcaatatttttattcgctctttccaaagaacacttctaattttctctctagaatcataactaaatggttatgtatgtgttctcatgtcttgaccatttcttgagacataaaatttgtaattttggggtgttacttgaattacagggagagaaactaacttaagcacaagagggaatttattggaattagttaaggaacacagagaatagaaagctaaagaatctttcagaaagctttggaaacccaatagctggggtggagagtgggagaacagagtgagaagaaagagagtaggattaccctttgacctggttcctacaggtcaatcaagactggagagggagaatcaagggtggacctaaaagagaaaacagaagatagcctgcatgtgtgtctaccctgtaattaatgaagggcaagcttctctgtctcagtccatccaggacaagtcctacctgcataatggggaataggtaattctctgaaagaaaataggggtgacattgtcctgaaggggaaatgggtgtgtgggcactggtgaccaaaactaaagcaaaataaaacaaacacccatgcactacaaatgaccactgtaaaattgaaatttccaccatgaaacactcaccaaaaacattttatcaatatagatagcagaaatagcataagaaggccaagcacagtgttcatgcctgtgatcttagcactttgggaggccaaagaaggaggatcacttgaggccagaatttgagactagcctcagcaacatagtgagaccctatctccacaaaaatacaaataaaaaagccagatgtggtagtgcatgcccatagtcctagctactcaggaagctaagggtggagaatcgcttgagcccatgttaaggctgcagtgagctataatcacacgactacacaccaggctgggcaataagagcaagaccctatctgtattagcttgttctgatgctgctaataaagacatacccaagactgggtaatttataaaggaaagaagtttaattgactcatagttccacatggctgagaaggcctcacaatcatggtggaaggcaaataaggagcaaagtcacattttacatggtggcaggcaagagagcttgtgcagggaaactcccatttataaaaccatcagatcttatgagacttattcactaccacaagaacagtgtgggggaaaccccccccatgattcaattatctccacctggccccgcccttgatacctggggattattacaagtcaaggtgagatttgggtggggacacagccaaatcatatcactatctcttaagaaaattaaagaaatagtatcagaccattcaaggacagatatcatatgattctgtttatatagaatatccagaataggcaaaactagagagagaaagtgcattagtggttactagggggaaatggggagtgatcactaaggagtatagagggcttctttttggggtgatgaaaatattctagaattagatagtgggaagggttgcccaattttatgaatatacttaaagccactaaattgtacacttttaaaaggtgagctttatgatatgcaaattatatattaataaacaaatattttaaaaatcaaaaaacaaggaagtatgtaactgttcagaaaatgaccaactttcaggtaataatcttaggatggcaagcactcaaaaagaaagtagaaagctattgtggaaaaggaaaacaatgaattatagggctgcatcttgctgtggctgttgtctacaaatatttctaagtagtcctaattctgtgcatctcagtttctgtcatcataaaacagggcatgtagagtgatttcagagttgtgccttttaagaataactcttgagaaactcccggtctgtaagaaagcattaccttaaaacccagtgcctgagtctgggctttcttcatggatcctgaaatggttggttctggaaggaaactgtgagaacagtggacactcactagagccagagatgtgtggatagactagtgtttcttaggcaatcttgggccacagcagacctccaccccaacattgagaacgaactgacattacttgtcttgacataaatatcttgttgatattcatgtctgaaagaaaaacacttattttggaattaaaaaaaaaaaggtgggtgtggtggctcatgcctgtaatcccaacactttgggaggctgaggcagatggaacatgaggtcaggagatcaaggccatcctggccaacatgttgaaaccccacctctgctaaaaatacaaaaattagccgggcgaggtggcacatgcctgtagtcccagctacttgggaggctgaggcaggagaatctcttggacctgttaggtggaggttgcagtgagctgagatctcacaactgcactccagcttgggcgacagagtgagactctgtctcaacaaaaaaaaaacaaacaagaacaacaacaacaacaacaacaaaaaacttctaaaaatctgaacctgccctctggaagtttcagctttcggagagagcacttgatgagggaagatagatgcttagtacctagtttagctatgagaaaaagccatactggttttggccttttcttttcttttcttgttttgttgcttaaagaatatttaaattaactaaggatgtaatgatctttcattttggtccaattagaaaatgagaaaatagcaatatgatgaggataatcctaaactccctttgaatttcactcatagcgtcatagcactgggaagagggacaaagatgaaagacacacggacctatgggcatgcacacacacacacacacacacacacacacacacacacaaatcccacagtgttccaagtactccatgcttcatgtttaaatgtggtagaatgtttcatgataaaacagagtaacagtgggctccagagatattatcaggtagacaatttaaaaggaagaagattgaatgtgatgttgcattccactgcctctaattttgtgtttctaatcttgagcttggcaactagatcacctaacttgttacaattctgtgccaaatagaggaagtagaatagaggaactctctgataagtacatagctatggtggatttgttatgtggcatcgcatttatctgcttgaggatctttttaacttactttctaattctcagttataagccaaaagcagtgtgtttgccagaggctgaacttatggataagtaaggtgatcatatagtagttgatatttataataatgaacctaaactttttgaatcacaaaaggttgaatatttggtaacattgtagtttagaatatatttacttttattctttgaaattgcgtaatgtatacagtaaaatttctggaacattcagttaaatagaactgcattctgaaaagtatattcaaaaagaatttactggctcggtgcagtggctcacacctataatcaagcactttgagaggccaaggcaggcagatggcttgagctcaggagttcaagcccatgctgggtgacacagggagacccagtctctataaaaaataaaaataaattagccaggtgtggcggtgcatgcctgtagccccagctacttgggaagctgaggcagaaggatcgtttgagcccaggagattaaggctgcagtgagctgtgacgataccccggcactccatttgtttattattattattattttgatacagagcaatggagcgagaccctgtctcaaaataataataataaaagaattatagtttgaaaattgtttgatgcttatatcttgcaataagattttaaaatagtatagtatttcatagatatgaaatacattattctagagaaaaaatatatatacaacatttttttagtaggaaaagatgtaatatgcatattaatttgcttgaatccaaattctttgagagttgatgcacatttcagagaggcacacagacacattcaaactaaatatatgtgcatatgtatgtacatgtaatatgtatccatatatgtattctgaacattaaactaccttagcaaaaaaacacaaagaaaggaggcctacaaaaaacagactgtgaattagattgaatcataccattatgcaaatcggcatttcttttttgctcttaaagaccacatctgtggtaactttgaagctatttgaagctatttgaaaagctttgaagctatttgagattaatataaattcctccctgaactagtcaaaactagttcagatacttttgtgtgaaaatattacatgtttatttaaaacagataattgatgcttgggagctacagtgactaaatgtgtttttcttcatagtctcatagcatctagtaaaatacttactcatggtagactctcaataagtggttgatgactaagtgagtgtacttatttctttaaagtgggtaaattgctttgaattatacttggactattaactatgaactattaactatgagctatactcaaattatgaattatgaaatataattttgaattacacagatcaggaatttagcttaagccatggtgcttgggttttctaataaatatttatatctatatgaaagtattattaaagttattgtatgtgagcacttcttggagcataaatcatcagtaccatggaaaaatagattgtctctggaaagctgcagacaaacattttttttcttattttgcagaatggtttcacgccattgtatatggcagcccaggaaaatcacctggaagttgtcaagtttcttcttgacaatggtgcaagccagagcctagccacagaggtaagatactgtttttttcctgtgggtgagttcacgtatttatagggcattttgaaaacctggagttgtgaatttgtcctactagtatttcaattgaagttttatattaatgtgtgggttcataagttttatgaaatacattactataagtctacttttaatttttacaaatcttctgttgcatagatactctttctactcttaaatgcccgattctatgctataattatgctattattttaatatttaacgtatttgcttgagaattcttttctgtctcttacaattttggcttataggcaaaggcaatcattgttttggagtaattgatgtgaactatcttttcaataaaacattagttttaaattgtttttccaaatttaagtttacctaattataatgattgaatttgtattttttaagttaactagacttaattcatagttataaataaaactatggtactttttttggggggggggaggggggatggagtctcactctgtcacctaggctggagtgcaaaggcgtaatctcagctcactgcaacctccgcctcccgggttcaagcaattatcctgcctcagcctcccgagtagctgggattacaggtgcccaccacccacacatggctaaattttgtgcttttagtagagacagggtttcaccatcttggccaggctggtcttgaactcctgaccgcgtgatccacccgcctcggcctctcaaagtgctgggattacaagtgtgagccaccacgcccagccaaaactattacacatttttaagtgttaaatagatgtggtatttgaagaaaaaaaatctttgctgtctagaatagaataattatttaaaaatagaaagttatttaggccattggcactgtcttaggtaatgttgtttattttttaaactaatctggatggaagactggaatcacttaagcatgtcaccagatatctattgctaataataaaggatcaatatttgagtattttttatttctaacaacacagtgaattagggcagatgcagggttatccctattataaaccactactcttgcttgcatgctgatgtgcttcctgaatagcacagaaaagatggcagtagataaactgcatctaatctcacttagtttttgagattataccttctagggaaaccactaaataaattaagagatagctcacagaaaacatacacaaacaaacataaatatatgaaaatttctcatcctcatttatagtcaaatactaatttattagtcagatacaaaataagatctaatcttttgcccatgagactaaaaacaaaaatttcatggggagaggaaaccagaactttcctacaatactggtgaaattgattgttggttacaacacttttacagaacatttggcagtaactatcaaaaactagtatttacaagcctttttacttagcagctgcacttctaaaaagttatattatagaaatattagatatatcaaatatatattatagatatgtttgcattaggatgcaaaaatagtataaaggatgtttgtcaacacaattaataatagcaatttttaaaaatcagaatctaaatttacaccaataagaatcctgtttattcagaactatttggcttggaaagaaaaaagaaacctgttagtaaatgttcatatatttatacaataacacgctgttagcactgttaaaaacgaggcaaggctctatgtactgatataggaaaatgtccatagtagattgttaccagtggtttgccctgagaattcggagggagcctttgtacccatcagtactgttgggaatttttatacatatttttttattttatacccatcagtgctttggggaatttttatcatgagaatgtactatttttgtaatagtattcttaaagctagttaggaaataaccactggttgatatcaaaataacaaacatttagccgggtgcaagggcacacaccggtagtcccagcccctcaggaggtagagacaggaggcacttgagcctagaagtttgaggatacagtgctctgtggttgcacctgtgagtagtcgctacactccagcctgggcaacagtgagaccctgtctctaaacaaacaaaaaagaacaaacttgctaggcagagaacggtgcctctcttcacactcaagagtagctattctaagcacactacgatacacacattgtgtcctagcggacaggggaaatagagacaggcagagactgttggttaagagaaaacccatcctcattttttggatggaaatattaagtactgtaaataacctaatgaaagtgattccatagctttctttgtgaagatggcgtaggactcttttttcacactgtgatgtacggatcactaagtatctctcctttagaagcaaacataaccccaatttactgctaatagattagaattagattgtaaaccaattaccagtaactctcagagctctctagtactttttaaagttttcaaggccccaaaagaagccctacagctaacttaaagaaaaatagtacgtgagatcttcaaatcactacttcagtcttttagcaaaggatatatattttaaagtttttactcttttacattgatttaatttcatgttatttttgtagttttaagggaaaaaacaagaaacatggtgtctattaagtcacgttcatgtcttcagggaggttgctgttatattgctatataaacaacatctaattacctagagatgtttgaacctttgaattttttctcttcttttggattattggaattggagaataagaacaacaacaggaaataagacattttattcaaatgatattctaattactgtattgctctctcattagcaataatattggtgttatttatagagaagtctgtatttacagaacaaacagtagggggcaattaaaggatcctttaaatagcaagtttttaatagaatctttaattcactacacgatgggatattgccaaattctttcaaatgtatttttttcagtaagcctggcacacttcaaatcttgtatatatgtagcaagacttaagtataattgtggtttttaaaacgtttttgtattactgtgtactgcatctcatatcttttctctctatatataatcttccttttgctaattacgattctgaagcacacagtatatttgtttgttcgtttattccatgagtaattattaagcacctattatgtttcagacacttcataaggtactggatatccttgagcaaccaggggatggaccttttttccagtagcctctatcacatttcctttctgctcatttttctctgaagaataactgcacaaagcaaaccacaccatttaaacttggttttgaaacaaaatctggagctgctaattttagctattaacaccttagagctggtatctttgtgtctttaattggcttatgcaggaaacatattcttgtcactgctaatcggctcagttgcagtttattttctggtacaaagtagtttcctttatgtataggtcctgtgaattttaaaattctcatcagtggaaatgtagccattttgtttggtttcagagcagaagtggactgtcatttttaccccttagcttttgttcaggttttttaagtgagatgcaaaattaaatctcaaaacacaattttccttttgccacactcttatttaaacaatgcatattttcttttttttgcaaaagtaatacattacataaatgagaaagtacaataagaagcaagaaatctctgttaattttccctagagataacattttacccgattgcttgcacatgtacacattagatacatgtatgtacctttatgaaaatgaaaatatatatttacattgacatgtagactacttttcttgttatatcctaaagttcctgtctttaagtgtaaacctatgatatcgtttttgtgacatcttggatgtatctagtctttccctgtttgttatctttcttaaggcttcagggaataaccttctagttgttttggttatgttattgttttcctttttcctgctgtctttggtagtaaagttaaaagaaacaggtggcatttaagccagatcttgaagcatggagggtagaggggatttgtatacatagagaaaagaagagggcatttcagggtgggggaaatagcatgagtacaggtgtcagaggagagtgaagtctgtacgtgcataatcagtacagacactggcagaaaggactttataggggacagtactgagcaataatgtcccttaagtgctttgggtcaatgttttgcacatcttggatataagtatgctgatttgcattcagtcagatgaattatgagagcctttctccatatgctagcaagggaaggaatgttgaaagggatgttttaggaagaccttggtgcatatgtgctcctatgtgttttccaaatgcttttctttaccatgggactacagaaataaaatatcatgacccaaataaaataataagtaacttgcatgccagttctctagttaaaaaaaaaatgcccttttgagtatataataatgaaacctttgcagaattacaatttgtgagccagtcctaggatttttctaccctgtgctgttttttctacattcaacaactctaggtaatccacaagttaatttcactgcagtgaaatctgtagctgtgtcccctttatcaagtcccagggcaacacaaaggggagagtcaaaatgtatagagtatgtatgtgtgcacttatgtctgaatttattctaaagtcgtgttttaatcaaattcttagaagcagagaggaacatggtggttaccagaggctaggaactgggagtaatggggagacaggaggtaatggtcaatgaggagggataagtttttgtttttattttgctttttttgaaatttattgcacaacttgattaacagagttagtaataatgtattgtacatatcaaaattgctaagacaataaagttcaaatgttctcaccacaaaaaaataagtgtggtaatgaagatgttacttagctggatttgtccacattgtattcataagtcataatatcacttgtacccctataaatatttataatttttaatttaaaataaaatttaaaaagaaaaaagacaataaccagaataaatatatagagtcatgttttgcatgatctttgtgttgtcttctctcaatggtcacagaagccaagagtctttctcttagctctagagaccttagcctctatagatctttcataaagcaacaatgagtacagttcatgaattcacctatcctgacagcaccaggaatatgcgaggcaacagggcacagtaatgaaccagacagacatacatctcagtttttaaaaatcagtggaaatgtttacatcttatttaaatgatctcctttgaaaactttgcctggatttagcctgagatttttttttttcttttttttttttgacagagtcttgctctgtcacacaggtgaaatggcatggtcttggctcactgcagtctccacctcccagattcaagctattcctctgtctcagcctcccaaatagctgagactacaggcatccaccaccctcggccaatttttgtatttttagtagagacggggtttcacaatgttgatcatgctggtctcgaactcctgacctctggcaatctggccgcctctgcctcccaaagtgctgagattacaggcatgagccaccgcacctggccctgagattattttatgaatattgatattatagcaactttttcttttatatgtagtatttttgtacactttcaaaattttcccaattaatgtatattaatttttaatggaaaagaaaaccaaaacccatgaacttattacaaatttcttagtattttttactttgtatagataaattttttttgaaaatatctttcacatttctgtccattcaaatatgttgttagttttaataatcccaaacaaaaattgatgcttggtcacttggttgccttcttatttgttaatttaataaaaaagaaaatattcattggagcccatcttgacccatccatttatttgcaggatggcttcacaccattggcagtggctttgcaacaaggtcacgaccaagtcgtttcgctcctgctagagaatgacaccaaaggaaaagtgcgtctcccagctcttcatatcgcggcccgaaaagacgacacgaaagccgccgccctgctgctgcagaatgacaacaatgcagatgtggaatcaaaggtgaggcacgagggacacgggcctgtcatgcaactctccggtgttagacacacaacctttaagagcacccggtctccctcttcgcaagcttatgccatgcctttaacttcattgaagggaggaacaatgtgtgtctgagctagccactgaaggcacagcctcccttcacatgagaagttggggggtgaggggaatgcggccctatgcgtgctaaaagggaggccacctcagaagaaatcaatttctatgcagtgatcatttctttcctttgaatatagttttggaatatattcaacagttcagctcaaacatcagggcgaaaaattacaaaatactgaagacagtgtacacaaacaaacctctggttgatacccaagatgacaggccaggcactgagcgtagatcagctgcggaaagcatgccagcagcaagagagccgcagccaaaaattcccatcgtcttgacatgtggtacctgaaagtctctgtgacggaaatgtgacatttggactaggccgttgcgtagcccatcattcagtctagctttctttctgtgcctattgtgctttcatcagagcttccatcctcattacttagctgtcatgagctttctgcaatccatatcaccaatagtgaactaaccgttcattttttcctcctctttgcttccaaatgtgttaacctagatggtggtgaatagaacaacagaggtatatatatatatgcatatacgtgtagtctatatctgcatcatcattttcccatgacttagtgctgctgcctcatgtctctcccttcttctttgcatcgccttctgtaggctagatacctgctttatccccaatccctcctctccccaaaggagcatgtgccagataagatagcagtagtttgattaccagggctttctgcagctgaacctggtgtttgaaagagatgaggaatccttgactcttaagggtattgcaatagagctgtgtgagatgaagagtctggacactttagatgtttatcagctatatctaaagctgcagacaaccctgtcattctactcatccaggactcgttttttagggttgtgcatgacacttaccctctgtggtgtcagcaaaaggaaaggtatttcagaatggtgtcaatatgacccacccttctacaagactcagtgagatagctagcatggctaagaagcttgctaacaaattagaaatgcatctagttcctataaggtttcaatctttggggactaagtgaatcgctgcatgttttagcattttttaaggaagtaaaatgaccttggtatgaacaatccaaaaacatgtgttattgaataggcattggctaacaaagagattaacttgtggattcttcatggaatacaattgcccattatataaaaccaactttgtggtagtacgtcttccccccaaaactgcttttgtcatgaaaattggcatttactgttcagtaatatgaatctatatcaaatatataaactaattgaattttgagtttcaatgcacaattctatcgtcagtaataaaacagcggcactaatcaagctatcagctataaagatttttctcatctctatcttaatttcttgaaatgttggcttttatatagttctgttattggattactaaaattgctcagtctccacccttggttcctccctggctattcttctgcctgtaagtttggggtttattagaaaccctgtgagcaattggcactgatcgaaacctagtacagaatggaacatagacctcagcatattttgcttcctcatttttatttgggcagggttatgatatttgcctgtcaggcagggggctggcaggaatcaattgaatgtctgctatgttttctttacagagtggcttcactccgctccacatagctgctcactatggaaatatcaatgtagccacgttgctgttaaaccgagcggctgctgtggatttcaccgcaagggtaagagcacagcaatgtgtaatacctttaaagcatttgcaactattttatactctctttccccaacatgaggatgttgggacaaattttctccaagagtccttccagtcagtgaaggctatgatttctactcatcctagtgtatgttcttgattttacataggtgtgcctgtttcctagcaggagaggtaaaccaagatcaggaatgctagctgggatggatgataaataaatctataaatgcatatatagaagatgtgattcaaggaatcgtggctggggacaacaaatagttccctaagttaaaatttctgaaacccttagaaattggtcagatggcactcagtgctctagagatcagggtcttgaccttacaatgggaatgttctggaatacctgggtgaggcctaaactacagaatccaaataatgagaccatcttttgcctttatcttctgtcccctacaaactttcataatgagtaacaagttggtgtaacctgagtaagctcatatccattgaagaaaggaattacaatgtcatatggcccactgcacagcaggttggacatccaaacatagtagcactgctctcaatttaaaaactggtgttcagcttgaccatcagaaacactgttggaagtacaagtgaagctggaggcaggatgaagtagtggctgaaatcctggactctgagactccttaggttcaaattttggctttcacttttttccctgtgtctgtcagtttcctcatttataagatgagataatatgaattatgaaattaaataaacaattataaaatatcacctctccctcactgcgtcactgaaaattaaaagagatagcatatgtaaatcactcagccggtgcctgatgtagtatcatcactaacagcagcggcagtagtgtattagtctgttttcacattgctataaagaggtgtctgagattgggtaattcataaagaatagaggttcagttggctcctggttctgcgggctgtacaggaagcatgatactggcaccagctcggctcctggggaggcctcaggaaacttaagaataatggcaggaggcgaagcagggacaggcacatcacatggccagagcaggagcaagagagcaagaagagtggtgctgtacacttttaaatgaccaggtctcatgagaactccctcactatcacaaggacagcaccaagcagatggtgctaaaccattcatgagaagtccttccccatgatccaatcacctcccaccagactgcacctccaacatgggacactacgtttcaacgtgagatttgggtggggacatacatctacacaatatcaagcagcactgttattttgaacgtagcatttgaagtcttattttttgctgaaccctcacttcttagaagagaaatgaaactagattagatagggagatagtgtataatgctagcaacagcagtacagtggtagttgcatcagcagtaaaaataatatcatttctgaagtctttcctgactgtaagatgccaggctatgcattttatctcacgtatactaatataaggaaaggtacagtttatccttattttacagaagaagaaacctaggtttagagataagaagtagctgctttaggatcacagtgctagcaggttggaagaggcaggatttcagccccaaagctcttaaccactattctctcccctaggtaacttaaaggggtttattttactttccctcttataatttgttagttctataaaaattaataagggctgagattgtactaatagaaaagctatttcctatcctgttgtcatgagcttgccgaaagccttcatcagtttaaatgactggagagcgtcagtcagttttattcacaatttttcttattgtgttaactacatccttgatgtggcagatccaaggcctagtttgacactttgaaggacaaagctaagcccttctttaagtcaagtataaacagggtatgtcagtgttgaagctgaagttcatttcaagatgcattcttctggttttatttctgtaattcatagcataataaaacctcattaagttacatcttctaattaggacattcagaaaatttatgtcagggtggtgtttgaagtttgtctttgtgcctttgttcagaaattttctgatgttgctaaaaacaagaggattagagaaatgtttaagcaatttaagaggacatattacagtatattcagacttttccaagtgattctaaagtgttcatttgcattaaaacaatgactgtggtaatgacaaaagatgcttatttattgattaaaaatcagtggagacatcagacccacgttgttaaccttcctgagttaccatatatgatttaaaatacttacactgtgcttttgtttaaaatatgttaaaattcagacttttcactgattcagaaatgcatttttcccagtctttcctaattaatgaggtctaatagcattctgagctgaaggctgtggtggaatttgattttatttaataggaggcttgggctgttgcatattcccaaatgagctatgcttctctctgcagtgggtgattgatgactggctttagggtacctgagaactctttttaaagagcttaaactgaggcaactgccagctgcctcaagcaatccatttgaggtcccacatctgtagcaattttgttgtataataatctagcatctccactttcatattacagaggcttctcccttcccagcttccaaggagtctttctaggtcatagttctctcaagaaggtaacagaaatagcaggtgaaagtaagaggcccctgaatgcagacaggatcaaattgtatccagtcagagcaataaagggagcattattaagcctcatttgctaagaattggctgcaaattgtaaccataaatcatatgcttcagagctaggtttggagagaggtattgatgaggtggttagaagtagattaaaaaacagcagcaccctttgtcttggggggctgcaatttctgttttctgcctgtgacaaaatacagtagggagtggaagatttaaatcagtgaagaaagaagtatgacagataaagtcttgcagttctttatagcactgtagactgagggaatgtcccagagagtgaccacctgctagcaaagagagctggggaagaggaagaatgacaacacttctggaatctttcctgcatgcaatagatgttcctttccaaagcagataataggtagaaacaaaggcgatgtgactgaagggagtaaacaatagaaggaattgctttctgtattcatttgtagtgccaactaattcatgcagcagtaaagcaggtcccagtcagtggtgaatgtatacttctgagtagcagttccggtaactgatttatagcatacttaactgtttcaataacacctttccttcaatttttattatgatgtttgcattgtaattttactaggtatatgtaagatatcctgtctgacatcgtcaatatttccttttggattatccttggagatctattcaggctcatgggtctgctgcagggagttaatgtagtagctgctgaatgctgcaatgcagcgtcagcattcttcattctttgaactgagtctgctgagatggcactgacactgtctgaatttatgcatgacccttgctctctttgcaaatcattctagctctcttgggaaagagaatgtaactaaaacatactagagctagtactgattgtcattccagtaaggagcatttgtgcactagagtaacaaaaggccaaattgtattatgtggttgcctgcaaagttccctttattgattgaataagatagattaatactttgctggctgaattttttcatcaaatacaatggaccacctaatctaatcttcactcttgtcattggcctttctcttgtaaattattattcaacttcccattttgagaagataattgaataaagcattcttctgttagtcttgccatttagcactttctgttttgatctctgaaaggattagggatttatgtgtttggattctatacctcatttgtttccaaaaagatttcgggtggtttacagattaaaatatacagacgtgaagggcggaaccaaaaaagtaaatgttaccaagcagcaggaatgagccagtaaatacaatggaaaataaatataggccttaaaagctttgatatatatagtggaaagggaagcatggataatagagtttccacttttgacaactgaaatcctgtagttacctatagagacaatttttgtgtgaaataactcaaacattatttttatcatatgaatccttaagaacagagaattaaatagttagcaatatctttagttactatacttcaaaaggctcaattctacttcctactgcctatgactgctataactccatctgtgaaggcaccttgcccagagaagctgagagactgtggcccagctacttaactttatgatgatctagttgtgtaggaaagaacttggcatgtatggcacagatcagtgactggttaacatgtccattgggctgcctttttcaaatattgggtattttatacaaggttttgatcgatattggaccacattcagaaccctactaaatcatacaaagggttactttatttaagatattttaatgtttggataaaatgagagcaatgtttttagatacttgaactactaagcctgttggtggaaaaataaaaggattagacttctcttctgcacttatatactgttggtaggaacgtaaattagttcagccacaaattggaaagcagtttggagatttctcaaagaacttaaactaccattcaacccagcaatcccattactgaatatgtattcagaagaaaataaattgtcttgccaaaaaatacgtgttcacatgttcattgaagcactatttatgatagcaaagacacagaatcaacctaggtgcccatcaacagtggactggatgaagaaaatgtggtacatatatactatggagtaccacacagccatgagaaaggaacaaagtcatgttttttgcagcaacatggatgcagctggaggccattatcccaagcaaattaatgcaggaacaggaaaccaagtactacgtattctcatttactagtgggagctaaatgtggggtactcatggacataaagatgacaacaatagacactggggactactgttgtggcagagttgaaaaactacctattgggtactatgctcacaacctaggtgatgagatctttcgtacaccaaacttcagtgtcatgcaatatacccacgtaacaaacctgcacatatacctcctgaatataaaggttgagattatttttttaaaagaattatgttctgtccaaacctgaggccaacatggcttagcacatgcatgagcaaaacagtatccatggatgagcattatctgggggatttcttttctaaattcaatccaatttagcaatatttatagagcatctactataagctggacctgaaggttcagacttgagttacctactctaccattagtacttgttactaatgtgtgaatacttagtactttattagtccctacactaccaatttgttcaggcaccaaggtgccaaaccatataatacaatttctcccgtaagtccccaaagcatagctgcatctaggctataatgctgaataggacttttctaaaaactcaggaattgatgaaaggagttgaaagcagaaaggcaaagctgaaggataggtcctctgtaacagtgtccccaaagaccacaggctgtgcccccttccttggagttcgtctggtgaccccttctgagcccccggagaccactgtgttgcagagtctatctcatttcccccaagtgggaacccctttaccagatctctcctagccagagtccaggcctcttaaccacctctgggccccagtgaggaaggaaagtctgttttctctacacctgggctatgttacttcagtagccactaacctggggaactagctttgatttaaataaatttttttttattctcaagagcattttaagtgctcaatagctagtggctactgtcttattaaatggcacagatatatcgcatgtccatcatcatagaaagttattttgaatgaagccatgacaccatccatcttaggccttccttcccttcaatgtcataatgatctgaaaatgcaacatttccctcaaggaagatggttagtccctgaccccataggtgagcatcacagcctgtacttccactcacattaggcctcaaatataattttatttatctgctattgtccattttgcacactctatttgctatctaagcccctggaaagttgagatgccctagtcatcctctgtctctaggttttcctttggtccccaggtgcttaccatgtgcctggctctgtgcaagtgactttaacatgaacttaattctctcagtctttcagaggatgatttgtttttgctgcctgatagccttttttctatttaccttccttgacatattaatagagtcaccaaaatgttcagctgcatttcattcacctagaaggcaatgaatgtaaaaacatcaacaattctgcctgctacgaaataagtgctcagtaaatgtccattcccttctttacttctgcaggtgatatttatagtaataatgattttttaagttataatttattatccagcttctttattaggcattttacacttattgtcataacaatcctatgagggctaaagtaaaaatgtaataaaatatagctctctcccacatcctgtttttcatctcacatgcagattttgaattccccaagaacagacctgtgtcatcttacacattttggaatccctggagtatagcccagtacctggtgctgggagggactcagtatatatttattgaattcaaaaatgaatgaataaatcacttcttggccttcctgtccaccactcctggtcacccagcacctatacaaacctgctttcctctccctagcctatcaaaattcctgttacttcaacttgaatctctcctggtctaggagctgctttccaaactaaactcagctgcgttaagggagatggaaaaattcacaggatactaatagaattttagaccagtgcaccaaacccaatgtcagaggcagaggggcaagtttatttgagcagcaaggagactttgcattcagctctgtagatgaccttggaagacaggcctaggctaactgggctaagcctaggctaaaagtctatcgccaagctttgttcaaaattaagagtgttttaagcagggcctcaggctctgggctgtgaaggccccaagtgaccaccagaagatgctagaaaggacatcagctactggagcatggagaggaggtgagcctggctccagtaagagtgtggcaaactcctgatggttttacaagggtgtagggcttttggagactctactttggtttgtgtagtgatgcatttgcaaacatatgtttaaaatactaacggctctccacattcttagatttcacatccatggttttaaccaaccatggatggaagatatttggggggaaaaaaaaaacaataaaaaagaatacaacatagaaaaagaatacaaattttaaaatatagtataataactatttacatgacttttatattgtattagtcattataaatctagagatcatttaaagtgtacagagagtgtgtgtaggttatgtgcaaatgctgatttatataagggacttgagcatccatgggttttggcatcctcaggagtcttgtaaccaatccccatggataccataggatgactgtatattttcctcttattatacaaatcatgctttaaacaaaatacaataaatcacaagtgagaaaataaaaaccacttatagcagactttttttggcatttgaatgtttatcccaacagagaccacacacacatacatttcttttttattggtacatattttttaataggtttatctcctagtataggctcaacagcattaaagacaaagacttcttttctttcttttaagggttatgtaaacctccccatgaaaatggggatttgagagccttagcaaaggaatatgagttatgggaaagtagccatgtgtctattgcattaaacatattcttgttgccatggtgatattaacatttcaggaggaacaaaaccagtaagtttttgtaaggtgacagaatggaggagatgcatgtttacatagatttgctcttataattatgctgtgcaatctcatttctgccttttcctgaatgccacatcaaaggagaatctcttacatacattttttaaaggagtatttttatctgatgtccatttatatacttgaattcattgacatcttcccgtgtggagtgggatctatgttcctcacctacagaggtgccatttctaagtgacagtggagtgaggggaggaatacgtgctggactctggactcttatcttggctgtatcatcaatcactaatgtggtccagggcaagtcccttcatcacctggcctacagttattttagccaaatgagagagacatcagccaaccccaagcccttgtcctctgcccaaccaccttgtctgacagcaatggaggtagtcttcagcttccctccccctttcacaatagagtacatatgggacagtggcaaagtaaaccgcactgtcagaatgctggagtcccacactggccttgcagcttatcctggtgctcttgagtagttatttatgtttcagcctaatcatccatataatgggtccaatggtagaacctaatgctatcaatgtgatgattgaatgaaataatccacagaaattgcttaacacagtgcctggcccacaagacatgggcaagggctcaagacatggtgatggttgtcactgcttgcatccaggaggggacgctgtcactgcaagtcacgttcccctgtaaagcatgacgcaggtcaggtcgatggcaccaaggtagccctctaaagtacatccagaagtagtcaggaatgtggcttctcagaatgaattatgttgtttgtggtgctatttgtcagcatgagaaagtctcataataagaaataagaaataataaatgagaaataagaaactgttaattaatgacactgagacaataagagagccaataaaagaaatcatggaaattggaaggtttttcactttttctccttgaatatgtgccctgccgcctggggtgctgctctagaattgttgctctgagaacatttttaaatgacccgaaaaaaatcctattttgaaattgtgtgaaatgaagttctattaaggtaggagttggcaaaactcactttattcatttgcactttaaaagagaattattcattagctgtagaatttttatttcccccattcagtgaaaataacagctaggggctgccatgccccagactgatgctctgctaaatgttccagcacgttgtccacactccctgtcatcagacagtgcatttggatctgctcagatgaatcctggtcccctccttgagcactgcagttcttccacagcagtgaaaaaaacattgctcttcttcctctggtggtttgaagaatatacagaaagggcaaaggggtacctagagtgtagaggttagggttcatagaactgaaggattgcacaggtgtcagcccctttggacacaggcacgatcatttattggccctcttccaaacttaagcaagaagttctaagaaaataaattcagatagaagatcagcatggaccagataattggtaggaaaaagttgcaaagctagactgtgatggaaatatagaaatggggatcagctccaagaaaaggaggctgaagcccagatgcaggtgtgaaatgagactgaagatgaattatgagagtccagcccggtggggaaggggctcagtgaataccagcctgggctgtaggcactggccttgatcctgcaggtagagggagttacttattgcaggtctttaagtggatagaatgatggcagtagtgtataaggtgaattatgacacatatgaaggggaaatcaggaaactgaagttacaagctgtggctgactccagtcacagaaagaaaagtaccgacaggggcagcatgttgccccctagtatgatgcacttctacttgctgatgacctctgtggagtctggccagagccactggttttcagtggagggaaaaggagcatcatctgccttaaaagatttgaaaatttgtagaggaatttttggttgtcacagtggtggttggcatgtaatgggagaggcccaggatggcttaggctccttcaatgcatgggtcagtctcacacgaataacagtgtcccaaccgaaaggccagtgatgcacccatcagacatgctggattgaacatctctttacagccaagaaatggagcagtgaggtgtcccaggatgggaaggaagggcccagaaatccatggttggtctgagatgctcctcagaaagtgtctagcatcccccagcaatgcaccccagagagcggttggtcagaagaccctgaggctctgttcagctcccactgctaagactttgaaatacgaggtggaaaaaacaacacaaaattcaaactaatttagttaatagctttcatgtatcactgggtgccaggtacagtagcaagtatttcatttattattcataatttcatgaggtgtggatatgatttccattttatactaggaagcaagaagttccataacttgtacaaagccacacaaactagtggagctagtgctaagatacagtaaagacaataaaaaactgtgtagttcataatattgtaacatcaaaggcaatgtgtgtttgggctttgacgtaatccaatatcatcacaagaaaaccagaattgacagcagcctcttgtgttctggctggtgatttggtctctacctgggccaggcttgtgagataaattaaatacatttttgaatccctaaataatcgggctttgaaatggactctggacatttagaaacttgatgatcttatgacaaaagcatatgatatatatttcctggtaagaaatataaggcaggcttgtctctaaaaggagtgaggtccccttagtttaaaatataaaagcaggccgggtgcggtggctcatgcccgtaatcccagaactttgggaggccaaggagggcagatcacaaggtcaggagatcgagaccatcctggctaacatggtgaaactccgtctctactaaaaatacaaaaaaattagctgggcgtggtggcaggcacctgtagtcccagctactggggaggctgaggcaggagaattgcttgaacctgggaggcagagcttgcagtgagccgagattgtgccactgcactccagcctgggcgacagagcgagactccatctcaaaaaaagaaaaaaataaataaaagcaaatgttctaacagtttctaagtcaagacctctcaactggtttttcccagtttgtctcagccacattttcccatagattctgaatcattaactctgcactggggacttgcaatctgtgtttttaacaagttcctcaggtgattcttctgatcaggcaagattagaaaatattgaccaatgctatgttatgaaaatgtttctctatataaattgcccaaagttgagtcatggaagtctttaaaaatcatttacttgtaacaattatttttgtgttgataaccccttaatatagccttgaatttattttatgtcttacatcttacaaaacacatttaggtatagtccatcatatgaaattcacaaaaaatatacaattttatagataagtcagtgaggcccccatttgtcttgggccctactaagaataaagtggcagaacacaggtgtgaatccagaccttctaacacattttggtacgcctcagtgcgtgacctgtggagctggtggggcatgctgggttgtggggagagtcagcacggtgctcagtgggcagcctcattgcctcattctcgttgaggatggggtatcggccactgatggtagctggggtcttcatggcacctagaagagtagctccagctccttaggacatgtgtgctgcccacagataaagctgttggcacagactgactttagtatttccaaaccatctttctttagaaacttcaaagacattgttttcatttcttgacatgtttgaaactccagcatctaatttgttaaaagatcaagtgaaggcaagatacctgagaaactaagaatttcaagttaactgatatctcagaagcctgcaagagtgatttactttctgcgggggtaagaaaaaatattcaaaacagaaattaatttagttccaggtttgtcagaagtgatacaggagtatagaaaatttgtaatataaatccccattacttttttaagaatttttgatggcagaatgttaaaacaaaaggggatggactttttaattgaagttataaaattcattagaaacatttcaggaaatctaatatcattagatcaacatattctaaattgtttcaaatgttaaaataactttcctcaaagtagagtaagtaattgattcctccacaattgagttttaaatgcccctttccattcaactgctatatatatctctctactcatagatctttctagctgggaggggctttctttactgtaaaacagatagcaggctacttttgattgagctttgatagtgacatctttaaagaaatataaagaaaaaccatgagttcttatttaaaatgaaagagttgaactagccactcttttagacattaactatttttgctgtcactgaatatgctgtttccttttggctggaaattgtttctcggcaacattttctgtatagagactatgctacttggattcagagctggagctaatgtttgcccaagttaggaagagactcactatcaggatatattttctcttctgtgacccacaggaaagagcacagctttgggaatcagacagctcagggtcaaacctcagctctggtattttctagccatgttacctgtaacccattccagcttcactttgctcctctgtgaactgacattaatagcatctatttcatgtgttgttatggagatgaaatgagatgaggcatgtttcatagagcctgcacaaagtagaggtcccataactggtaattttcttccattttaattatgtttgttctcatgtcaaacaaatagtttcttggtcaaaatcagtggtgtccttttttttgtagcagaactctttttctaactaatttctacaggaattaggcatttactatgtcaatctttagtgcccccaaatttcttattttttatggaattatggaaactctgaaatgtagcctgaaaaaatatatatttaaaaagcatatatggaatactcattaaaatggctactatcaaaaaaaatcagaaaatagccggtcttggcaaggatgtgaagatatgggaactcttgtacattgttgatgggaatgtgaattcatacaaccacaatgaaagcagctcatcatttcctcagaaagttaatacagttaacgtatgatccagcagttccacttctgggtatatacccaaaataatgaaaagcaggttctcaagaggtatttgtacatggatattcatagcagcattattcacagtagccaaaaggtggaggcaagccgagtccaacagatgaatggataaacagaatgtggtacatccatacactggaacattcctcagccttaaaaagggaggaaattttgatgcatgctacagcatgaatgaaccttaagacattatgctggccaggcgcagtggctcacgcctgtaatcccagcactttgggaggctgaggcaggcacatcatctgaggtcaagagttcaacacctgcctagccaacatggtgaaatgccatctctactaatatacaaaaattagctgggtgtggtgatgtgcacctgtaatcccagctacttggaagtaagaggcaggagaatcacgtggactcgggaggcggaggttgcagtgagccaagatcgcgccactgcattccagcctgggcggcagagtgaaatcctgtctcctcccaccacaaaaaagaaaaaaataataaaatgctgagtgaaataagccagtcacaaaaagacaaatactatgattgcacttaacacaggtatctataatatctatagtagtcagattcggagacaaaagtaggatggtggttgtcctgggctgggaggaaaggggcataggcgtagctaatggctataaagtttttcacttttcaagataaaaggagtttggagactgattgcagaatgctgtgtacttaatgctgctgaactgtgcacttaaaaatggttacaatggaagttttatgttacgtatattttaccacaatttaaattaaaaaaatttttaaagcgtatattgaaaatcactgggctctgactgggtccagtggctcacacctgtaatcccagcactttgggaggccaaagtgggtgtatcacaaggtcaggagatcgagaccatcctggttaacatggtgaaaccccgtctccactaaaaaatacaaaaaaattagctgggcgtggtggcgggcacctgtagtcccacctgctcgggaggctgaggcaggagaatggcgtgaacctgggaggcagagcttgcattgagccgagatcatgccactgcactccagcttgggcaatagagcgagactccatctcaaataaataaataggaaaatcacttggctccaaagacccagtcatctgtaacatctaatcatgcaaaggtggaagagaatttgtaattaagggaggagatccaagatcagcttccatcctagtctttctcctctggcaactcctgagattgtgtgtattggctgagggtgtgtgtggggagaagcaggtgtgggaatctttaaatatggtctgctttccccctaactcacttgagaaccgaaggaagacctggctgtgccttatctgaattgttgatgagccatcctctattaattcaaagggagccctctgacaggattaacaataaacagccttgtactgtccttaaaagaaaataaggctcttgagtttagaacagatcccaacactcagagcctgacttcacaacaaacagcaaacatccaagcatttgctgctgcttcctgggaaggccagcactatcaggtgtctgatcaaatgggattagttggtctctctgagagcagtgaggttaaggaaatgtcattggcatcagtatcttcggtgtcagtctcagcaaatccagtatggacttaatctccttatccagaaagcatacagagaaaaattggtgtagaataagcaaacagttagcaaaactggaaaagagaaaaggactttgtctaaaaagacctatttcatttaattaaagtctcatgaagaaagaggaaaaaaaaaaacttacaatggtgatcatctttttttcttttttcttttttttttttttttttttttttttgatacagggtttctctctgttgcccaggctggcgtgcagtggcacaatctcagctcactgcaagctccgcttcccagggtcaagcaattctcgtgcatcagcctcccaagtagctgggattagaggcacacaccaccatgcctggctaatttttctatttttagtagagatagggtttctccatgttggctaggctggtcttgaactcctggcctcaagtaatccatctacctcggcctcccaaagtgctgggattacaggtgtcatccaccatgcccggcctagtggttatcttaataatgatcactatggtatgaaggaagtttctgagtttattttatacttgtgtcactaataataggtcatctaagtcaaatttttaaaaagaaatgtcctgcacatagtgtcagactaggaaggctggagtgttttcttatcagtctattcaaatattagaaattttcctgagtatatccttgaaatctcaaatccttatcattggaagttatcattgtttgcatatgttttatgggattcttaaggaatttaaaaacttggcatcctcatgaaaagaaataaagtactgataagtactacagtatggatgaaccttgaaaacatgctaagtgaaagaagccagtcacaaaagattacatattatataatctcatttgtgtgaaagatctagaataggcaaatccatagagacaacaagtaggttagtagttaacaagggcttgggaaacagagaaatgggaagtgaccacctaatggtatgggattcctttttgaaaatgatgaaaatgtgctagaattagatactgctgctgattgcacatccttatgaatggaataaaaaaatcactgaattgtacactttaaaatgatgaaaattatatgtcaatcttaataatgccattataaaaataaaccattagagaaaactttcagtggaagataataaaaacttacagaaaatatgtttttatactcttaagaaaattaaagggaacagaaattcagttctctaattttctacattgtatcaaaacctatatgactggttttttttttgttttttgttttttagacggagtctcgctctgtcgcccaggctggagtgcagtggcgcaatctcggctcactgcaagctcggcctcccgggttcacgccattctcctgcctcaacctcccaagtagctgggactacaggtgcccgctaccacgcccggctaattttttgtatttttagtagagacggggtttcaccgtgttagccaggatggtctcgatctcctgacctcatgatccgcccgcctcggcctcccaaagtgctgggattacaggcgtgagccaccgcgcccggcccaaaacctatatgactgttaaatagaatttatcaaacatttattgattaccttttatgtgctggagagttagcagatgcaacctcttccctcagaggctaaaagagttttcaaaagatatatgtttatagcgtgaacaaggatggtagtaatctttgcttccgtgtatttcctgtgctttctctgtgaacgtattcactaatcatttttccgtttctatatatactagaaataatgccaaagtataagaaaatagaatgagaaaacataaaaatcttaaaatgtatgtgttttaaatgtaaatcacacactgaaatctggatcttcaatttgttatgccacttcgacttattttttaatcataatagtaactttgtgacaaaaattatgacaagtggtaagaattagcagaagatactggattccatctcaacttttattattttagaatttgtcttcagtgggagcatgtcaaggaaccaaactaaaaggctgtataagttaatctttcattatctacaagattttgagtgatatcatccacttaactcttcccttaatgataacctctcccagacatttttaaagaagagatgagacatgggagggttgggggagacatcagtaattcacatacatccttttcgtatttaaatgaaaagtttcccatttatcacaagtaatatagaaaatggccctgatttcactttgggcagttgcagacatgcccctgttttgatgattatttcatgaaataaatttggctgggtttttcagaaacactgagaaagaagaaataagcaagcaattccacatttcccagcagaggcagttgtttttccaggtccctgacatcaatagtacccatatatttctatcatattctatcatgtagatcatgttatataccacatatgtctatcattttaaatcaactccagctttgcctgagcttcccattcctctcagctgctcctgatcccagcatggctcacagacacagcctgttctgagctcatgctcctctaagaccctttgcatccctcataagatccacctgatttagtaccttatctttcaaggcttactttagatcgccatgtcttttctacccaaattatttcataatatccttgtgagatgcagtcatttcatacatttctaaatgtctgtataataagtaatacaaataatataacatctaattgttataatgtttactaaatgccaagcaccattcttaagactctacacttactaactcatttatcctcatgacagtctattgtcttagtccattttttgttgctataacagaataccacagacttgtaatttataaagaaaaaaatttcttatagttcaggaggctgggaagtccaaggttgaggggctgcatctggtgagggccttgtcaagatggcggaggacatcatatggtgagaacaagagtatgcatgtccagttcaggtctttctcctcttcttataaagccaccaatcccattgtggaggccataccctgatgatcttatctaatcattaatccctgccaaggaccctaccttcaaattccatcaacatatgaatttggagattaagtttctaacatataaaattaggggggcatattcaaaccatagcaactatgatatgagtaagtactattattagcctaattttacagataagagatctgcaatacagagaatttaagtaaacttacctaaggttaattagctagtatggggcaggcctggaatttgaacctaagcaatctagcccttaaccactgtcctgtcctgccacaatgcaatgtttctctcttaacacactcttaggtgctccaaaaatgcaaaaatagtaagacataagtatatattagtacactacaaagtaagtacggtgacagcatgacctggtctagcgaaaaaaatatgaacttggggttagacaactgatgggagctttgtgacctttggcaaggtattttcatttttagggtcttcaaaaaatcaaatttttcagattttcacagatttcctcatctgtaaaataaagaaaaacattcgatagtacttctttctagggttgttgtgtatattaaatgagacaaaagatatgaaatacctgtgaatgtccttcttttaatacaaattatctcatgtctcctcttgacacccctgtgatggaggcagtggaggtattgtatccaccgcacagatgaggagataagttcattaaggataaggcacattctcagtatcagctctcatgaaagtgggtgtagaagagtgagagtggggccttgtcttctcattcctgatgaaatgtgcttcccactagacatatgctaaggacaggactgaaataaagttataaccaggatagaatttctccccctacccaattcattattaaaatttttctgtacatttctaagccagttttatagtttaggaagtactgtaaaaagtcatctttatttttggagttagatgaccttttaagagttattctaaagtatatcatatgatataatgtaacatataataccatatattactgtagagcggtgtgatgaagttgtaaaggaatatattgaatttttacaaatcataagtgatcttagtttgttctgggtgatttgcttctctttttcctaaaagtagaaggcaaaatcttttctaaattggaattttatcctctaacttcagttgtaggggccttccaggagtaggttagagactaaaaaccttgtctgaaaatcgaggtggaaggagatcctcatggaagaaagtgaataaactacaaaagaaaaaagggctagaaatggtattatacataagaacaaaaatccacacattagaggatatagcagtgatccatgttgttttcttaagtacttaattaatttattggcctagaaatttgagagaattaaacttgctgtgtactgtaattttgctcagtcaaatttctgaatatttatccaggtctcattaatgctttatataaatgtatgtatagccgattccctttgttgtttataaaatgcatctgcgtatacatgtgattccctttttgtctttatccaccatttttcaaaaaggattaaggagaagtaaatactagagaaaaaaaagtattggttaatcatatgtatacttaagttttttagagtgaataaatattaccttgagtagtttgatgggaaagttaagttaaataagatgctattgtgccggtgatgaaaatagtggtttataaataaacccaaagagtttagtgaaatagaaggggtagtacctgggagttgggaaacctggggtcttggccaagcaccaagctctgtgactccatgtaaatcacttagcctcctccctggtctcttccttacctgtaatataggtgattagactgaatgaactcagaggtctttcagaaacttcccaaatgctaatgtattctataacattttgaatgaacaggaaaaaatttatttggtacaagaacaaacattgtattaagaaactaatatatataaaattacaatcgtatttacttttttgtttgaactaaatcaggtcaaattcaaaactccaggttgaatttgtttttatctaaatgttaattcatgcttcttctcacaaagtgcatatagatctttaattctagccatacttaatattctaccttaatgggaaaaaaaatcatcatatttttaggtgcaggatattctcaggttccttcaaagtttacatattagggaagttaatggctaagttaaacctctctggggcattcagagtatagaaagcaagggatgagagttgaaacagatggtggtagtgggctgcaaataggcaatattaaaatacaaccatctttccactgtacaaatgtacatgtagaaattttttagaaaagcatgaagaagcaaaaagtcatctataatctcattactgaaagaaattgttaacgtttggattaatatctcaccaggcatggtggctcatgcctataatcccagcacactgggaggccaaggtgggcgatcacttgacgtcagaagttcaagaccagcctggccaacgtgatgaaacctcgtctctgctaaaaatacaaaaattatttgggcatggtggtgagcacctgtaatcccagctactcaggaggctgaggtggcagaatcacttgaacctgggagatggaggttgcagtgaactgagattgtgctactgcactccagcctgggcaacagcaagaccgtctcaaaaaaaattgactgggtgtggtggctcacccctgtaatcccagcactttgggaggccgaggcaggtggatcacctgaggttggcagttccagaccagcctgaccaacatggagaaacctcgtctctactaaaaatacaaaattagctgggtgtggtggcacatgcctgtaatcccagctactcgggaggctgaggcaggagaattgcttgaacccaggaggcagaggttgtggtgagccgaaatcatgccattgcactccagcctgggcagcaagagcgaaactctatctcaaaaagaaaaaaaaatatatatatatatatatatatatatgtgtgtgtgtatatatatgtgtatatgtatatatatgtgtgtatatatatgtgtgtatatatatatgtgtatatatatgtgtgtgtgtatatatatgtgtatatatgtatatatatgtgtatatatgtatatatatgtgtatatatatgtatatatatgtgtgtatatatatgtatttatgtgtgtgtatatatagtgtatatatgtatatatatgtatatatgtgtatatatgtatatatatgtgtatatatatgtgtatatatgtgtatatattcacacatacatatatatttggatcaatatattttagaatgcatatatatttatgtataaaaatttatcttatttttcatagtttgatatctttaataatacatccatgttttccatgtcattaacttatcacagtataccttcaaatatggtatgagcctgacaacagtatagttccagtttctccttttcatctatgtgtggttgttgtcatacgttttacttttgcatatattataaaccccacaatttgttgtttttgtctttactttggaccatccgttatctcttttacttaccttcattttttgccatttccagagcccttcatttcttggtgcaggcctaagtttctgtttactgtcatattcctactatctgaagaactgaacattttatgtattgcaggtctgctgatgatgaattctcttagcttttgtttaccttaaaaagtctttattactccttgaaggtattttcatttggtgtagaattcttatttgacagtcagtatttaaagatgtcacttctttttttctggattgcataatttctgatgaggaggccactctacctattatctttgttctctgtatgagatgtgtcttttttccttgggctaccatcgagattgttcctttatatttcattttcagcaatttgactattgtgtctagttggagtttgtttattgtttatcttgcttggcatctcctgagctttctggatttgtatttttctgcctttcatcactccaagaaaattcttgaccattcattatctcttcaagtatgtcttctgtcccattctatctcttctccttatgcagctctcattagctgttttgtatcatcccacagctcttggaggctctgttctttcttttccactcttttttctccttaatgtttttattttaaataacttaaagtgacatatctgtaagttcaatggatcctgcctcaactgtgtgaagtctattgaggagcccacaaagcaatttactctgatattgcaatttttcttatcaaatgtttccatttgactctttgctaagaatcccatgcctttgctgcacttccctatttttcatgcatgttgttcctactagatagaacactggatattgtgtgtaggaggggagagattgagttaaataatatttttacctggaaatgagcatactcatactttttcttctgtgctgcaaatgtgagaggtggagcctgttttggcaggagttgagctgagtttacattttgtttcaggcttcagattcctcagtggaaggctgccattgctttctgcttggggtggagtctggggcatcagagaattttgcttagtgttagtgctccaccctgagctttctctgcacacctgcagcacagaggaggtctccccacactcctgccttacctcagcagttgactactcttgcttgttactctgtgctaggctagtgctaggggttgggggtctttcatgtaagctcagactcagtctttagggtgtgtgtctgggttcaaggctgtgtctttctccacattcctgccctttccaccacagcagccaaactctgccctgtatgtatggtgacggatttgaaggctctttgtacagactgccaaattgcattctagcaagcatgtacaaatttacatttcaccagcagtaaatgagggttctcttaggcaggctttcgagctctaacatcactgagtttctttgatatgttgggatttcttaactctgttgcttgcttagacagtggaagtgcagctcacagcgttactcatagtagggcatgatacatttttattggttagctgaggaatcaaaatatgagtagtccgttgagtggccctgaggtaccactttcattttgatttgtttctacttcacagaggcatctacgatatgattcaggagtaaaaagtgattgcattttattggaagctgcatttgacagagatgagaagctagggtttttaaacaaacgtcttctgaatcctgcctgaaaataccacagcctgagggtctagagcccaaattctgatcctgattctgcctctgattagctgtttcttaatctgcaaattaccagttctgtgcctcactttctttatccaatagggttaatgatatttatcctatttcagtggattgctgtgagggtaaaatgaaattacagaagttcaggtcctttacaacgctgtttaagtgctgtagaatataaagtatttctctaggaagggccagagaggtggagaaaatgtgagaattagaaactcaaggcacaccagcatggcacatgtatacctatgtaactaacctgcacattgtgcacatgtaccctaaaacttaaagtataataataataaaattaaattaaatttaaaaaaaagagaaaaaaaagaaactcaaggcacctttttgtcatctacacatccacagtatgagagagtgcatgaatatggaagagagtgaaattagaaacagacttcttcctcttactaaacttagcctgtttgtgataaaggttaattaagtctttctcaaccagtgagggcatagttttaaagggaaatggcatgccagcccttactcacactgggaagtgatgaggtcttcgtgtcacgtcccacttggggctcagtgagctctcctattggtcggtgtttcctttattcccaacctgaccctccatctgctgtctcagctctagaattcatccactgtgccgcttgggtcactagagcaatacacacttgtactcagaaaacagacataagcagatctgaaagtcgtcatgaaatttatttccttctgccagctttcactcaaaccaaatagtcctccacaccaaaaaagaccacagcgtgcccaaaggcacagcctatagtttcacttcctcttttgtaacctgttatacacagtcgaaagctgtgcagctgcaagctggtaggtctggagcaggggtcagcaaaccactgcccacaggccaaatccagcgcactgcctgtttttataaataaagttttagaaacacaaccgctcccatttctttacatattgcatgtgcctatggctgcctttgtgctgcaatggcagagttcagtagatgcaagagactgtatggcctgcaaagcagaatatatttgccatgtggccctttgcggacaaagtttgcctataccctgggtaacagcaatattggtctgtttactttccaccagcattactaagagaaatttgttttcctcaggtctctttcttctttcatttaagatttatattttagcatctaagaatagtgagcaaagagaatgtgcaacctttccatctgtggaaaggttgtaaacctaaccctaaccatacaaccattaaaagcatttaactagaaaagtttacataaaatacagggagaaaaggacatgttaaacaactccccatgaggactcaatcagtcaaatccaggtgtggaagagtctacacaataaattacccagtttcttcaataaataaatgaacacggggggaaaaaggtgggatagaggagctgtggagattaagaaagacttaaaggactcaacctaatgcaatatgtcgaccctccaacttgagcaaactaatggagatagttggagataatgggagaatttgaacatggagggggtcttgggtgctataaaggaattatttttactttcttcattatgataatggtatcgtgattttttgagatgtcctcatctgttagagataattaaattgcagtatttatgggtaaaataacatgatgccaagaattttctttctcctcttcttaaactccttcagaaagaaaaaaaaacagtagggagcataaaagaaataatattggctaaaggttgatgtttactgaaccagggtaaggagcacttgaagttcattatgtttttttgcccaaactttgtgtatgttggaacttttcattattgtgttttttaaaatcatgcattcaagagtttaagtgttgaagagttgaatcctggttctgccaactgtttctgcatgtgtaaaatggggattgtaattcagattatgtatgatgatatgaggattgtgagaattaaatgaagtagtaaagagtttagcatagtccctgacatgcaggaagtgatcaatacttgatagctactatattgtttctgttatcgaattataaatacataatccctgtgagcctagttcatttatgatgtaattgattctttgtgaacagcagaacttaaactcatattgctgctacacaagaataagaagccaggcatggtggtgcacacctgtagttccagctacttgggaggctgaggcgagaggatcgttggagctcgggaatttgagaccagcctaagcaatataacgagactctgtcacttaaaaagaaaaaaaaaaaaaaaaaaaaaaaaaacaagaaatcagggaattgtttttgatgtatgcgtacatttccttgacagtctggaaataatcatagcgcctgtaagatgcttggagagaagaataactatggtagcctaccactgaaatcaaggagaacacaattagaatttcagataatcctaacaatctggttattcttcaaatatttgtcaaataagcattacagttttcatgagactgctaacaaatgcctgtaaacacatttaagcaccacgggcatgggatgttatgtgactatgtatagaagtaacagattttccagtttgagttcctattgtctctccttgacaacctgatgctcccactggaacctgggaaaggctccaagtcacatgacactcttttaaactgagtctgtactgacttaatcagctacttgttagtcaaccactcactagccagtatgtatcactcaaattatagaaaaatacattgacttaaaaatgcaggacttttgagcaaaaaaacaaattatcacttcatccatcagtcacctcaagtgattgaaataaattaacttggaccctgcctcacagattcccttacaattcattcctttttaaagtctccttctgaagaaaattcctgtcagaagtattaggaagcacactgttcataaaggatgtttagaaaaggagagggggaaatggggatatgttgggggaagtttagaaaggaacgttttgttgaaaccaaaaatatcaaatctgtactttttcctcttcttcccagaatgacatcactcctttacatgttgcatcaaaaagaggaaatgcaaatatggtaaaactattgctcgatcgaggagctaaaatcgatgccaaaaccagggtaagtgtgcaacttatgtacctgcttctacttgtattcaggaagtaggaatacttttcctgatacctttgcactgatacaacatgagctttgttttctgttctatttgttatagtctcttggaaaatgactgctacttttattctttttaaaatggtatggccatccatctatatttataaatacttaattcacagttaaatggtacctggctttaaaagttctagagttcttgttgcatttaattttcaagacactgtaagctaagctgttcggtcagtttgatactaaaactgcaagttattctatttagaaacaaatctgtctactcttgtgcactgctggtagaaatgtaaaatgatgtgactgctatggaaaacagtgtggagcttcctcaaaaaaaattaaaaatagagctaacatatgatccagcaatctcacttctgggtatatgtccaaaataattgaaagcaggatctcaaaatatttgcataaccatgttcatagcagcaataggcaagaggtaaaagcagcccaaatgttcatggacagatgaatgaatttaaaaattttaaaatacaatggaatattattcggcccttagaaggaaatcttgttgcatgctacagcattgatgaaccttgaggacattatgctgaggtgaaatataccagtcacaaaaggacaaatactgtatgattccacttatctgagacatctagaatagtgaaaatcatggaaacagaaagtagtatggtagttggcagggactgggggtagaggaaatagttatttgatgggtatagagttttagttctgcaagatgaaaaagttctagagatctgttacacaacagtgtgaatgtggttaacattattgaagtgtctgcttatggattgtgagggtaaattttatgttgtatgtattttaccacaattaaaaatttttaaaggctgggcccactggcttacaactataatcccagcatttttagaggccaaggcaggaggatcacgtgagtccaggagtttgggaccagcctgggcagcacagcaaaacctccatctctaccaataaaagagaacaaaattaactggtagtggtggcatgcacttatagtcttggctgtacaacaggctgaggcaggaggatcgcttgagcccaggagttcaaggctacagtaggctttgatcacacctcagcaacagagtgagaccctgtctctaaaacaaaacaaaacaacattttttaattaaaaaattataaaaacccacaaatatgtctaatctaggtgtttatgtcatgttgcttctttggagtgatgcattgtgggtaggggaaaaaaccaagacttagaatttgatttgaatccaaattctaaacttagctagctgacttaggtaggctatttaactttactgattgtcctttctctatctgaaaataaagaaaattaatggccaccttgtagggttgttgcaaagatcaagataatgtttgtaaactgtgctggcataaagtagggcagaaataaattctagccactgctagtatatctcagagctccagttagtattaaagttctagccacgggttttcttattcaatatttcttgtgcaagaagcaatctaatcaaaagatggtctcacgacaaacatccatctatcgaagggttttaagtagttttcttgtaactgcaactcctgcaatcctgtgcttccttcttctaaaaattctgattccatgatcctaaaactggcctggtaacctcagcttaatttctgtagtgctttgatttactacttcattttttattccttgcatttatttactcaaccaatagatgatcgtcgagtgtctactgtgggccagacatagcaggtgacagagcaagacaccacaacacttcccctgcccttatgaaacaaaaggtctagtttgtattctgtactttgaccctaagacagcccagccataggcaggagacctagacttctttttcttgattaccattgaacctggaaaccatgtatgtaccttaaaagaaacaaactttctaaataggaaaagggaagaaaggaaggccgacccctaaatgactgtcttactggagaggtaaattgaatataggtcttactgaactgattttgcatcattccagtaagaagcaattatcagtatgtaaagaatgctagaaccattgctttaaatggcaggggtcttctgccatttaaaaagcgcaggctatttaaggagttgtaaggaataaaaagtagagatgcattgcatctgttgcctgattatcacatggagaaaaaggaacatttgtaaagaggaggaatctttgcaaagggaaatgagggttaccaagacacgcagaaaagagaagcttgaagaggtgcccggatatacagatttcagttggcatatggattggaaattaccttatttctctctctggtgatatagtcaatcaacagaacagcaaaatgatttgtcagtcatttttcatcatttgtcaaacacttacatgtcctatttcgttcaatgggaggagaaaaggatacataggaagttcaggccccatctttagagggcatagagggtcacaggggagggccaggagaaaaacatacaaattcctctgatgaaagtaccaaatataggaaataatctacataggcaaagtttggtgtgcaacttggtttctgtgccactttgcctccctgttccgaagggctgtcttattttcgacaaagatacagattcctttgtacctcccactcagttttgacttggatttacattcctcctgtattatgtgaaggaaagacatggagaaccagagaacagaaaagcctgacattttcttctgcagttgtcctgaatggaatgggttgggggaagggtgtcagttgggcagactgaatttctggcagactaaatgggagaaattatagtatatacctgaaatatgtaaactgttttgtgttctcttcatcaaaatgtcccttctctcctgctgaaatgatgaagtagtgattgggtgtgtgggtgaaagggaaggagcgggctaaaatgtcagaaagccatgggggcaagcctaaaaatagaaaggagaatttgtcacaaaaacaagttctaactacccagtccggtagcccctgagaaaatagataccgttatctatccatctgcctcccaccaagtacttactattgtggcaaccttgcttgcattcaataaatctgatctggtacacacttatcccccgtgttttagaggcaggaaagcatcactggatttcacctcagaggacagcactgtaagggaccttgttcctattgctctgtgccctgcctgggtgctcacagaatagaggattcagtttaaaagaagattcttagagctctttcattcaaggatgtaaacttgaattgtgttcagtgtaatttaggtaggatcagagcaagatattaccagctggaaaggcagatgagtgaatttaatttcaccctagtgcctgatctgtaatcttaagtgtgactagcaagtagtgaaattgtgacctgagaaaagttcacccttctgagtcatagttttccagccagtacagatagaaagttgttcctgaagatctcactctctcagctggaagggcactggaaattgtaactttaagaataattagttattgtaaaatttaggatgattgcacatgaatcttcttagaggtgtttagctaggatatgatgaattacagacccttcaggtttctttttttttttttttttaagatggagtctcgctctgtcagtcgcccagtctggagtgcagtggcgcaatctcggctcactgcaagctccacctcctgggttcaagccattctcctgcctcagcctcctgagtagctgggactacaggtgcccgccaccacgcccggctaatttttgtatttttagtagagatggggtttcaccgtgttagccaggatggtcttgatctcctgacctcgtgatctgcccatctcagcctctcaaagtgctgggattacaggcgtgagccaccgcacccagcccccaaacccttcatgtttctatttacctcatttcaggaaagtctttcccattttcccagctccataatgctaattaatatcaactggcttgttaactcatgttcctgttgatagtaagtatatagagaatctctgtcatagtggtgggacatgtgctgagatataaacacctatcaaggcatatttgtcaatctggtctatatgcagctttctaattttaaaatgatttatgtagttcattttttcaacaagatcacaatggcttcgtttctttatagactaaaatgttttgctgagaatggcccctatttctttccactgaattcttccctctttaaagctagcgtgagtatttggtacatgttgaaggaagatactttgcagtggatggtctcttgtcatttttagtttgctctgcatcaattcacagaccaatcagagactcaatatagaccctaaatccgaaccattttgagacttgagttctctatctcttttcactgactcctctccatctaataataaaagcagctatacttgtatttagtgcttcagagaagatgcagaatccccggtagtgttggtaataacaatactctcattgccagaatgttactctaactgtgcccctcccaacttctagcctttctagcgagttgccactgcctgcatcctcagagaaacccattaccacagtattatttgcaaagctacaccttaactctaagatgcacgtggtcatcttagtgtctgccacacttagcatacttagcacacttcctggtgcatattaaatgcctaataagtgtttgctgaatatattgaaataagatatacttcttaatattacatttgtcaaaacatcttaatttacttgactttatactggtcctatggtaacgtaatttttccactgaagttaatggcatccggtttatgtacaagaataaagaagtatttatgctcaggtagatgaagtgttttcaaggcacttccaatctgtcaattgttaaatttttactgcctgggaaggtgtcaggggacatttggatgtactataatttcagcccatgctttcccagaaatgtaactgattctgtttctcaggttaaatactaagaaaaaagaattattgatactgacttttgcttttgattatatttcaagggatgtgattgtccaaagttaaaaataaatccttgaataaaatattaaatatttcaaagtcatagaatagtctctctgaaaaagaaattctaaaacagtacttcctccttgagttctaaaatagatatgttgacaagaacattagaaatagtgaagaagaccctgggtttctatattagttgaaactagcctgaaaatgtttcttcatgtcatataaaaatatatcaattttttcatttttatgtcaaaaaattacaagttaattgaaaatatttatttagattaaaagaaggaccagtaatcatgaaatgccactagctttcaaaacacgagagaatatctttgaaggaaagaatgttttttacagttgcaaagcattctgagaacatggagggagcatcttttgttttatttttctccctctcctaaagtttttacactacattgtaaacctcatttcccttgccaaattagagatctaaaagtattatggcaaaaatcacaattgttgttgcaccaacctaataaatgtcgtatgcctggttctgttgaagagtcaacaaaataggctcaggacagttttattttagataattgctatgtggttccaagtgctaatggtcagaatgttgtctgctttttctcctactgtttcttaatgtatgttggtaatgctcacatctaatttttttttaaatagctctacatcagttagacacaaaattaccctatagctgtcaactataaccatctttaattaccctccttcctcaaaggaaagataaagataaaagaagttattagtgttttgtaaattatgaatactaaattgtttcaaacatgtaacatcttataagaagcatataaaagcacctttgtatgtttgaaatcttttttttttttttttttggagacacagtctcactctgttgcccaggctggagtgtagtggcgcaatctcagctcactgcaacctccgtctcccaggttcaagtgagtctcgtacctgtctcctgagtagctgggattacaggcacacgccacctcgcctagctaatttttgtatttttaatagagacggggtttcaccatattggccaggctggtctcgaactcttgacctcgtgatccgcccacctcggcctcccaaagtgcaggattacaggcatgagccactgcacctggccaaaatcatattttatagtaggttattcagtatctaccaactggaaagtcaagaattctctcatgtattcatagaagaaatattcgtaagtggtgcatgatagaaagaaatacaaactatgatggcgtaatatgcagaggtcacatatcctatttttattcaaatatatgagagttctggcattaagttatgatggaatagcatgcattggactaagccttctgctgggaaaagtcatcagctctggacaaaaccaagctgctgtaagttccaaattatttataacatatcatacataatacccagtatgtaattttaaaattactaaacaaagtcaactggaaaatatgaccgacagtcaaaagaaaagttagataatagaaacaaacccacagatgactccactgttgaaatttgctgaatttaaaataactaagataaatatgttaagctataggagaaacgagtataatgcgggggaaagaaccagatggaaatcctaagattgaaaaacacagtatcagaaatattttaaaaatcattacatgggataaataacagattgaatacaaaggaagaaaaaaattggaggacttgaacacaagtcatagaaatcatccatactaaagcacagaaagaaaaaagattaaaaataaaatacactgctatgtcagtaacctgtggaataatagcaagtcgactaaatctatacaatgtagtccaacaggcaaaggagaaagagaatggggcataaaataagtttatatttacttccaaatttgatcataaactgcagcactcaaatcaaggaatcttagcctaccccaaagaggataaatacaaagaaaaccacacagagtcatatcacacaaagagtcaaaaaatcaaaaagaaaaaaatttaagtagccagagaaaaagacatatcatgaatgggaaagacaattataagaatgttatctgacttctcatcagaaacactgaaggtcagaaaatgatgggccacctttaaagttctgaatgaaaaatatctagcaatctacttacatagattgatataaatatctagtaaaaaaggtatttatatctactaaaaattatatttacataataaaagcaaaacaaagactgtttcatacaagcgaaagctgacataactttgttaccatcaggcccagacgaactaaaatactgaagaaatttcttccatctaagggaaatgataccaaaaagaaaactggatctacataaaggaaagaacagctaggagtaggaaatatgtggatacaataaaatattattcttcttaagttctttaaaagtcaattgttgaagcaaaatatcaatctattgtgaggtctatgatatgtaatagtatgtagaaataaaatatatgctatagcacaaaagataaaactaacagtgtaaatataattataatatggcagaattcttgttatacataaagtggtatattaattcagtatatatgtaatattaatattactttataatatactatttatataatgaatactatgtattatatatactatataatatagtatattatgttatactatattatactataatttattatgatatattatctatactatatataatatatagtgacttttgcttttgattatatatagtatatatacatagtatatatacatatactatgtatatatactatagtatatatactatgtatatatactatagtatatatactatgtatatatactatagtatatgtatatatatagtatatatactatgtatatatactatattttatagtatgttatatattatatgttgtatagtatgttatatatgttatactatattatactataatttattctataatttactatattatatagtattacatatactatataatatagtatatatacatagtatatatagtattacatatactatataatatagcatatatacatagtatatatagtattacatatactatataatatagtatatatacatagtatatatagtattacatatactatataatatagtatatatacatagtatatatagtattacatatataatactatatattaccacatatagtatataatatataatatatattacagtaaatactatttagatatatactatatcctctatattatatataatatatactatatacactctctattatatataatatatatgatatacaattatcttattacattataggaattacaatttgtaatattataatattcacactagtaagttaaagatacacattttaatttataaaacaactatccccccaaaaaaaattaactaaaaaaatcagaagacagccaatgatatatataatgtttcaatgattagtatactaaataattccagcacaaaaggagacaagcaacgagggacaataaacacaaagaacagagtggaaaactacaatacaaataacataagggtgtgttctagtctcagaatgaaggctgtagttttccaagtagagaggacacaaaaggattttaccttattttcatttaaacatataggcggtatggcagtagaacaaggaagctaattaatgtattttccctcctatatataaaaggcagaaatgaactcttaatcttaaatagaacattgactgcttatattttttgaagaggttgcttggcatagtagaaggaacccagtccttccaagggaggcaatcctgaatgtaaattctaattctatctatttactctatgtacttgccatgtgaccttgagtaggtatatgaatcccctggagaagttttctcatctataaatgtagctactgatgcttttctcatagaattgctgcaaagattaaataagatcacaattataatgtgcctatatcatagaggacattcaaaaaattttatttcacctcttaggctatctcgataactgcctaacacaaaaaaaatgaggacacagtccaaatttttggtgaaaatgccaatatggaatagctttgctggctgggtgcggtggctcatgcctgtaatcctagcacttttggaagctgacgtgagaggattgcttgaggccaggagtttgagaccagcctggccaacttggtgaaaccccatctctacaaaaaatgtaaaaataactggaaatggtggggcatgcctgtaatcccagctacttgggaggctgatgcatgagagttgcttgaacccagaaggcagaggtgacagtgagctgagattgtgccattacactccagcctgggtgacaacaagactttgtctcaaaaaaaaagaaaaaaaaaagaaagaaaaagaaaaaaagaaaagaaaagagcttagctattagactgtaagtgatgccctttagtttatctttcactatcatcatagctctcttctcttgaaggactctctacatttttttcattgttttcagtttttaattaaagattatatcctgttctacagccatgatctatctgcagagttctctctgcttgaattccttttctttctctagagtgaggagtttgtatttatttatttattttgctggtgaaaaagaaaagaaagagtatcctaaaggatacaaatcaaaataaatatgtctcttcttgaaaatatttcccaaaccacgaatttgtgtcacttcagtgacactgagcaaatttgacctgctaaagacacattctggtttcatagtcctaggtgtgatgccttaacatcctgcttcatgcttttcagaaaaatcagaccggaaagtcttttgaccttcgcatgtacaaggatttgctcttaggctaacatgagagcattctgtccggcgagtaacgtgcagttcccctcctcactaataagattactgtcactaaaatgaaatatgagatctggactagccagtttgtgttgctttagaattctgcccaagggaaacttgttcattatgtgagtgctttaaaaatcaagggaattggaaaatattactaaccccatgcaatttcatttcccttccgtaatgttactatggcaactcagcatccctctcattctctcctgtccaactgcatatgttgcctttcttgaggcaccccctccctcaatcccccgaaattgcctttgtctagcatttttcaactggagatcaacactattctatgcagttgaaaaactgctttttggtctccagctcattctaagtgactttgttcattaattatacatttctaggggttggaggcaagtaagaatccttattccgcttcaaaaaaaaaaaagcgtggctctaattttagggaaatgaatatgccagttctctgctacattgcaaagcacagtatcaaccatagctcttttattacgcttattagtattctgagtagaaaaaggaaatcttatttagaacaaattctgaaagctaagagacttagtcacatccttaaatcaaatcccaatttacaagtcacttattctatcgagaattttacttttctggaaaaataaggtattttaatagtgctactgaagtagacaaaatgagtctactcttaaacaaaaaggataacaaggaaaataattttaaacaactaactagaaaatattttttttcactagcctgaaaacacattcattcactcactccattcattcatttactcagtaatttttattaggcaactttcatggacatagtactaagttacctcctctgtaagattcatttatcccttaagctggtaatcttgtcctcagagataaactagtgttaaattaaaaaattattcatgatacttgtaagaaaacagtaaagctgactttatccaaagggggctactacaaaggaattttatagtagtaaagagatctagctcaactctgaatacagcaaggaaaggtgggaatttatagccaaggagtagggttgaggtcagtaaatagaaaattactaagaggaaatgtcaagggtaggggcacttctggctaaactgacttgacaagattattgccaaaggcaggtcagattgataagagtggcagggtgggagataaggaatttgatctaatagaaagggttgggattttcattaaactgatccagtaggagtcttgctaaaactgaactaagcagacactaacatatggaaagccaaaagtctagatgagaagagaattcagagaagcttgactagagttaagtcaaggaagagcatctttgtcactggaaatattcatgtgtgcccacaggtaaagaaaatactaggtaaaaagttacaggtcccccaaaagaggtatagaaaataagacaggagtctggaaggtagaaagattccatttaatttgtgaaaagatttcaaagaaatgctctgctctaagatagtaaggatcctgtaggaagtgggaaaggaactctcaggtacatgaaatggcgtgggcaagacagtaaaacaacggagggactcttatcagaagctgcagagagtttgttaattgcagtataagttaagggaatcaggaaaggccaagttggaccaagtatagcaggaactgattttagacgactttgaatgctaacttgaagaatttagacttgactgaggagtaactgtgaatgacagttagtgaagatcattttgaacagaatggcatcctaaatcagaaccgtgtgtcaggaaagtgagtgataggccacaccagcttcaaagccaaagaaatgagttcaaaatttatttttttaaccaaaaagtggagtgaagtggaacaaatgcctgctagttttcctcctcttttttttttttttaactgaattaagtgtgaatcattaaatggcaggtacttttcagtcccactgtggatcagctggtcttgcccatcttcatgactgcaagaactgtgatgctaattaaagatcttacattcaccctaggcactcgttttccactgacctgtcaatgtcccagcagctgggccagcgctgcctgtgcagccaggcagtcgcatcattgatatcttgtgcagcttcctgatgaggcatccctcctgcagcaattttggctacttgaagagctacatgcctttgaaaagagctagactgaatctgtagaagatccaaaggagactgacacttgaagtcagtgttcagaatactacaaggaaaactacagttgaaagagttgtgcttcaggtagctctttgcagttcagctagaactgatgagttgtaccttggggaaacagctgactttgtcatggaagcaaggtgattaaaggaacaatggctaaagaatataatacttcacagctcttccactggtgaaatgtcacctttccctactgagtctttagatgccacatgttgttagtaaacaaacatcagagatcagaggtagcagcttctgaatgtagctaagggaaggctaagagtggctgcaagtgtgagcacagggactttgccttagtaacccctctgaagacatgccttgattgtcttgtagagccagcactcatagtccaagcctcgttctaaatttggtgcgtgcagccttgaatgagtaatttcacttctttgaaccttggaatctctatttatcaaatcaatattatactcttatagcactaatcatgaggatataataatatgatgtcttggatttgcttcaaaataatacaagaaaagggtttgacttttggtcagtatatagatgagtcatgactgaccatggggtgacaattgtggaagctgagttaggtacccagaggttcgttataatattctgtctatgttaatctgcaatatgtctgacattttttataattaaaacttcttttgaaaagacaaaaatcaggccaggcacgatggctcacgcctgtaatcccagcactttgggagactgaggtgggaggatcacctgaggtcaggaagtcgagaccagcctggccaacatggtgaaactcagtctctactaaaaatacaaaaattagccaggcgtggtggcaggcgcctgtaatcccagctgctcaggaggctgaagcaagagaatcgcttgaacccagaaggcggaggttgcagtgagctgagatcacactattgctctccaccctgagcaataaagcgagactccatctcaaaaaaaaaaaaaggcaaaatcaacaaaaaatatgtatctgtaagaagaaacagtatacctcaaaggattaaggagttgatggatgagatagattttgctcttagccaaacactttgcattcagtatgtagcattttgctttgtggaagataattttcaaggatgaatgagtgcagctaaaatagttatttttctgtgtgagcacagtttgaaattcttgatgaaaagagtcagacactggtaagatatttgaatagatttattctgagccaaatatcagtgactggtggcccgtgatgtagcccttaggagatcctgagaacctgtgcccaaggtggttcgggtacagcttggttgtatacattttagggagacacaagacatcagtcaacacatgcaagatgtacattgcttccatctggaaaggcaggacaatggaagcagagggtcttccaagtcatcaatggattcaaagattttctgattgaaagagttattcaggttgaaagagttattatcaatacaaaggaatatctaagttatgataaggggttgtggggaccaaggttttatcatgcagttgaacctcccaggcttcagagagaatagattgtaaatgtttcttatcagatttaaagagtctgttctatcagtaattccgaaaaggaggagggcagaatgaggcatgcctggcttcccttacccatcatgacctgaagtagttttgcaggttaattttggaatgcccttggctgagaggaggggtccattcagatggttcggggccttagacatttatttttggtttacaaacatctctatgcatattttgtcattttttacttagaatctgcagaagagaaaatgaaacaattttgaccttttagttcataaaaaaaaatcactgtactgcagtctgtatgaaatgttttttgtgtaggtggtggaaagtggatgtgattattgtatattatttctccatcagatgtcttcaggttttacattatgaagtagacatttggacattattttttgtatgtttccagattttattttaatagtaaaatgctgttttcacttgaaaggctgctttactttggtttataaaagcaaatgttttaaatcaacataaaaggcagaagatataaacgtgctccaaagaatgttcaaattaggccatgtactatttgcaattcaaatgttatttttaaataacattaatactattgagatttggctagtagtttagaaatagggttgtatcttgttgcttatacattagaataattaggcttactttcaatatctgctcacacaatccagaaagttacatgaacgtattgaatcaaattttgttgtattttttaatgtgattatccttagggtaggtattaagtaccagtctcagggatcttcaagttggggaactcttaaaccaagaacacttgtgaaaacttctccagcgggattggggccacttagttttaagtgaataactctctacttcctcaacttcctgcagagtctcccttcccactgatcctttaacacacattccttctgccctagtactaagaaaagcctagctctctctcacgcacattgcccaagggtgcaaaaacccctgaggtggcgggggcaagcagaaaaattcaaaatattggtattctgctgataactgcctgattctaatgatctgataaaccccttgctgcccacaaaaatgaaagacctaataaagttgtcctgtgacggatcattgagaagaattttgggtgaaagatcattaagtatggaggatcagatggacagattgacagaagtaggcttcagaagatgggtaataaaaaactacactgagctaaaggagcatgttctaaaccaatacaaagaagctaagaaccttgataaaaggttagaggaattgctaactagaataacctgttgtgagaggaacataaatgacctcatggagctgaaaaacacagcgtgagaacttcatgaagcatatacaagtatcaatagctaaatcaaccaagcagaagaaaggatatcagaatttgaagactaccttgctgaaataaggcatgcagacaagactagagtaaaaggaatgaaaaggaatgaacaaagcctccaagaaatatgggacttcataaaaagactggacctactactagaatatgagaaggagatggggagaatggaaacaagctggaaaacacagttcaggatattatccaggagaacttacccgacctagcaaaataggccaagatgcaaattcaggaaatacagagaacaccattaagatactccatgataagatcaaccccgagacacataataatcagactctccaaggtctaaatgaaggaaaaactgttaagggcagccagagaaaagggccaggtaacctacaaagggaagcccatcagactaacagcggacctctcagcagaaactctacaagccaagagattgagggccaatattcaacattcataaggaaaagaattttcaacccggaatttcatatccagctaaaaactaagcttcataagtgaaggagaagtaaaatcctttacagacaagcaaatgctgagggattccattaccaccaggcctgccttacaacagctcttgaaggaagtactaaatatggaaaggaaaaaccagtaccagccactgcaaagacatgacaaaatataaagactaatgaaactatgaggaaacagaatcaactaatgtgcaaaataaccaaatagcagcatgatgacaggatcaaattcacatataacaatactaaccttaactataaatgggcgaaaggccacagttaaaagacatagactggcaaattgggtaaagagtcaagacccatcagtgtgctctattcaggaagcccatctcatgtgcaaagacacacataggctcaaaataaagggatggagaaaaatttaccaagcaaatggaaagcaaaaaaaaaaaaaaaaaaaagaaagaaaaagaaaaagcaggggttgcaatcctagtctctgacaaaacagactttaaatcaacaaaggtccaaaaagaaaaagaagggtattacataatggtaaagggagcaattcaacaagaagagctaactattctaaatatataggcacccaataaaagatcgctcagattcataaaacaagttctttgagacctataaagagactaaactcccacaccataatagtgggagactttaacatcccattctcagtattagacagatctatgagacagaaaattaacaaggatagtcaggatttgaattcagctctggataaagtggacctagtagacgtctacagaactttctaccccaaatcaacagaatacacattcttctctgtgccacatggcacttgttcgaaaatcgatcatatgattggaagtaaaacactcctcggcaaatgcaaaagaactgaaatcaacagtctctcagaccacagtgcaatcaaattagaactcaggattaagaaactcgctgaaaactacacaattacatggaaattgaacaacctgctcctgaatgactcctgggtaaacattatgacattaaggcagaaatcaagaagttctttgaaaccaatgagaacagagagacgatgtaccagaatctctaggaggcaactaaagcagtgctaagagggaattttatagcactaaatgcccacatcagaaagcttgaaagatctcagatcgacaccctaatatcacaattaaaagagctagagagacaagaacaaatgaatccaaaagctagcagaagacaagaaataactaagagaagaattaaaggagataaagacgtgaaaaccccccaaaaaatcaatgaacccaggcactgtttttttgaaaaaattaacaatatggatagaccactagctaaactaataaagaagaaaagagagaagaatcaaatagacaataaaaaatgacaaaggggatatcaccactgacctcacagaaatacaaactactatcagcaaatactataaacacctttatggaaataaactggaaaatctagaaaaaatggttaaattcctggacacgtataccctcacaagattaaccaggaagatattgaatccctgaatagaccaataacgagttctgaaattggggcagtaattaatagcctaccaaccaaaaaaagcccaggccccagatggatttacagctgaattctatcagaaatacaaagaggagctagtaccattccttctgaaactcttccaaacaattaaaaaggagggactcctccctaactcattttatgaagccagcatcatcctgataccaaaaccaggaagagacacaacaaaaaaagaaaacttcagaccagtatccctgatgaacatcgatgagaaaatcctcagtaaaatactggcaaaccgaaaccagcagcacatcaaaaaacttacctaccacgagtaaatcggcttcatccctgggatgcaaggctggttcaacttaagcaaatcagtaaacataatccatcacataaacagaaccaaagacaaaaaccacatgattatctcaatggatgcagaaaaagcccttgataaaattcaacatcccttcatgttaaaaactctcaacaaactagggattgatggaacatatctcaaaatgataagagctatttatgacaaacccacaactaatatcattattgaatgggcataagctggaagcattccctttgaaaactggtacaaacaaggatgccctgtctcaccactcctatttgacataatgttggaagttcagaccagagcaatcagtcaagggaaagaaatagcatattcaaataggaagagaggaagtcaaattatctctgtttgcagatgacatgattttatatttaaaaaactccaccatctcagcccaaaaactccttaaactgataagtgccaaatcatgaatgaactcccattcacaatcactacaaagagaataaaatacgtaggtatacagccaacaagggatgtgaaggacctctgcaaggagaactacaaaccactgctcaaggatgtaagagaggatgcaaacaaatgaagaaacattccatcttcatggatagaaagaattaatatcgtgaaaatggccatactgcccaaaataatttattgattcaatgctattcccatcaaactaccattgacattcttcacagaattagaaaaaaagtattttaaatgtcatatggaatcaaagaagaccccatatagccaagacaatcctaagcaaaaagaacaaagctggaggcatcatgctaccttacttcaaactacactacaaggctacagtaaccaaaacagcctggtactggtaccaaaacagacatatagaccaatggagcagaacggagacctcagaaatctgcaatcatctgatcttcaacaaacctgacaaaagcaagcaatggggaaaggatatactattcagtaaatggtgctgggaaaaccggctagacatatgcagaaaactgaaattggaccccttccttacatctaatacaaaaattagcttaaggtggattaaagacttaaaagtaaaacccaaaaccataaaaaccctagaagaaaacctaggcaatagcattcagcacgtaggcatgggcaaagatttcatgacaaaaacgccaaaagcaatggcaacaaaagctaaatttgacaaatgagatctaattaaactaaagagcttctgcacagcaaaagaaactatcattagagtgaacaggcaacctacaggataggagaaaatttttgcagtctacccatttgacaaagggctagtatccagaatctacaaagaacttaaacaaatttacaagaaaaaaacaaccccatcaaaaagcaggcaaagaatatgaacagacacttctcaaaagaagacatttatgcggccaagaagcatatgaaaaaaagttcaacatcagtgatcatcagagaaatgcaaatcaaaaccacagtgagatactatctcacaccaggcagaatggcaattattaaaatgtcaggaaacaatagatgctggggaggctgtgaagaaataggaatacttttacactgttggtaggaatgtaaattagttcaatcattgtggaacacagtatgacaattcctcaagaatctagaaccagaaataccatttgacccagcaatcccattactgggtatatacccaaaggaatataaatcattctactataaagacatatgcacacgtatgtttattgcagcactatttacaatagcaaagacatgaaaccaacccaaatgcccatcaacaatagactggagaaaggaaatgtggtacatttacatcatggaatactatgcagccataaaagagaatgagatcatgtccttcgccgggacatggatgaagccggaagccatcatcctcagcaaacaaacacgggaacagaaaaccaaatacctcatgttctcactcataagtgggagatgaacaatgagaacacatggacatagagagaggaacaacacacaccagggcctgttgggggctggggggtgaggggagggaacttagaggatgggtcaataggtacagcaaaccaccatggcacacatgtacctgtgtaacaaacctacacgttctgcacatgtatcccatttttttcttttagcagaaatttttcaaaaagattttaaagacaaaaaaagatcattaagtaatttttcacatggaattcagagaattcgtaactctactacaacagtctacatgaacaaggtttctcagcactaatatgtataaaagcaaaaatcagggctaatattgatgctgaaccctgtcttattctagcaataactaatcttcattagcagatacataaactagtcgtgaaaaaagcatatctaattaaaagagaaatttttaatacattgtttttgtggaatggtcacaaaactttttatatatttttgctgttttgattggttatattcaaataattataataatccagtcaggtgatttgttttttacacttagaggaatgtattgtcaggaaatatttcaacctttcttaaatttaaacttatataatttcatggcagagaaatatgtagtaatcaataaaaaaccttcaagcataaaattacattaagataaaattatgtaggggaaatggaatggaaaaagaaccaatgtagaatttctattacaaatttctattttagagtttattcatgtgtttttgttaatggtgagcatcaaattacttgtagtacttagattttattggctattcaaaagactagtggaaaagttatatatttaaacgtcaatattcaaacttgtgggaaattacatactttgcagctacttaaacttatgaaaaaatgtagttttcaacctaaaataaggaattattttatgaaataaatgagcaaatgtttgaagcccgcttgaccacagcatgttgggtgccatgctggatcttgaagaagtacactgcactcatagaatttattgtcaaatttaattggtgatgtttcctttgttcaacaggatggtctgacaccactgcactgtggagcaaggagtggccacgagcaggtggtagaaatgttgcttgatcgagctgcccccattctttcaaaaaccaaggtaatttcttttcaggtttctggacattggactgtatttattttgatggttatatgatctagccttttgaatcacatagaaaatgacattttcaatgtagcagtcagagtagttatgttcaccagatctttatagaacctcagaataagtttgggctaattaagattttatgtagaatgtgctataccacaaagttgtttgtgtgtgtgtggtttttgttgtgtttcaggaatgcttactgcttgattttactctgtgaaattttcatagctcagaaataattgcttgtcaggttaagaaagactaaagttctacactctctaacgtttgggtgccggctatcttcagcacctcagcttacttcttgagagttcatagacttttaaggaggtcaaggatatcacttagctgataaagactggaaactttggaaagactgcaccttgattgggcttttgggaatgttgacatagctgaaaggaacacatgatgattgcctgaaaaaaattaatggttgactctcttttagacttttttttaatagtaaaaccatttgacatcatttgaagaggagaatatttgcaaataaattttgagacatgtaaaccacctcattgtcactactacttttattaattaaaccagtgatttttttggaaatgatactaagctttactaagagctttaatctctaaacattatcaaagcaacaaaagcacatattatttctgtcttcactctggtcagtgtttcctcaacaatattaggaaggctagacagggttgagatggtctggacaattccatcactcatttaaaacgtagggtttagattggtgagctgttgagggtattgtctaacagaattaaacagccatgatgttttcattgtatatgatgacatcttggccttttgagtgtttcttatcttgatgattctatttgttcttttccttttacataccccatatctattttctttccccctccactgctatcttctaagccacattatcatctctcacctaaccactgtagtagcttcctgttggtcccccatttccctttttgctcctttacaaatcagttcccactttgcagtcagagtggccatataaactgtcatccaaatcatgtcagcctcctgcttaaaaaccctcccattaatccccattgttctctttcaaattgattttcattttctcagagcagtaaggaccaatgttaaaaatcagagagttgctcatattttttctcctattcatctcattgctttggattttttctgagaaatcttcttaatttttttcttccaatcttttaattttcaagaacattttcttgttatcagatagcttcttttcttaaagtatcctgttcttgtttaatgggtacatttttttctgttacctttctgagaacatttgagataacttttcttttaatttagtttttctgtttcccaaatgtccctaattcctcagatttcctttttttcctttttttttttttttttttttggctctgtattttacaatgaaggcttcccacaatggctgtacctaattgtgtcaggcacaaacatgtgagtggcagctctaaagagtgtaggcagtgctgatcaggtggcagtggttaagaggggctctttaatgtcacaattaggttccctttaccttaggcggtatagttttttgagagacaaatccaccaacctttgcagtgcacacatgtgtgaatacattctgagtaggggaaagaggctgccagtcttgtgctttatgcatactttaatcataataatgataagcaatattttacatagtgattactgcttatcaggctctatgttctttacacatattaactcatttaatcctcgttaaatgagatactggtattactgttattcccttttcatagatgaggaaactgaaacccaaagaggtaaagtagctttctcaaaatatcccaattagtggcagaacaaggatttgaacccaagcagcccaactccagagaccacatccttaacgcctccattctccttcctttttctgtgatcacctattcttggtccagatcctcgtcactgccctctgttctgcctgggcccttgagtctgaatctctctagttcaccttctccagacactaattctggtgtccttcaggctagcaggaggcagttacctgactttgctgagttgggaagggcctggagacctgacggctccatacacagtctttgaaccaatcttatttgcagccccaagtctcactttatcttctgaggtactacgcttccacagcctttgcctttttgggatttgagaggcaaatcagcttgtctttttattcccagcagtgtgctggatcctgattgtatcggctcatgagctggttgtgtacatctctttccaattccccattcagtaacatcagatggacggcttgaaatgggttattgtggggggatttacagcatggaaattgggtagtgctacacactggggcttttctttttccaggagttgggtgttaaaacatttgtcagcacagcactgattctactgcttcagacacttaggtttcagcctctctcttcagctggatgaattaccacactcaaatcctcttttcatattctgaagtttggagacaaccctcatctggttttttatttcttccccattgtgtgtgtgggaatggaaaaggaaacacacatgtgtgcccttctagattttaccctttaaatccattactgctttttggtggagttttgggagaggaaggatacatatatctattacacctgctgtgtttgatcagaagtctccctctgcactgaggatagacttcttaacagattctgaccacctctcttcctcatctcctccggttttgctccttccttgccatcttttagctaaccagccttcttttacttcctagaatacgcctttgttctcatttcctgtttgcttggtttgagttccctcagcttgttccagatctctgtggtccccgtatattcttcaactcaaatgtcttcctcatagacaggcgttttctcacgatttacccctcccatcttcaccacctcctgccagtgccatctggccatattttattttctttagagcttttaacaccatcttgaaattatatgcttgtttacttgcttgctgtctggttctcttcaatagaatgaaagcaagaacttttccttgttgagtgcaatacccacaagcacctattttcatgcgcagaacacagtagggcttcagtaaatatttgttgaatgactattaagtgaatgagtacattcctagccttaaggccatctgacccgttcttcaagaatttcatcttactgagctaagaaagcccatcacattggttccatattttcaggcaccatatgtaataccacctctttccatagggcagatgatcttttctttactgttttcttgtccttctccaattatctttaagtttcccatccacacaatcattgtgtttttgcattgctagagaatttttttttattgacactgcctcccatttttactctccactattacttgttctctcagattttgtgggatttttttgtttgttcacttgtttacttcatgttttcctctaagactgtatcaaaacataaagcaaaagaatattttggcaggaataaagcagtccatatgctcgtgggtagcagtatctcaaatgggaaatgttcctaccttttcctgcaccttaatttctacggtttaaaatatttgagggaaattttttaggcagaaatatcctgatgggctgacagtgtacgaggcctttaaattgacctagatatttgctgagctctttctgtatatgcaaagctctcttctgggcaatgaaaaaataataaccatgtacctcttgccttcacggaacacaaatagttgaaatatatgtcagagagtggataatgccgttagaatggttaacaaggagcttatactactttttcttatcttgaactccttctttgtgtcatccattgataaattcagagcaaataacttggctcagaggattcagaaacctctggttccttggtacatatttgatctgtcattgtcaaaattcattgatgacaatttttttagaaactgaatttgctgtcaaattacttttccctaatatatgttaaattatgttacaataattgatagagcctctcttgataattgaattctctaggaatttcccaggctcccccacttcgccatcatagttaaaagaaaggactgacatcttcatagcttgttttgccttcattaggaaacatattgagtgccagtgtcattctaggttttatttacctttgaccctatttatttattctctctgctctttaaatgaattttcaactcgctcctactgcacgtgattaactgtgttattgaacccagttgatttaaactaacaagtcaagcattagttagtggctttgtcaatgccttgcctttcctcatcatagacacatgggggcaccagattgatagaaaagggaaaagttttcctttcttctttgatgtgagatgaaatgcgttacattcagaccttttttaaagtcaaatcagtatagtcttcaatattgggtgttagtaatctctaaggacaaaattaataccagtccaatgaataccactgttcttaccttcattttttcttttagtcttaaatattaagaattcctatctggccaaattacagtggctcatacctataatcccagtgctttgaaaagctaaggcaggaggatcgcttcaggccaggagtttgagaccagctgagcaacagagtgaaaccccatctctatttaaaagaaaaagaaaagtaaaattcatatgcctctaagttatgacccatgctgcaattctcacttctattaaattgggaaaagacattatccttgacaacttgttattgactggcataagcagttgggaggaccagttttaaaaatagctgtagttcaaaatagttgtcaaaagcttttacaaatagaaggtattttcatgtgaagaactggagtttttatctgtttatatttgcactttgtgttctgcacatttgtgtttaaaaggtaaaagaatgaactctgatttctttatgtgttccagaatggattatctccattgcacatggccacacaaggggatcatttaaactgcgtccagcttctcctccagcataatgtacccgtggatgatgtcaccaatgactacctgactgccctacacgtggctgcccactgtggccattacaaagttgccaaggttctcttggataagaaagctaaccccaatgccaaagccctggtgagtggctcaaccagcgagtccagcctcagttgtcttgctcacaacgtgctgcctctgtatgtgaagggaatgctttgaggaggttaaaatagaaggtgctagttaaagtgtacttcttgtcaattttttcaaatatccttcaggaaagtctacaaaattttctatttctgacatgagaaaggctgagggagccaaactgttaatgtttttatggtcacataagtgattcccgtatgaacccaaagactatacaattataaaaagactaaggtggccaacgtcgtcttattgtggataaacttataattctgtgaattaaaagtttattctgagatctgaaaacaaggcaaagttatcaaaaaactctatttgaaacataagtggtctaggaatttgtgagctaaaattttatatatcttaaccttgtaagttaatgaaatattgcctgtaatcttctgtttccgtttgccaatcagaattttggtccagtttataggcttcactttaatttgttcttttaacctttagctatgctgtactttggttttctcagcaagatggtacttgttgtctttgcaaaaataaatggtcccaaattagtaagctgtctatttcagaataagtacccaagtttaggaaaaaataagtcacccaattttagggaaaacatgtgagtttactagcaattttgaggtaaaggttgtcatcatccaattgacccttttaggaagggtttttgcccctttccaaagagtgcggtcatcctgtctggatagatccgtaccacctcttgtactctgtgggctctaaaattcagagtggacaggaaagaatgacgaaagagaaactctccagaccccagacacctccttgccactataattctaaaaccttttaccaaagcagcatttcaagatcagtctgttgacccacccagtctatcaaatgtgtctgaattctgagaagggaggaaaggaaattagcagtcatgactcttttttccatacaagaaaaaaataagtcctaaaacagggcgtgggctcccactctcattttcctctgactctgaagatttcacaacatatggaggttgtagccagtcatcctgggatggactgtggccaaatggtctgagaagcctcggtgaaagcacctgcagtgactttgacctaagcttttacagtggactctggtattttatagttctccactggcagctgaaatacgtgccacagtctcaatcggcaggcaggacaacttaggacataatttattaaaaagcagattcttttattagattaaatagtaaacaaaatgattcaaataatgggttatttacatttctgcatgcttggagtaaacacctacttgaagcataaagctagagaagaaatcaaaacgttttagagctggtcttgtagttgtcctaaaacacagcaaagagaacagaataaaccttggtgaagtggagctgtgaggacaaatgttggggccagacgttttcagtctgtatttgaaatgaggtagaggagggacatattattattatttattattttgaaacagagtttcgctcttgttgcccaggctggagtgcaatggcacaatctcggctcactgcaacctccgcctcctgggttcaagtgattctcctgcctcagcctcccaagtagctgggattacaggtgcacgccactatgcctgcctaatttttgtatttttagtagagatggggtttcaccgtgttggccaggttggtctcgaactcctgacctcaggtgatccacccacctcagcctcccaaagtgctgggattacacatgtgagccaccacacccagcctgagacatatttggaagagtgaattccaaaataaaataatgaaatgaatgatcatttttacctcagctaaccaggagagtgtaataaaaattcacttcctgttcacaattatcagggtaccttgggttcccagggcagctggactacttctagaatagaatctacatgctgcttaaccctggtactttctgttcatttcaatttaccacacatcattttagcaaaactatttactgcacacagtgaaactggattttgatggaatgtagtcaagcaggtatatgtatttgtcccttgcagaatggctttacccctcttcatattgcctgcaagaagaatcgaattaaagtaatggaactccttctgaaacacggtgcatccatccaagctgtaaccgaggtgagaagagttaagatttctgggagtcctgagatactgagagtatagccttagcagccagagccccagggccatctccagggaccagctagtttgtttgcatatcatggccatagactgcattctgaactctttaggaagagggctgccagtccctaggagaagcagacaaacatgttggtgggtgagtttgatgcaaatgtatcaccatgtcaagaaatgtaacctaaaacacatgcttaaggggaagggcaccttcacagaaagcataatttatatcaaatcctatactgtagtacttctctagtgggtgcagttttgtcccccaaggggcgtttagtcatgtctggaggtacttttaattgtcacaactggatagtactactggtctctagtgggtcaaggccaaggatgctactaaacagtttacagtatacaggacagtctcccgcaacaaaaagtcgtctgattcaaaatgtcaaatgtgctgaggttgagaaaccctgcacaagacgaccttggtgcttttctcaagtaagggttactctgtcttaaaactcaaaattaatgaaacagctgctgaggttagtaaagtattagacctaagtttctctcataggaaccaactcagaactcagagaaatgatccatcagaatcagggctgtgccttctacaaagcaaaccaagcctgacacctaccctttcagacttgtcccagacccccaacctccacctcactacatcctagcactctgattgatctctgttaattctaattctaacccttggcacttccatagactagacactctcttgtttgcctccgtatgtctctgcctctgtgtgtcacacccccttggccaggcaaatcctgcacgtcctttagaaccagatctgggccaccttcttcaggaaacccccgctcactccccagcctggactacatgttccttctaggaaccatcacctcatcgtgtgcatatttccatcaaagcccttatccagctctctgacttatgactcagtggcacccccaagaaccccagaggctgaaggctccttggaagcagggctgagtctgactggtcttcatatacccacactgtctggcccatacacagatcattcagtaaagttttgttgaatgcctgatgcttaactataggatttgaagcaaacataaacattaaagtctagtctagtgattgttgcttggcttcagtttcttgcctgcaaatggaatatttgcctagatttacacttagaatttttaaaatattaaatggttgacaatatgaatactgatttgccatattgtcaggcttatgggttcatattaggcaacctgttatttttaagtataaaatagaaagtttactttcagtgcataggaaccctcttagagataagaataggctctaaaataaaagtaaattcttggctgatgtttgagtaaatgtccagagatatcaaccagtaatccagctctctgttccctaagagctttaaaaggcagttcagaccaagattttgccttgcacaagctctaactactccccctgctgatggaaaaaggtgccaagactataacaaaattctcattttcctaattgtcctccattcttctcactttttgaattctggacagccggaattattccttttctgtcttttacctcactttgattgtatagaattcctttcatatatttttgacatttctcaaatttctgctgagattaattatccccttctgtcccttttttaaaaaacaggttagctttttctaaacatactaaaaaaaatgttttatcaagttatgatgttcatgttgtaagctaaattaaactgaaaaatttaaaatggaatcatttcatataaaaagcacgagtaaattatactctttaaaatattaatgacttgagatttttatctttcttattcactctaaatctcacaatcatggacatattcaatataaaatatcctggaatcaataaattctgctttacgctgaagagtattctggggtctatgtacatttatgtatatgtatgtgtgcataggatctgaagcaattcaagtctagtctagtgaccattgtaatatttgctttatttagattgctttaatttataatacccataaagttaaacaattaaatgtttgaaactattaatgctgatttgttcatttattaaagaaacagctttgtgttaggtaccctgctcttttatatgtgacataaatgggaatcctctttaaagcccagaataggatctgaaataaaagttgactttttactagtatgtatgaaatcacagctctcctccttctacacacacacatatggataaggaaggtttattagtaaaggggaaaacaaccttcaagttatttatcaattttttcaaagatctacattaaaagtatgaaataaattctttttcttttttaataggtatgacataagtctttcatagtaacagaatttgctttaggaaaacgatgattatatgtttatatatttaccatatagaatctgtaacataatggtgaatgtcctgatgtcttctaatccgatcattaaactgatttagatgggtggatggatgacaggcaggcaggctcacagacaaaccttttttatgctaagccaacaaaccaccattttcttcttttccccttagtcgggccttaccccaatccatgttgctgccttcatggggcatgtaaatattgtatcacaactaatgcatcatggagcctcaccaaacaccaccaatgtggtaagtattctttgaacaaaggaggtccattgtgagtatttaataaactggcaaaggtggtttttatctactttttttattttttatttttttaagagttggagtatcgctctgtctcccagactggaatacagtggtgcaatcatagctcactgcagccttgaatcctggactcaagtgctcctcccatctcagcctcccaactaactgggactacaggaatgtgctatcatgcctggctaatttttaaatgttttgtagagacgggggcctcactattttgcccaggctggtcttgaactcctggcttcaagcaatcctcctgcgctggcctcctaaattgttgggcttataggcatgagccaccatgcccggccttattgttattataattaattaatatgtaattaatatgactacttaaaagaagaaagttcaagaatacatttgtttcctttacttcaaaggcaagatacactcggtctctagttggccacaaattgttaggacttacgaactacgttcattaaccttacaggtgcattactactggatattatgttttaaaaaataaagtgtggccgggcacggtggctcacgcttgtaatcccagcactttgggaggctgaggcaggccggtcacatgaggttgggagttcgagaccagcctgaccaacatggagaatcccccgtctctactaaaaaatacaaaattagccaggcatggtggcgcatgcctgtaatcctagcaacttgggaggctgaggcaggagaattgcctgaacctgggaggcggaggttgcggtgagctgagattgagccattgcactccagcctggccaataagagtgaaactccatctcaaaaaaaataataaataaaaaataaagtatggggggtatttttctacaacaaaaacattaaaaagtaccgcatgttggagaggttgtttagatactatcgtcgtttatacaaagaagtgattttagcagggcatggtggctcacgcctgtaatcccagcactttgggaggccgagatgggtggatcacttaaggacgggaattcaagaccagcctggccaaaatgatgaaacctgtctctactaaaaatacgaaaaagaattagctgggcgtggtggtgcatgcatgtaattccaactactcaggaggctgaggcacgagaatcacttgaacttgggaggcagaggttgcagtaagccaagatcatgccactgcactctagactgggcaacagagtgagactctgtctcaaaaaaaaaaaaaaaaaaaaagaagtgatttcaactaacttcaaggtagtctctctttaatgtgcttcaccatgttatagcaaacccatggaattctgtgttcatagattactcgatggtattcttttcccacactaaacattgctctgtaggaaccatgaggctcacttcagagtagctatcagagtggtaacttaccacccatgatctgcatgtggcatttgacattgttttatagaatttcaaatttgacatcataatattagcacaacagaccatagacataataacactcattggactcatgagcattaaagaagtaacaataaaacaagcaccatcctggcacagaaggggcaagctaggaggccctgcacgcttaccctgagagtggggctccccagtaagagtgcatcttccagcagccccaagcagtacaaccaaaagatagaaataggccagcttctgagatgaaatacagtctttcctagtactaattgcacagaatgttttcattcgtaaagggaacactgagtaatatactaaatgacatcctcagcacctttccagtaaacacaatccaccagtttcctgtggaatctgtcttcacgtgtccttccatggaagtaggtggcctataaagcaaagaccaatttataaaggcagtttaaaagtgagcatcacctatgtgagagaatatatttcatttttgttatttgtccatttcagtgtatctgtttctaataccattttcatttttaatcaagtaaagaagtaatctggattagaatctatttggtgaaaaagtagggggagggtggtccagggcaaagaaaatgacccactgggaaaaatgcccaaagactaagatattgatctgttcagataaaacaagaaatgcaaaccggctgttgacaagccaaatccagcccttggctatgtttaggttgcccatgtagtgttttgtttttaattctgaatttatggtcaatatttaagagttagaaaatttgtataaaatccagactgccacttcttttgaaaagttgcatggtgtggcatggtaaggctggcatcttgcacagtgacagcagcgagctgcagatgtggggggtgtggggtggggggttggctgcctgcttcagcgcaggtgtgggctctctcaagcactccacacctgcccagctgcactcactcacccccctgcttggctcctatgagcactgacctttccagccctgagggaggccacattgtaggttactgagcagcacccctggcacagtgggtgacaagactcccgaggcttatgccaaagtctttgcctcatggaccaggttcctgtgaaattctcatgcatttgatttcctatcttttcaataaggaagtgcttaggactattttttatttttgaaaaaagtccatcataagctttatgccaaataaaatacactactcttcttcagagctgcagctaatttactttggctcatgttccccagagaggagaaacagcactgcacatggcagctcgctccggccaagctgaagttgtgcggtatctggtacaagacggagctcaggtagaagctaaagctaaggtatgcgcaatacttgacaagtgtttgaaattgaggaaaaactgttggattttcataaaacttttaagtatatacatgcagtctttcaagaatactttaaaaatattgaaaaacctccaatgataaaagtccctacccaagtaacattgtaaaaaatcccttccctgcacatttgttcattctattatttaacaaaatgaaataggatgagatgagaacttgtgcctgaaactgtcagcacacggctagtccctaacagattggggactgaatctagacttggtccaaagttcttcacactccgtggagaagggcttatgcacaaagcttctagaacaatcacaacctagaagcataactgagcttttctggttgacttataagtcagctgtcaacagccacaaaaggaaaatgggggatttttttttttttctacacaagctgtatggccacttcagaattggcctcgtatttcacctgcaggagaaacccacttatctgctgctattgggatagatagttcggtcaggctatcagaatggcagttcaggtccagaatcataaaccacttaatttcaacctacaatatgtaaatatacatttgcacaagtctgcagtctctagtttcaagtaaggggtggcagtagtagcagtatgtgagatttttccttggcacctattcgtttctgctttcaatattcctcttctcccttgcagcatctccctaactcctcatgcttcctactggttagatagcccctcttactttgacattgaccctcatcctccttattcttccaaaatggtgtcctctattctagcctcgtttctctacctttcctacttaaaccatttacctgaaccttatcacaattcagtagagaatttctatttagaggactaccacagggatctttgagcaaattaagatgatttgcgcctcccacttggggataagaccctaggggatcaggacttggtgagtacctcctgcccttgggtgaattgtagtgaggtggctctccagtttagacagatgcagcccttgccaggatgcacagcctggcaagcagagggcatcagcccctgctgacccttcagctgggagcctttgcacaggtatactgcgcaaccccacactgccttcctcacactctgcttttgtctatgggaaggcagaaccaacaaaataattcattccatgtgagtgcataataactggtgtggaggtataatatccctcccaggtatatgagttttactaggatacattctcttatctcccaaagaaggagcaattaaagttcaaatttgattctctgtggcaggtgtgggtggggtgtaatttatagacaactgcatttcatggttttcttattaatgagtcactctccacaggtatttaattagcttagagctaccatctcctcatttctgagcattgaagaaaaagacaaatgagtttttttagcattgactcaaaaagttgattgtacctcttacatcaagcagctaatattccctgaatttttcataaaggcaccattgtttcctcagctcatcagccttacatttctaccttgctgtttaggatgaccaaacaccactccacatttcagcccgactggggaaagcagacatagtacaacagctgttgcagcaaggggcatctccaaatgcagccacaacttctgggtacaccccacttcacctttccgcccgagaggggcatgaggatgtggccgcgttccttttggatcatggagcgtctttatctataacaacaaaggtatgaaagcaaatctcagaatcctgctctgtccccccaaatacatcttccttacgtttccccgcatagtaacaggtccagaagctgcacaacagcatctattcttgcgatcccacagtagtcattaatatggccagcaaagctctgtggtgggagagggtaactggtagtattttgtggggggttttttgccttaagtttcttagtatgttatcttccaatgaaaccttactgatatccagagtcagatttcttgtaaattatttggtggccttaaatggtagtttaaaaacagagccacagattagcaaaatgctcaggccaagcacacaaaccacattatcacagctcggttggtagatgcttttataatacttgcaaaactggcagtgaatttttcttggggttgtttttgtttgttcttgttcttttttgtgtcattattgtcttgtctgacttatggtttgatttatttttatctcaactctgatgccttagagtaataccctaacataaacagttgttctgcatgtgcagaatgcaaaatttggagctcattttttttgtgatactacataagccttgcaagtgtgatagcaagatgaattggcttgtggcgcatcttccaaagctagtaactggtactgcactcttttatttggatgcagataagaaagattaatgtgtaatcaatatagaagacaattacaaatagaaaactatcgggataaatgatgactacctcaaatttcatttcttgtgattctttgggctcttcagtagagttgagatgcaagttcaggaagctcatttgatgtgaaacagaataatgggtgatagggtcttgagtattcaggcatttcaccataccagctgcacattccttttagtttgctgtagtctcatgaggtcaaatgtgctgatgaccccgtaatccctgactcatgattgggacccccacaacagtgtgctgattggctggttgatacacagattcttgtaggagttggaagtctgagggagccagccactcagctattaatatccaagtgttgcatatttgtccatgtgtcattattcagttcacctacagaatagacgtcgtcattctaaaaccatgtcattattcagttcacctctggtggcaaaggtgagagaatttctcactcctcctcctgaagactagaggacacataaggattgtgtatacatggagaaacggggaaagaagaagaaaagtggctggtctggtgatgtgagattgtgagaggttcagacttgccctggattttcccaagccctccaaactgagtctgggaccctataacttattcttcccacaatatgaaactctgaaaacagccctagaataagccccagatccagctctccaacttcatcctggtgagatacctgaagacttccagaaccaatagcatgtcatggctcagtcagcagaagggagaaagattaggtatcctggtatgttatgctcacaccctgtcaataagaaggctcttgaactcttatctgtgagtcttggactttaaatgcagacttcactgctcatcatcaatagaataattaatcagttctggaaagcagtgcccttatgtcatatctttttgtttgtttgttgtttggtttgggttttgtgtgtgttttccttatgtcatttctattgttcattatttttatgttttttttttttcagaaaggatttactcctcttcatgtggcagcaaaatatggaaagcttgaagtcgccaatctcctgctacagaaaagtgcatctccagatgctgctgggaaggtaagaggtcaccagccaccctgaagcaggccacttccacgataacaaaatacacccttgctaatattcactaatagccactcaaattataactaaatatttaagtcccactaggatgaagagcacttgggaaataaaaggtaaatgctggggtccaagtactgtggaaaccggaatgtaaatatgccctatgtcgtatccaatctaatttcatttcctcaatctaagcctctggttttaagacacctttgacactggttgttgtttctgcacgtgttttcagagcgggctaacaccactgcatgtagctgcacattacgataatcagaaagtggcccttctgcttttggaccaaggagcctcacctcacgcagccgcaaaggtacctataattccacagcctaaggagactgatgggtaaggtctatcagtctctatctgcacatctacttctgcttcagcaggagcaccctcctagtttaggcaccactaaaaaatcacagaaatagaagcaccttaggacatctgtgccttcagtgatttagtctgctaatatggtagatactcaggaaatatttacttgtcagttgattgtctttggcaatccaggacctcctggaggaaggagagctggaacactctttagccagatgaaaaacataagcacagcctgaggaagtaagaaagttctgatttgtcagaattatgaaacatgtgttacatttttctggccacataattgccttcaagttgtttatttgcatttagtaaaataggttgagaggttttacatgtgtgtttttattattgctaaggaggatctttattgttagggcctttttgatcagtagacaacttagatttctgagaaaagagaaactgagtgggtatatagctatattattattttagtaatctaatttgagggacaaatcataaagaagagcttccttaaagacaggttaatagagtgctattggtttaataagcttcctattgttgagcaggtggctatgatcagagaacactgaaatgatgcaaaccatttcagtgttgttcagttatttcgctaaacactattggttggaggaccattgagtatcccttatgatccttctccttttttttttttttttttggagggagacggagactagctctgtctcccaggctggagtgcagtggcgcaatctcggctctctgcaagctccgcctccggggttcacgccattctcctgcctcagcctcccgagtagctgggactacaggcacctgccaccacacctggccaattttttgtatttttggtagagaccgggtttcaccgtagccaggatggtctcgatctcctgaccttgtgatccacccaccttggcctcccaaagtgctggaattacaggcgtgacacaccgcgcccggcctcccttatgctttttacatctttgatttgctaatccatgttggggcagctgcagtgctctcctttaaacctaatgtttagatcacatcattgtatacacagatgaatgaactggggttctagattactttagataccctaagagatcaagttttaggtactctctccatttagagagtatgttatcttcgacagatatttcttcctggaaactttcgatcattttctgccccatcctctccagaattatacccagtgaaatctaaaattcaaaatcaaactcccaaacttgcttttaatctaaatgtagctttcccctccacagtttctgaccctgacaaacattctttctattacaaaaccacaatgtgacttgataaaactttaatttaaaaaaagacagcagcattattcatgacagccaaaaggtggaaacaatgcaaatattcattgatggatgaatgcatatactcactgtgcatatacacacaaaggaatattatttagtctttaaaaggaaggaaattctgacatactctactataatacatggaggaatcttgaagacattgtgctaagtaagccagccacaaaaggacaaatgtatgattctacttatatgatgtatatagagtagtcaaatttatagagacagacagaggatggtggatgtcaagggtagagggagaagggaatggggagttaatgtttaatggatatagagtctcaattaggaagactaaaaagttctgcagatggataatagtgatggttggagaacaatgtgaatacacagtagttaatactactgacctgtacactggaaaatactttaaatgggaaattttgttatgtgtattttagcataattttaaggagaaaaatttgtaaggaatttaatggttgtacattttatttcatttcatttttacctctgtgcttttgggctacttttctttttctctttctttttctttcttttttttgagacggagtctcgctctgtcacccaggctggagtgcagtggcacgatcttggctcactgcaacctctgcctcctgggttcaagcgattctcctgcctcagcctcccaagtagctgggattacaggtgtgtgccaccacacccagctaatttttgtattttcagtagagacagggtttcactgtgttggccaggttagtctcaaactcgcaacctcaagtgatcctcctaccttggcctcccaaagtactgggattacaggggtgagctaccttgcccagcccctacttttcttatgtataaataaccccaagtccttcatagataacaagtaaataattagtaagtgaactattttttccttggatgagaataaaaattttggcacaaaaagcagtgtaaaattgaccaaagttataaagcagtaagtgcagcaaatgactccaatctctctttctactcacaaataatttttttttttttttgtcacccagactggagtgtagtggcacgatcttggctcactgcaacctccgcctcccaggttgaagcaattctcctgcctcagcctcccaaatagatgagactacaggcatgtaccacctacccagctaatttttgtatttttagtagagatggggtttcttcatgttggccagctggtcttgaactcctgacctcaagtgatctgccctccttggcctcccaaaatgctgggattacaggcatgagctactgtgctaggcgcacaaataactcttaaacagggcaatagttggtacattcctagttgatttctcctttacatttgtcaaacaagacttagtattcatagttctctatctgcaaaacatcctttacaaagatttgaaaagaaaagcaatcctttaaataattctttataacattccattagcctcaggcatatttttatagtcaattaaacacaggcttttctaatgggacattgattctcatttccatacacaattgcctccataagagcctgggtaatgccatctctggcacatgtccaataatccctgtcttcagggcagtggtactggtcaggaactttttctagactttaatcttaagcaaagccagtcatataattttaggtattggctttatctgctaggaaaaaaaaaaaaaagtcctagctacaatggtttaaattgatgagcctccattttctcatggcacaaacaggaggtagacagggcagttgttgatgttgatatagggtgttgaggcaagttccctgtgactttttaaaaaatcaatttgggggtacaagtgcagttgtgttacatggatatgtcgcttagtgctgaatacagggcttttagtgaaaccatcacccaaaatgtgtacattgtacccattagagaattccttgtccctcaccccactcctaccgtcccacctttccaagtctccaatgtctattattccactctttatgtccatgtgcacacatttagctctcgctttcaggcaagaacatgcagtatttgactttctcagttattttactgaagataatggcctccagtttcatctgtgttgctgcaaaagacataattttattcttttttatagctgagtagtattccatggggtgtgtgtgtgtatttatgtgtgttggtatatatgtatacacgcacataaattgtatatattataattatatataattatatacaacttatttccagctttatatttgtcaaacaagactttatagctgagtaatagtccactcagctataaacatatagtatatacatatatatatatacacacatacacacatggtatgcaatatgtgcataccatggaatactactatatgtatgtatatatatctgtatacacacacacgcgcaccatgggatactactcagctataaaaacaaataaaataggccgggtgcggtggctcacgcctgtaatcccactactttggaagactgagacgggtggatcacgaggtcaggagatggagaccatcctggccaacatggtgaaaccccttctctactaaaaatacaaaaattagctgggcatggtggccagctactcaggaggctgaggcaggagaatcactgaaacccgggaggcagaggatgcagtgagccaagaccgcgccactgcactccagcctgggtgacagagcaagactcggtctcaaaaaaataataaaaaagaataaaatgtatatatcccacatattcacatattctttatctaatcatccattggtagacacaaaggttgattttacaggactttgctattgtgaatggtgctgcaatgaacatacgagtgcaagtatcttttttgatataatgatttatttcctttgggaaatacctaaccagcggtatctaaccagtggtaggattgctgggtcaaaggtagttctatttttagttctttgagatatctccttacaattgtccttaaaggttatattaatttacgttcctactaacagtgtataagcatttccttttctctgcatcctcaccagcatctattatttttgacttctcatagtagccatttggattggtgtgagatggtatctaattgtggttttgatttgcatttctctgatgattagtgatgacgatcattttttcatatgcttcttggccatttgtgggtcttctttcacaaaatgtctgttcgtgtcctttgccttctttttaatggatttttttttttcttgttgagttgagttcctcataaatcctggatattagttctttgtcagatgcatagttgtgaatattttctcccattctatatggtacctggttcactctgttgattatctcttttgctatgcagaagctttttagtttacttaagtcccatttgtctattttttgacttgctgcatttgattttgaggtcttagtcgtgaattttttccctagttcaatgcccaaaagagtttttcttatggtttcttctagagttcatatgatttcaggtattacatttaagtctttaatctatcttgagttaatttttgtatatggtgagagttatgggtccagtttcattctccttcatctggctatcaaattttcctagcaccatttattgaataggatgtccttttctctgtgtttgtttttgttaactttgtcaaagattagttggctggaggaatgtggcttttcttgtgagttttctgttctgttccactgatatatgcatatatttctataccagtgccatgctgttttggttactatagccttgtagtataatttaaagttaggtgatatgatgcctccaactttgttctttttgcttaggattgctttagctatttgggctcccttttggttccgtatgaattttaggattgctttttctaattctgtgaaaaatgaggttgatattttaacaggaattgcagtgaatctttggcttttccctccaaagactgttgactgggttgccaaatttactttcaagccacaggcagcaagaaagtcagcacaacaaggctttcccagaagttccaccaaaccacatctccttacaccccactggccacttctatgtgcaaaaaaaggttgagaaatagtgctaagcacactaccagagaagtttgtctgttttgttttgcttttattttttgtattttggtttgggggtttgtttgtttgtttgttttcactaagaaagaaaggagaataaatacagagtaggcaatctgccttctttactccagggaagctcaggcattcctgaattccggcagtggtgagagataaggtacagagcctcaatagggcatgattaccacatggatgtgacagcagcaacctcaatgttaactcatcatcagatcacatcctttgtcctttttcttagagcatgtgatgccttctccttaccctttcttctcctttcttctcttttttaaaattgccaatgtattgtcttactcatacatgtcctagaaatgtgatgaggtttcaggaaattggggtactgaaaagtagatgggcagctctaatctattttagtccaatctatttcctgtggcaggaccttatgctggcaagaggattggcttgagttcaggcataacctggatactaattgtagaagagatagtgagctttaagtattatttatcaggtttctcttccataaaatgtgcaacatatctattgatatggatcagtatatttgtgaaagttcttgaaaaaaattaaaatatgatttaaatgctatatattacttttgataatttcaaattgcatttgcttttattttaattttgaaatgcaaaagcacatgtggcaagcacttggtcctctacatcaagagggaaaaaaccctgtaggtcagaattattctacagttgaatcactccctgttgaatttttcttttgatagatgcatctgcctttcttagtatggcaagtgagaatcatttttacttttcacaaagtagaaacaacttagaaaatttagaaaattcattataagcctcaagataaatgtgcttattatttgaagatatttcttaagtctttctgagattaacttttcatactaaaataatacctgagtcacttttcccttgctttatactttcctttgtatctcaggtaaggagctcaagataaatccttgagcaataatagtaatttgtctgtaattggcatatattacagagctgagtctgtctctgtctgtctctctctctgtctctgtctctccctgtatctgtctctctgtctctctcagagttttaaagacaggctctccctatgttgcccagggtggtctcgagctcctgagctcaagtgatcctcctggctcagcctctaaagtagctgagactacaggcatgcaccgccatgcctgactgccacagctctcttgattaaaacatttttttaggacataggattctttttggtggcattagaagtaagtaagattttcatgtgtgagctgccttaccttgttagggggttgagaagtgactaacctgaatattatatcaatagcaaaagcaaaaagagaagatgcatgataagaagctaaattctgagtttatcttgcctttaccactcgaagtagttaggttagtgttagacacattgactaattatatttcctattttagtgctgctttgtgaattttctcttttatgctggtcacttattgtagcattgggctcagaccaaagctctgcatttggctctgcgggcatcagtctctgaagggtgtgtcccagcagagggccaaatgcttctcagggcagctggggttttcagatggcaataggtcaaaattaaaaatagggatataaaatcttcttttaccctggctcatccagtttggcagaggctagtttcagaagagtctagaagtgacatttccactttcatgggttgatataagggtttgtcaagtgaggaatgctgttggacttggacatgccagtgacttaaatgtgaggttcattgcagcaggatggctgagtactgggtgcagcagcccctcaaaaccctctgtgttgtttgtgatccttccacatggctcaaaaagattgtgactgatccattgtcaagatttggatcatacttccaaatataaattcttagattctattttctttttctaaatcttcctgtctatggaaaaaaatcattctgatttgtcattagcatattttacatactcaggtttatgtccatgtcaaagtgtaatcttacacttcttgtaagtgactgtgaaccagggcaacatcccccaaaactctttcttggggcagaagaccctgatggctcctgaggcacagctgactaacagtttatcaagggaatcttgattgtctctctctgggtatcaggggtcagccaagaaaaggatgccagaatatgctgaaagctctagtactcttgattcaaaacctgaggattcctttcttcatgtaattaatacatggcagttattgtgaggcactagagagatacaaagacaaatataacacaatatacgcccttaagaaatgtatatttagtaggaggggacagataaataaacaaaagagtgccactaaatatccccaggactttgataagagtcagtcagggttgggggtaggggttgaggcttgagggatgggaagaaataaaaaacctcatggagggtgtgacccttgagctgaattttcagctgacagatgctggctgctgggcatgttggggaaaagcattcttgtagagtaaggcaagacagagaaacatgagactatattctgtttgggggacatgcaggatgacagaccagcatgaagacaggttttgtaaaagaggaaatcaaaaggccaaatgaggagagatggtagtgtcttaacttccatgaacattaaaaatttcaacttgtaagcagtagatggcaattaaaggtatttttttaaataaaagaatgaatggctctgaacatgccctagtgataactgattgtttgttgcttcttcctcctgtcctcaatttaaataaagcaagtaattatcgagcatgttgtaacataatttcctgtaaaagggaaatttatattccttttggaaaaccaataatgctctaactctttttgattaaaatgtccatattaagccgggcgcagtgactcacgcctgtaatcccaacactttgggaggccgaggcaggtggatcacgaggtcaggagatggagaccatcctggctaacaccgtgaaaccccgtctctactaaaaatacaaaaaattagccgggcatggtggcaggcgcctgtagtcccagctactcgggaggctgaggcaggagaatggcgtgaacccgggagatggagcttgcagtgagccgagatccagccactgcactccagcctgggcgaagagtgagactctgtctcaaaaaataaaataaaataaaataaaataaaataaaataaataaaatgtccatattaaattatgttttccctacttaggaatgcaggatacatgagggcactatattcatgtaccacttggtttaccagtatttgcttacttaatcatgatttcttaagcaatcatagaaaaccactagaaagagacataaactatttgaaaatgcactgtgcacatttttatcttgttcctgggcatgtgaccaagtgatttgtgttgacagaatggttatacgccactgcacatcgctgccaaaaagaaccagatggacatagcgacaactctgctggaatatggtgctgatgccaacgcagttacccggcaaggaattgcttccgtccatctcgcagctcaggaagggcacgtggacatggtgtcgctgctcctcggtagaaatgcgaatgtgaacctgagcaataaggtaacccacttctttcttgacaaagcatgcagcacaccaaaacctcacccctcagaaaggtcactaagaattcacagaagatctgagtcaaataggatgtgtaaagtgtaatattgcaccaagttgtttaccaaagtgttacttaacagagcaaaaatttggaaacaatctgtttaaacaataagaaaaatggtcaatgcgccagttgctctggctcaggcatttaatcctagcactttgggaagacaaggcgggtagactgctcgagcccagaagatggaggctgcagtgagctctgattgcttctttatactccagcctgggtgacagagtgagaccctgtctctttaaaaaaaaaaaaaaaaaagacagaaagataatggtaaataaataattcagataattcagtcagacaatgagtatatatggaagtggctctatgtacacatagccataaaaatgaagtccaggaagtttttgtagtaacataaagttttgttataatgttaattcaaagagcaccattgttacttcaccataacatagcaaagaagaagctgcaaattgtagccctttgctttatttcacaaacatgtttggggtcctgctccttgctcatccgtttttaagttctaggttacaaagagaaatgggaaacattgctgccttcgtgagttcattttaataacaaatttagagtagctattttatggagtagataggagaagttgttggcaattttgaaggaacttgtgaagactgttccctaaactcttcaaacacccatgctgtcatctttgatatgctcattattcatgaagaaaagactagagttttgtcaagcaaagtgaaagttcagccgacaattaaccagaaacttgttaatgaagttactgcctctccctgtatgtatcaaatttaggtttgctgaattgctcattaagattgacccaaaacacaagacaggtgtttctaaatcttcagataataggaaaccacacaaaagggccctcagattctgataacctcccctgtctggcatttagcttctcttctgcctgctgggtgtgggcatagctgtgatatttctcaggcctagctcagatattggagtagggttgcaaaatagcaatagtcttatgttgacaaataacaagtaatttaaatactttcaacacgtgtgcctgtgttttgaaatcacagagagtttgaatcctaagttggattcttcctgtgtcatttaggcaagttatattacctctctgagcctcagttttgtcctttagtacatggagatagcaatactgacttcttgagttgctttgaggatacactgagaaaacattcaacacttttaagtaagaaaaaatcgtttttttaattttggagtttttacagttttggaaaaaggttactccataacaatctgaattctcaaggttattatttaacaaattctatagaccaaaagacatatacaggagaccagggatatctttttttagttttagtattgtgaaaatcttttttggtcattacagagcaaacacatttttttaattttatttttttcttgttaaacattccttttaggagtgcatgtctcagcattaatgggaatcaaaaagcaatttcataatcgtcattatagttaagatttgtttgatcttttgaattttctatagttttatataccaatttagagaccagaattgtaatggcttgcctcaaaactcaatttgtctttatgacaaagaggaccttgtgtttcccaaattgaagcacatgctggtatcagagtgtattttctcttgtgagcccataatattgtatttcatcatttcttccagaaacaatgtagtactttcacaattggtttaaattgaatatttccagtaggtttgataccaaactgcagtgtgactgactttgtttcttcaaaatcctgcagccaactggtacaatatatgcccagccttgaattcatcttagcctcatagggtgattttaggctaaaaatatttagggcaaaaattttctcagtgcttgttttagtagagtggaaattaacaaaaggaattctaaagactcaaagacatatagcaaaccagggaaacctggaaatttctggccactttcctgagtaaatgatacacaagcagagatattcctaaaggaattctaaaagatcaactggctttccattagcatgttgaacttaaggaacttctgagaacttctaatacttttaacttctaacttctcattagaaactatctaataagaaggcatttgtaaatccttgcatcctttctccgttgtcgttttcagtataaagcactaaatatgccctgatgtgaaaacagaaaagcagcaaaactttttattattcaataaggaactgtctctcagtttttgtcagtttttcctgagctgccagtgttttaagcatcaattactcactgttccctcctcccttctcctgcctacctttccctcttctcacataacactacattttatttccttgctaaaaaataactattaaaaaagatttagctttcataatttatgttgaactaaacactttattgtttttactttcttttttcttactagtaaccagcactttcccagtacttttaaggaaaaatgatcatgaaccccaagttattgttgaggtgctagtgttcgatttgattcaattttgcttttgatgttcctattttcccatataggttttgcagaccccaatgcttatattttttatacaactgaaagaatattaaacagagatgttgctattttaatttgatgttttctctgtttcaaataaatacctttttttttttttttgagacagaatttcattcttgttgcccaggctggagtgcaatgatgcaatcttggctcactgcaacctccgcctccagggtgtaagcgattcttctgcctcagcctcccgagtagctgggattacaggcatgcaccaccactcccggctaattttgtatttttagtagagacagggtttctccatgtaggtcaggctggtctcaaactcccaacctcaggggatccgtccgccttggcctcccaaagtgctgggattatagacgtgagccactgtgcccggccctaagtgctatttttaaaatgagcaatgatcaaaatgccataaaagattaacaggtaacttctgaactcaaacagggctgtggttaccttcatattgttttttaaaatcttttgaattataaccaagaatataaaaataaaatgttatttatataatttatactgttctacctaagaaaaatgtttgattttttttctctgatttaatctatgagtgagtggattaaatgctagatgctagacactggttatataaaaatcaaagatacgatacttgcctcaacaagctcacagtggtttgaggaagacaagcaagaaaacagagtttaaatgcaggattatgatatttgtaatagaagtgagcacatagtaggtttgcacataaatgtaataacttggccctttattgaaacgagaagagagaaaggccagggaagcctgaagtgactccatcagtgagtgggtaagccagctgagcagcaggcacctagacatgggagcatgaggggacaacatgtgcccacaacacattctcagtctttgctgagagctactcagtaaggtaccctcagtgtcaaaagtttcaaacttagaataggtgaccatgacactcacaaaatgttgtggctgacaatattatttcctctgaaggagaacacggaacatggttctgtgatgaggtcagtgtttgggtggtgccaattttggctctggcttatttttcttgaatttcaagtgaatgcatcagtcctccttttcacatttccccctttattcagttcaagtgagcttcctccaaaattctataaacattattaaaaagtcccagcttgactctctctgcattccataattgctctgatggaatagcaacccctgaataaataatgtttcacatctagaagactctgtgctcttcctgaaactgcctttgattacctcctttcctctgacaaataggacaggctgatattttcattgcacagatgctagagggggagaaaagacttccaggattaagatattaacttctgtgctcataatggatgaaagcaaaaaatctgaaagtactaacaccaactcactttctcttaaatattataaaaaatgctttacaatttaaagaggttttttaaaaccggagtataatcttagtaattttttttcttggtcatgagagcaaccatgtgttctgcaaattctctaatagggttagtttcaaatactgtatcagtcttgttaaatccatacatcatctaaatgacctggaaattgtcatgatcttgcattcacattacatttcacaggcgatctttcctacccagagtgacatacagaaaatattcattagaccttgggaattaatatggagaaaatattatcagcatatgtcagtgttcactttgtaaacagatatcatttaaataatttttggtaaagctagtggcattggcaatatgttaaaactcttgcataattttgtaaaaaaaaaaaaaagtctaatttttgtagatgaacactgaaatgtatgggggtaaatgttatagtgtctagatttgtgttaatattgccacaaatgaatgaaaaggaaaagagggataggtgaaacacatataggaaaactttgataattgctaagtctgtgatgagtatacaaggctcactccatttcttacactttcgagtatgcctacaatttttcatgcagcctacagatagtcatgttgccacagtgctaagacagtataacatataatttttttttttgagacaggtttcattcaaccctgtcaccaaggctggagtgcaatggcgctatctcaactcactgcaacctccacctaccgagctcaaacaattctcctgccttagcctcccaagtagctgggactacaggtgcatgccactgcacctggctaatttttgtagagatgggaccttgccatgttggccaggctggtctcaaactcatgggctcatgtgatccacctgcctcagcctcccaagcatataaatttattccataggttttttctaacatagaaattctcggcttaccatcttagaattcacaaatggtttctcaaacatggctatgtgtgtgacattccttcctgtacgatgactgtgccctttgaatcttttgcagagcggcctgaccccactccatttggctgctcaagaagatcgagtgaatgtggcagaagtcctcgtaaaccaaggggctcatgtggacgcccagacaaaggtatacggccctcccttgccacacggaaaagaatgtgtccatttggtgactgcagtaaggaagaaactataattgtatcaggagaacaaaccctttaatcatctcttttctacgtagtattttaaatgtttatttatgcaagggacactaaagtctccggttgccgtattccagggacttttgtctttaacggcctgggtacttgattctagctgcacagtaatttccccctatattaacactgttgagcctccttacaacaaatgtgtccttcggggcagagtgtgaaagcttgtacctttcttagtttttgtgatggatgttttaaatgcagacaaatagacaaatagaaaaacttgtaatttgtgacctctacgttcgttcagcatgatttatgaaacaggataaattaaggcttatttaaatattactcacttgctaaattcctaatggtctgtgcggtcatgcgtgtgttctccctctctcagacgagaaagctctcatttcaaaaagaaaaaaaaattgctaattaatcttatataatgccacaactcaaacacacacacaaaataggacttctcatgtcatcatcaaagatatagcttcacattaatcacatttctttgaaaattttctttatatgcttaattttgttatttcttcatatcagatttgtgtcatttgtgtcatctactctaacatgttttttttttggtttttttttttttttttttgagacggagtctcactctgttaccaggctggagtgcagtggcttgacctcggctcactgcaacctccacctcccacgttcaagcaattctcctgcctcagcctcccgagtagctgggactacaggcatgtgccaccatgcccaactaatttttgtatttttagtggagacggggtttcaccatgttagccaggatggtcttgatctcttcaccttgtgatccacatgcctcggcctcccaaagtgctgggattacaggcgtgagcccccgcacccagccacatatgctttctttctatatgccatgtttgacatgaaaaagaatgactactaaatattgtgaataaaatttttatatgtaatataggcaggttctgaggtatatgggcatattgaagtaactagtaatacagaaatattaccccaaattagccagataaaagggtattgacaccaaaatgagactgaatttagcttattttcttatgctgcttgaatactttcatcgggaaataattcttgactttggaaatttgcaactttatggtaaatgtcttcattccataccgctttattcacacacagagagagagagagacagacttaaacactttcttaggttctctctcctttttatagatataaaactctagaaggcaaggtctgggtcaagtttctcaacatttttctgccccagcacatccaagccatgccctaaaattcagccagggagtatggtgaggattcttaaggccaggtcggggaggagagaaacaagtactgtgctgcctccatctgttttccatttgcacacacagcccctcgatgtacgagtctcaggactccaccacagtttccttctaacccagcccaactcaggtcccagttggtagtctttttttttttttttcctccaagagggagtctcactctgtcactcaagctggaatgtaatggcttgctgcaacctccacctcccggattcaagcaatcccacctcagcctcctgagtagctgggactacaggcacatgccaccacacccagctaatttttgtatttttagcagaggcagggtatcgccatgttggccaggctgatctcaagctcctgacctcaggtgatccatctgccttggcctcccaaaatgctgggattacaggcatgagccaccgttcccggccacgtagtcatttttgtaccccgtatgatatctggcagcatgtaacctttcctgccctttacaaacggagcagagcgtctcacttcagaaagcatctctctgtcctttacaagttattttcctttcctttctcttctctgcaaaggtcacagccaccaaaaggaagtgaagccatgattgtcccataactagagcacagcagaagtgcagatagctgggttgcttgcatttgctgcttaattttgtgaataaggaatttgttgtatcccaggaatgttcacattctcactggtaaagaagacatccccaagcagcccacaggtgggatgtataccattcaactcattggcttacatgcaaaaataattaataataataaaaatatcaagacctcttctccctgatgaggagaagactagaaaatcctggtaacagcctttgcagtcctctccccccgcacccctccagtttgctgaccctttataccccaccccccttttgcatttgaagttcaccaaatgagtttaagctaaattgtgccacagggtataataatcagtgttgtttgatagagatgaagccactgcttttgcttttcagaaggataatgtccggaagcattttatttagaccacccctgaaaggcattgattcttagaggacactaattagggatcaggagttacactggatttctttaaatgtgtgtaaaagcataaaaagctttgagaacttatgtgatacttacctatttcacatttatgtgtagatttcctgctggtcaccaaattcttacctgggagatatattccttgccctcatagaattcatagtttagagagcaaaactcatagtattataataacaaagtcatcatcataataaaataaaacaatgtattacccattttctctatgccgggtactattctaagtgcttttcatttattattttgtttaattcttacaactaccctatgaggctggtaaaattagcatcctcgtcttacagatgaggaaactgaggcacagaaaaagtaattacttgcataaggtcccaaagctaattattacaaagcctgattttaaccacaggtctatatctagaaatatatatataattttagagtattcggtaataactaagatttttgacaaaggtgggtaggatagaggaagcttgttcaatatcatgggaacatgtgaagaaaaatggggattatgtcttaagatgttgctagaaaattaagatctcagagggccttaatgtaccaggctaagctgtccagctttttatcctgtttgcactgagaagccactgaaggttttaaacacaaacgtgataagatcaacaatctggtttacaaagatcctgggaagcaatgcgaagaataagttgattttaaaccttgcagcagggtcagttaggctattgtgaaatccaaatgaagaataaagaaggcctgaactaagtggcagatgagacactgagaacaagagagaaattagagagataattaaaagacatacaaacagctaagatttgaagacttttgggaggccgcggcggccagatcacgaggtcaagagatcgagaccatcctggctaacacggcgaaaccccgtctctactaaaacaatacaaagaaattagctgggcatggtggcgggtgcctgtagtcccagctactcgggaggctgaggcagaagaatggtgtgaacccaggaagcagagctcgcagtgagccgaggtcgcaccactgcactccagcctgggcgacagagcgagactccatctcaaacaaaaaaaaaaaaaaaaaagatttgaagaccatgtgtggtatggggactaaggagaagcaggaaattcaggaggaaactaaggatctgacctgtgcaactgggtgatcacaagtaccattcaatgagacagggaataaaggagagacaaagccagctggggaaagaggactatgagtttcctattgggtgtgttgaattgtagattactgggggccaatcaagtaggaaaacccaagaaatgactcacatattgatctggacacagaaaggatggctggactaaagatgcagatttcggaatcatcacagtcaaggtattagctgacactgtgaaagtagatatgatcctcaaggaaaagtgtggcgcaaaccaaagacaaaaccctcgggatccactccattttacagtggatggaggaggcaaaggagggctgtccaaaggtagaggagaaatcaggaaagaatatgatagggctgtcaaattatgaaaaactgtcaaggtgtttcagataagagaagctcaaagtccatgcatgccatgcatggctgggcacttgggatattaaaaagcagttttactagagcagtggagatggtgaaatgtagggaggatgagctggaacagtgaatgaagattatttttttttccaagaagtttagttttcaaaggatagaaacctagagaaaaggagaaatatttgaaaggagtgctttttgtttctaagatggaaacataaaaatatgtctataagctgagatgagcatgccagaggaaagaaaaatggttagcaaaattacttggttttttttgtttgtttgtttttgtttattttatttatttatttattttttgagacgaagtttcgctcttgtcactcaggctggagtgcagttgtgtgatcttggctcactgcaacctctacctcccggattcaggcgattctcctgcctcagcttcccaagtagctgggattacaggcaccgccacgcctggctaattttttgtatttttagtagagacagggttttgccatactgggcaggctgatctcgagctcctgacctcgggtgatccgccggcctcggcctccaaaagtgctgggattacagacatgagctactgtgcctggcctggttagcaaaattataaggggtatcagaagcggaataggctgagccagagttagaaatgacaatttctttttctttctggtttttttttctttcttttttttttttttttgggagacagagtctctcactctgttgcccaggctggagtacatgggcatgatcatggctcactgcagcatcagcttcccaggttcaagtgatcctgccacctcagcctcctgagtagctgggactacagacacatgccaccacgcccggctaattgttttttgtttttttttgttttttttttttttttgtatttttagcagagacagggtttttgccatgttgaccaggctggtcttgaactcctggcctcaagtgatctgcccgcctcagcctcccaaagtgctgggagtacaggcgtgagccaccacacccggcctgatcttttcctattttcagtcattaatttaccaaagatttaaaatatttattgagcactgatgatatgccaggcactgttttcagcacgaggtaataatagctaaccctatgtgtcagacactgttgaaataattgttaacagttaatccttatgacaacacaatgactttggtactgctactaaagtccattttataatgcataagccaatgtacagagaggttcaataacttatccaaattcacacagatagtaagtagcagagctgggtcccaaacccagtctgcctctgaggcccgggctcctggctgctgagcccctccttcccccgttctcatcagtcagaagtgcagtcttatcagtgaatggatgtaaacatctactacttggtaatcaagagaggaaaaaaggaaggaatgctgttaaagactcggatgcattttgcagggttttgctgagctctatccagtgttgcccaaaggaaggaaggaaaaacctaatcagcttgtaatgatgttatcagtgaggcagctatgacaaagaggtagaggctgctctgttccctgggctatggctctttatttgtttgcttatttagctactcaagaaaaaaatagggagtctttgaaaaatttgttactgctgattggaaagaattgctcatgtcccacctctctgagcgtatttatgcgaggtgctattttgtatgggaatgctgttaaccccgatgaatggaggagcccacatctgatttctctgaatgcaagttcaatcttcttggccatgcccatgtatttttgaaaaaacactttagtgtttgtgtaacagcaggaagaccagtgtcctggagcacagcgaccaagggagagaattgtgggaagactaaaagatgtatggatgggggatgaggaggataggggagactagaattagacagctcctaacactgtattataatgacttagggttttaataagaatgagatgggaaactatgaggatgaatagaacctgtgcattaacatatttaggccaggcatggtggttcacacttgtaatcccagcactttgggaggccaaggcaggaagatcacttgagcccaggagtttgagaccagcctaggcaacatagtgagacctcatccctacaaaaaatagaaaaattagccaggcgtggtggtgcatgcctgtagtcacagctacttgagatagattgagcccaggaggggaggctgcagtgagccatgatcccatcactgcaccccagcctggtgacagagcaagaccctgtctcaaataaataaataaacaaccctgtctcaactatatatacctaatcaacacatccatctcaacaactattagaaatggttgtattataacttaggcaaattgactaaaatctcaaagaattttttaatatttagatttttaaaaaatattgggtccacgtggttttgacttgtaaggggaagttctttgaacttggaaataatgttacttcaatcagttaaaccattgtactgagcactgattggacacattattttcaagcttcccttattaagcagtattctgatcatgggtgcagtatctgagttcctctgtattgaaaaggagaaccctgcaaagcaggcaaatggattctggtcaccaaaaaggaatatcttccatcgtgtattcagtagcgttagaggttgtaagtcagtttcctatatgtggttatggtgagctttccagggacagtctggtcagtgtgggtgcactgacagtgtgtttagtgagacaaagtctaccaagagtcaccgctctagggcagcacatccctggtaaggtatcttcaccttctgcagtcaactgtggtttgggcatctctttttcaaattcaaatgtattcatttgctggggtcaccataaagactctagtgccatcatataagatacagacccttgaaaatatggatcacccacccccattcctgtttagaaatattgtgataaaaggtcaatgttctccctttcagagatctggtactgcctgtgtcattatgaacaggggctctgaaattgcggggtagtatgttataatgaacacagccatctagagaaggatctggaatatccttattttaaagaaaataattatctagattgtatacacatacatacacacacatatacacacacagagaacttatagcccctcaggggtcagtggatactaatttgagaaacaaaccatttcttgtctaaatcagtgaatcagtggttttcaaactctgggactctaggtaggaaggcaaaagactaacttgatataccttgttcaagttcatacttctcagaccacctgagctctcaccagcctccctcttccttttagtgtttctgtgcttcttcctatctctatcaggcattctgataatcacctcctgccatgtgttattatttagccacttcatttttgcctagatttaaagctttcagaaagtattcaataaacaagtcaagtctccataaagtgctcttctgaccccgaataagaagccactgaatcagtttgtctatgctgtcagttgttccatctttcctttgtatcttgaaaagttctaagaacaagatgacctgataaaaaataaagcactttggggagctaacaattttatgggcagtggtattttaatttatacctaagtcttatgctgagaattatcaagggcaatttttttaatatagagaagaaaaaaacctacttttgccagctcaaaaagaaaggttaaataatgattttgcttctgtttaggatagctgttagtaaaagtgtaattatgatgcttcttttttaaaaaaataataattacagatgggatacacaccactgcatgtgggctgccactatggaaatatcaagattgttaatttcctgctccagcattctgcaaaagttaatgccaaaacaaaggtaagctccttccttttttgtttctgccagaatcatttatttttgcttcaaaggaattaagaatcatctcttccatcttccttctacagaatgggtatacgccattacatcaagcagcacagcaggggcatacgcatataataaatgtcttacttcagaacaacgcctcccccaatgaactcactgtggtaagcgctcagggccagctcaggagaagagggaggagatagatgggcctggactctggtgtcttcttacgtttttcattgtactttcatgaagaggcataaacagagcattcagtagaatgaggaaagaaggacaataaccatattgttctgagctgttcagagagagagagatgattagtgttttatatgtgaaaactacctactgcattgtcacctagtaggaagtacacatgtaagaaaaaaaaattgtgttggtttcattgattgcttacttagaacgttaaaaagcctcttggattgcatgtgtagctgcccagactttgctgtacaaacaggttaggtgggttttgtgcaaggtatgtctctaatgaaacacttatttgtgtatgacagtgggatgggtctgatgagacactcaccttacattttgtatcagcaaaaaaaatgtggaataaggcttgctaattcctcactcacattttccttttgccagaatgggaatactgcccttggcattgcccggcgcctcggctacatctcagtagtggacaccctgaagatagtgaccgaagagaccatgaccacaactgtaagtaaggaatgcagaaccttgttaccctaggagccagctttcagccagttttcttgggtttttctgagatgaatattttttcccattcataaactaagcaccatgttttaaaatacagtcacctcattgttggtagtcaggatagcaaaactcttattgctaatatgaataaaagtttaaaacactaagaatacctatttaaaagatgcatctgtagctatagagtttttacttccatatacagctaaatgtatttatttatttgtttgctttgatataacaagttcttaatgaaatgatggtgaaggcagaaattttttaacatccttccttggcagcgtaaagaaaattgaaaactctaagttggttccttaaaaatgttttaatgcacaaatggtacatggatacattatcattcctgtaaaaaaatgtttacattgttttaaaaaattccagatgggatcagaactggttttgcctgctactgtcactcatcttctgtcctattggagttttcataagaaacacaataggctgttttgttaaaatttaaagtggatctttaccaggaggccctattgcatcaactacatttttacaagctgcagcctctaggataagtcatttctttccaaccccatctggtacctttgaacagcattaacatttggtaactttggaattaaaagcaaatattacatgatatcagaggcttatttgagttattcctgactccatgactcaacacatagacctgaggttgactcttaacaaagtaaatataggactctggaacattttgaattatcagctctgtccccttttctcttcgaccaccttccaacatgaaggagaaaatggttagcatctgcaaattagtttgtatacccactgctttttgtgaaaaacatgggttgaaggtctctgtaactacctgcagtttgagttatctggcagtgttactcaatgtataattcttagtctttagaaactaaaaaacaagcctgctgattacgggagaaaaattttgtaatttgcaaaagagaaaacagttgttttaatggaatagaacaatgattgtcaagcagcacccattccgaacttcaagttatactttgtctaagagagaaatttccacatgttgctttcatacacctcttgaggattttattatattaaaatctatcattaagttctcaaaaaaagtgttcaaaccaataatgtttattacctttaattttatatcccatgtagctctatctaggataggaaaggagaagagaacaaactatttaacgatagccaagtgtcacaatgctataaagatttgaagtcattgcagtaaatatataatattaatacttctatttcaatgttaaaagacttgagacatgtaaaagttcaaaatacacatcttatttggttgaatgtaaatggctttctcacccattacaaaatttcaaaacttttcttcaaaatcaaaaaaaagctttaagagaaagtagagttaagaacaaaattaagttacaacttcaaaaaatcaactgaaagacagagaagggtctcagagctccatcaggttcccatcagaagacagaatgtgtacaggaatagtgccttttcactctcaacatcatcagctgtccttgttgatgactttctgcaaaagagagaagacactatgcatgctaattggaaaggtccagtttgcctagtgaagaaaatgaggcttccaccaaaagaagtgttcacgttgattaaaaaagagtccagagaagtctctaaaacttcgcccagcattgtggtatttggtacattatctcaagctgagacaccaccttgtcagccttgctttagcggttacatgtaaactagcttagacaggactgatgtaattcagggtggagtctatgactttaagctaataactctagctcagcctccaccacaggcatgatatttgtatagctagttactgggactccagcagccattgactctataaacagacttcagtttttcaaaacaaaaagagaatgtcttttccatgtgagtaaaatacatgatgtggcaatgctgagaaagacggtttagttaattagattacaatcaaaacagcataccaaactgaatggatagaagctgatattcaaaagatgtgaattgtatctatcaaaactgcattgtttaaaatacccaattacttcatatgtaaggagcagaacacctctagcacacagatattggttgctaatactattttctactaaaagcaaacagtgctccttggagaaatggctgaatctaaggatagcacagtaaatatataagatgagcctggaacatcttagagtgtcaaaaagtaaggaaatgctcctccctcccccaacaaaagtaaataaactaatacagaggcacaatggtagggggtatgttgaagggacatatgaattaactaaaagagttcccaatggccatagctggaacaatttgagcaaaaataaataaatataatagtcttgaagtatagtgcaaactgtaaaataactatccatgaattcatactattatacataagtaattcaataaatggaaaagaagacacaaatttctcaggcaaaagaattccaaataatgtatgaaaatacttcactctcgaagtggaacataattccccactgcttacatgtgggctgaacatagtgattcctttgcaaagaaaacagtatggaagcagggggaaatagagtaactttacaatggagaaacctgacaaatactgcttcagacatatgatcaagatcaacatcaacaatgataagtcatgttgatggtattgtacccttgatacaatgtgatgaaatggcacttttcctctgtgatcttcctccgtaaaacatacagccccagtctattaaaaaaaaaaaaaaaaaaaaaaaactatgagacaagccccagttgatggacatatctgactagtatactgcaaaactgtcaaggtcatcaaaaacaaggaaagtcaaatgcaaatcaagaccacaatgagataccctctcataccagtcagaatggcaattattacaaagtcaaaaaacaacggatgctggcaaggctgtggaaaaataggaatgcttttacactgttggtgggcatgtaaattagttcaaccatcatataagacagtgtggcaattcctcaaagacctagacccagaaatatcagttgacccagcagtcccattactgagtatatacccaaaggaatgtaagttattctgttacaaagatacatgcatgtgtatgttcattgcagcactatccacaatagcaaagatgtgaaatcaacccaaatgcccatcaatgatagactggataaagaaaatgtggtacatatacaccatggaatactgtgcagtcataaaaaaggaatgatatcatgtcctttgcagggacatggatggagctggaagctgttatcctcagcaaactaacggaggaacagaaaaccaaacaccacatgttctcacttacaagtgggagctgaacaataagaccacgtggacacagggaggggaaggacacacactggggcctgggggtggggagggagaacatcaggataaatagctcatgcatgcgaggcttaatacctaggtgatgggttcataggtgcagtaaaccaccatggcacacatttgtttacctatgtaacaaacctgcatgtcctgcacatttaacctggaacttaaattaatttttttaaaaaaacaaggaaagtctgagaaattgtcacagcccagaggaacctaaggagacacaactaaatgtcatacagtatcctcgatgggatcctgaaacattaaaaggccattaagcagaaactaaagaaaaatgaataaaatataaactttaataataatgtatcaatgttgattcattaattgtgatattttccatgctaataaaagattttaataataggccaggcgcggtggctcatgcctgtattcccagcactttgggaggctgaggcaggtggatcacctgaggttgggagttcgaggccagcctggccaacgtggtgaaaacctgtctctactaaaaatacaaaaattagctgggcgtggccatgcacgtctgtaatcccagctactggggaggctgaggcaagagaatcgcttgaacctgggaggcagaggttgcagcaagccgagattgtgccactgcactccagcctgggaaacagagcgagacttggtctcaaataataataatactatcaatgaagattttaataataaggggaacttggtgtggggtatatgggaactgtctatactatcttcacaattattctataaatctcaacctcttctaaaaataaaagtttatttttaaaactgctccattgcagtattacatgctggaaaagacatcaaataatggttgatttcaacacaataattggggataggggtagaaatcacatttaccaagtattatctctaagaaactatgaatttgtacctttttttagttttaacaacctggctttttttcagttgtctcatttaaacgtgtatcttcccttgtaccattagtgtctcatatgctgagaattaaaaaaacaaaacaaaacaaaaaaaaaactcacttttaaactaaggtcattaagattttcttaccagtgatgctaacagtgtcttttggatggatataatctaagattttcttaccagtgatgctgacagtgtcttttgggtgggtataatctaagttatcaaagagaaagtaaaagaggcagtaggcatttgctgcataatatactgttctttaaattttgggggaggctaaaatgatctgccaatgcatcaccttttaagtattttttcatacacaatattgtaaagattattgttgtaaatattattttaatattttgttttatcctatgaattaaaagtacatataagaggagaacacaaaatagacggaaagcttggcacaagtaatagagacatatttcttgcagctcatttggcttctcttcagccgagacctttcgtggaatggggcggcagattcatcagaccatgaaaaagtatagcagtggagtaggaggggcagaatcttctcttttcctttgaaaagctttattagagacctaaatcttttaagctgtggtactttgccactagaattctttcattttgtactcctgtgctttgtatatggtgacaacctttgtgacactaagggacaacaattttgatgttattttatatgtgggagattcaagatattcaacacatacattccacaagaaactgattaattcagagataaatgaaaagacccattaaaatgtacagtctgctcacactaaaatgactgcttttttgttactagactgtcacagagaagcacaaaatgaatgttccagaaacgatgaatgaagttcttgatatgtctgatgatgaaggtatgaaaatgttctttgagttcacaataattataagtgactgtgtattttgtttgtttcctgaagaaagtccattgcaaaaatgtttatcaggaatattgaaacgttttgttgtaatatcaagagtatgtatttttcatccacttatattgttcacttcaatcatgcagttcgtaaagccaatgcccctgaaatgctcagtgatggcgaatatatctcagatgttgaagaaggtatttgtaaatttttattgtgatgaaacttaactactaccaactttatctttcatttcttatctttgaaatataatatttccttgagttactaacttttcatattatcttgagattattaatttgtgtattatttaaataatgtatatctggtactactagctctcctttttaagtctctttgaatcctctttccttgaacctgtttcctaactttaaaatataaaagtgtcactaattatctggattacttgccttctctttgtttctatcgaacagaatactgatgcttttattgtttgcatctgaaatctagaaagggaaaactggttaatgtttatgattacaatattttttaaaacaagcgaagtttccttataggaaatccttttaaatgccctgagatttgcccattctgctaaactttgtagaaaaagcagcttttgatcttgaaatgataatgaaaacaacctgaaaaaaaaaacttttgaaatagaaattttcaataatgatttaatgaaagagatcaaaatattattgtagctatactttatgtgttttcagaaattggtttctgttttgcttaaaaaccaatactttgaccaggtcatgatatacagatatatcaatgaatggcatctttaaaaggtccattggaaaacaagcatttttatagtgagtaaatattgtactgatgacacattttggagtgtcactgtaataacaaaatatttaccatgggaaaattatatttaactgtttttcttgcatcatttgactctcccaaatgatgggagatcatcaaatacagtctaccctattatgacctccatttgccacctgtcatgtagtagctttcttttggttagtcttagtgttgctagtctttttttgcctttaagtaatcttccctattttaattcatatgatttctttctttgagttgcatgcatttcattgggaacctaaatagtggaaaagcttgcctagtctgaagccactttaatcttttcgttatccaatcaatgacttcccactataatgcattgtggccagggactgcacaccccagtgagctaatgtcctgctggtcatttagggacctcggaggatctggctgaatgtttgtaaatgctgttttgataaatgctaaaggcttttactcagttttctttctttttctctgaaacatctgctatacatttacctcccttctatccccaaatggataatatttgttatcgtctttaggacttttagaataatatacctactgtcatattatatttcattgccttctcatacatttcagagtaacttctgtgcagaagataaaagaaaaaatgatattcttacatagatgtttacacacacaaaacatgatgtcaaaagtatgtttgtcaaatgaaattattaggaatcatggtatgacaatcatagacctaaaaatttactgttcattaacgaaatatctaaaattatccccattgatgagaggccaagtttgaatggactaacagccttatacatatggataaccaaataatttcaaaaatggagattttgaatctcgaaatttgaatttaattgacctcgttacttaactagaaatgtgtttatctcagcttgggaatttgaaattggcaattttaaattctcattttatgcatcttttctttaaaatctttggcccttactttaatgtgtccagggctattggaatcaaatggcttttaattttgtggtattgccgaatttaatgttgaaaaggattccttaaaggtcactcagtctgagcaaacatctgctggaatctcatctgcttaggatctcctgtgcccaagcccttcaaataatgagaattctttaattcctaagctgcatagtccatttggacaattctgtctttaaaaatccttcatgttattgaacttcctgtagcatctactcattgattcaagctttggtgtatttgaccaagttgatgggaagactacattctatgtagtattttgaacaaaagctgccttttctgtgtgacaatctttcagatatttaaaaatgctttttctatttctttttagttttttttttttttcaggtatatcattgctacctccttctattgttcccctcagcaacctggtcgccctctcctgtgcatgtttcaatatgtctgtgccatctcaagttgaggtgaccagaactgaacacaatatttttagtctcgtcaaagcagagtatagcaggactattgcattctccatggaagatgttaaaagtctatttttgaagattaaggttataatacacttttaattcaagtcatattagtattactgtctgctaaggtccctaaattttgcttacaagagctctagtaagccacatttgccctattatgtatttatgttgtcctctgctgcataaattagcatttctaactactgcaaatcccaaaacaaatcattttgaaatttggattctaaaaggacccctacaacttgaatgataattttaacttctgactcatttgcctgatagtcttgccagagctttgattgtcattttagttagatttagtgttggccatttgagtaagctcctatgcagctgtggcaaatgttcatttccatgaagccataggcatgttgtgagtataactatctacaagaactagtgagagatcatcacattggtatccccagacactaaagaataacagcagcttttaaaagcaaataaaaataataagcaatataggctgccagtttgtctcaagaaagaaaatgaaaatgagtttgtaataagggaaaataaaattttaatctgattctaaaaataatctgctgtaagtagatatttaaaatttaaaataaataagataaaaaattaaaaagcaaaagtaaaataaatattaaggaagaaatgtcaagagtagtctctctcttctttttcattctcttttcctttttcttctttgctttctccttatcgtcttctctttcttttgtacactatgagaaactagtgcaagtgaaagaatgtttggattcatttctcaaaaaaataaaaattaaggaatacaagactagacaatgttatcatttaataaggtgggagaacaatggggccaagttgcaaagttgaacacaggtggaagcatcagcaaagcagagccgtagaagaagtcaagcaactttgtccaaggcagggttttaagctcacattaggcaggtgggggctaagcagagctcctcagagggtcagatgcatttgtagataccttactgctctactgtctcctgttccagaaaatacctatgcatataacattcataaaactttaatatacgtacaaaactagtatcttgattgtagtgctagtttgattcttatgttttgcaattcatattttgtaattgaaaatatgaaagagtgtgtgtatagaagaaagaagagagaaggaaggaaggaaggaagaagaaagagaaaggagagaaagaaaaagagggaaaattgagattaaggttcaagtgattgagtttggcgtctcctcccaagggattttacattggctttggttcaactctgatcttaaattgcaactgcctataaaatgtattttataaattggggcaggggggtataaaatgttattttagcttgtagaattctagtggattggagtgtagttacagatcgaaagaactatagatgggagataatgagaagtggaattaagccatgcaaagtaaaaatctaagaggcagctctatgaaatatgactctactgaacaggtttaggagacagcagctggtgaggcaaactcctgctaggaagaattttctaattctaagctactttcaaatttgatagggctgaaaaatatctctctgaatcaaatgcagacattaaatattaaaagaaaaataagaggctaagtatacatgtaaaaataatatcaagtaggtataagtttgagatataataaagcaataaaattttagcagataatagagtgacatgagggataagaagaatcatgttcagcttcgtgccaaatttggtggccagtggaagccacagtaaattaaaatccaccgatttcaaagaactgaatgggcaagttggagtcttgtaagtctattcctgccattacactgatgaggtaggaaagcccaaatacacattgaatggtctttccaatgaggtttgtggcagagctggacaagaagactggtctgacactctgtagttttagatcatttcattcccctgcccccaaagtctagtcaagtaaagcactgggagtagagaaggaacacatagatctgtaactggttgtgatcaattacttgcaaacaacactgcatagatcatctctttcattgctattccaacttgaaatgtttcttatatatagaacccaagaatgcatatttttagcttcaaaaaaaggaggtgtgttaaggaaaaggaacaaatcatgttcttggaaactatcacaaggtaataagaatattttaatttgtaataatggatacataataattgtacatatttatggggtatatgtgatattttgatacaattatacaatgtgtaatgatcaaatcagagtaattgggatatctatcacctcaagcattgatcatttctgtgtgtttggaacattctggttccacccttttaattcttttgaaatatattgttaactataaattattgttaactataaattattgttaactatagttgccctattgtgctaccagatattagatcttattccttctagctaactgtatttttgtgccaattaaccatcccctctttatccccgctctttccagcctcctgaaaccatcattctactttctatctccatgagttcaattttttttttcagttcccacatatgagtgagaacgtgctaaatttatctttctgtgcctagcttacctcacttaagataatgtctccaattccatccatgtttttgcaaaaaacacagaatttcattcttttctgtggctgaataatatttcattatgtgtatgtaccatattttctttatccattcatcagctgatggacacataggttgattccatatcttggctactgtgaatagtgctgcaataaacaagggtgtgcagatgtcactttgaaatactgattttcttttttttatttggatgtatgcccagcagtgggatttctggatcatatggtattctattcttagttttttgaggaacctccatactcttctctatagtaactgtactaatttacatttctaccccatagcatatgagggttctcctttctccattttctgttagcacatagaaatgatactgatttttatatgttgattttgtatcttgaattttactaaatttgtttatcagttctgataggtttttggagggatccttatgtttttctaaatagaagattttatcatctgcaaataaggataatttaactacttcttttctaatttggatgtcctttatttctttctcatgtctaattgctctggctagggcttctagtactatgttgaatgaaggtgatgaaagtgggtgtcctggtcttgctccagatcttagaggaaaggctttcagtttttccccattgggtatgatactagctgtgggcctgttgtttacagcttttattgtattgaggtatgttcattctatactacttttttgaccattaaagtatattgaattttattgaatgctttttcagcattaattaaatgatcatatggatttgtcctttattctttggatatgatgtatcacattgattcatttgcatatgttgaaccatccttgcatccctgggtgatgaatcccacttgatcatgttgaatgatctttctactatgttgttatatatggtttgctagtattcgaagattttttgcatttgtgttcatcagaaatattggcctctagtttccttttgtgtgtgtgtgtctttgtctggttttggtatcatggtaacactggcctcatagaatgagtttggaagtgttccctcaaatttttggaataatataagtaggattaatagtagttcttttttaaagtgcttggtagatttcagcagtaaagccatcaggtcctgggattttctttaatgggtgactttttattactacttatatcttgttattcattagtagtctattaaagttttctatttcttcatgattcaatctttgtaggctttatgtgtctaataatttatccatttctgacaggtttcccaatttattggcatatagtagttgctcataatagtctctaatgagcctttgaatttttgcactatcagttgtaatgtctccgttttcatccctgatcttatttatttgggtcttctcttttttagttagtctggttaaaagcttattgattaccttttcaaaaaccaactttttgtcttgttgatcttttgtagtatatttttagtctcaatttttcctactctgatgtttattatttattttcttctataaattttgagtttggcttacttttgcttttctaattctataagctgcctcattcagttgtttattcaaagtttccctgcttttttgatgtaggcatttattgctattaactgctcttttagtactacttttgctgtctcccgtaggttttagtgtgttgtgttcccattttcttttgtttcaagaaattttaaaaattttctttttaatttattcgttgacataatggtcgttcaggagcatattgtttaatttccatgtgtttgcatagtttccaaggtttctcttgctattgatttctagttttattccatcgtggtcagaaaagagacttgacatgattgcaatttttttttaaattttttgagacttgttttgtagtctaacatgtggtctatccttgagaatattccatgtgctaaggaaataatgtgtattttacaggtgttggatagaatgttctgtgcatgtctattagggtcatttggtctatggtagattaagtccagtgtttctttgttgattttctttctagatgatctgtccaatgctgaaaatggggtgttaatgtccccacctattgtattggggtctatctctctctttacctctaataattgctttatatatacgggtgctccagcatttggtgtgtatatatttataatttatatatccccttgctgaattaattcctttatcattatataatgaccttctttgtctctttttgcagtttttatcttgaaatctatttcatctaagtatagctattcctgttccttttttggcctctatttgcatggaatatcctttattttagcctgtatgtgtctttataggtaaagtgagtttcttatagacagcatatcgttcagtcttgtttttaaatccatttggccactctatgtcttttgattagagaatttagtccatttaaattcagcattatcattgctaggtaagaacttactatgccattttgttatttgttttctgattgttttgtttgtcctctcttcctttcttccttcttgtctttctttgtataaaagtgatttttttttattggctgggcacggtggctcatgcctataatcccaaaactttgggaagctgaagcaggtggatcacttgaggccaggagttcaagaccagcctgggcaacatggtgaaaccccatctctactaaaaatacaaaaattagctgggcatggtggcatgcatctgtagtcccagctacccaggaggctgagttgggagaattgcttgaacctggaaggcggagattgcagtgagccaagatagcaccattgctctccagcgtgggtgacagaatgagattctgtctcaaaaaaaagaaaaaaagtgctttctcttgtagtatgtttaatttcttgcttttaatattttgtatatctattataggtttttgtgcttaccataagacttgcaaataacatcttataatcaattattttaaactggtgacaatttcgttctgattgcaaagaaaagaaaaacaggcaaaaagaaaatgaaatattccacactttaacttcatcctccccactttttgacttttgttgcctctatttacatctttttatactatctatctcaaaagttgctctagttattatttttgataggtttctctttttgtcttcctacaaaggtatgagtggtttgtacaccacaattacagtgttagggtagtctgtatttgtctgtgtacttacatttaccagtgagttgtatgcatttaaatgatttcttgttgctcattaatatccttttctttcatactgaagaactccctttagcatttcttataagataggtctggtttttcatgaaatctctcagcttttgtttgtctgggaaagtatctttgcttcttttctctcactgcctttaggattctttctttatccttgatctttgagagtttgatgactatataccttaaggtagtcttatttgggttgaatctgcttgttttttggttttcttatacctggatattcatatcttactctaggtttgtaaagttccctattattatttctttgagtaaatcatctaccctgatctccctccctccttccctgccgctgcctctctctctctctctctctctctctctctctctctctttttctctctctctctctgtctctccattctctttaaggccaataacttagatttgtccttttgaggttattttctagatcttgtaggtatgcatcattcctttttatttttttgttttttctgctgtgactgaattttcatagagcctgttttcaagctcattaattctttcttctgcttgatccattctgctattgagaaactgatgcatttttagtttgtcaattaagtttttcaactcctgaatttctgcttgacttttaaaaattattttaatctctgttaaatttatctgataaaattctgctctttgttatcttaaagtgcattgagctagcttgggcaacatagggagactctgtctctataaaaaataaaaataaattagctggccatggtggcatacacctgtgatcccaagtacttgcagtgtttaagtggtataaacacctgggcccagaaggtcaagactgcagtgagctgtgattgcaccactacactccagcctgggcaacagagtgagaacccctttaaaaaaaaaaaaaaaaaagccgggcacagtggctcacgcctgtagtcccagcactttgggacgctgaggcaggcagatcacctgaggtcaggagttcgagaccagcctgaccaacatggggaaaccctgtctctactaaaaatacaaaattagccaggcgtggtggcacgtgcctgtaatcccagctactcaggaggctgaggcaggagaatggcttgaacctgggaggcggaggttgcagtgagccgagatcatgccactgcactccagcctgggcaacaagagtgaaactctatctcgaaaaaaaaaaaaaagattcattgagcttccacaagacagctattttgaattccgtatctgagaggccatatatctccatcactccaggactggtcactgatgccttatttagtccatttggtgaggtaatgttttcttggatgtccttgatgcttgtagacatttgttgatacctgggcattaaagagttaggtatttattccagtcttcacagtataggcttgtttttagccatcctttttgagaggactttccaagaattcaaaagggattgagtgttgtgacctaagcctatggtcactgcagccatttcagcactagagagtgccctaagccccggaatgctgcaactcttacagactccttgatacacagctttggtagattttgggaaaataagggagaattccctgggttaccaggtaaaaagtctctcccacttccctctctttctggcaaaggaagtcagtctctgcaccaggctgcctggagttgggggagggataatgcggtcactctaatggccatgacagctggcactgcacagggtcacatgtaaagccttgtagcccagcacagtgctggggctcaccccacggctgtagtcactactgcctggctgtcgctgatgtttattccaagccaaagccactctattcagcagaacggggtttgtcccatcaggacattggattccctgctggtccagcgtgggtctagaaacactgtccagaaacaaaggcatggaatcaggaggtacaggagtttccctggtgctttattttagtgtggcttagctggtacccaagttacatgacaaagccctctgtattcttccctctcctttctccaagtgaaaagagtccctgagctgcactgcctggaattgggggatgagtgacacaggcacacccttggccaccacagctggtgtcacaactgaagtctaccacctctgtattagtcagcattctctagagggacagaactaataggatagatgtgatatataaaggggagtctattaggagaattgattcacacaatcacaaggtaaagtctcacaggccatctgcaagctgaggagccaggaaggcagtccgaatcccaaaacctcaaaagtaggaaaaccaatagtgcagccttcagtctgtggccaaaggcctgagagcccctggcaaatcactggtgtaggtccaagagtccaaaagctgaagaacttggggtcagatgtttgaggcaggaagcatccagcatgggagaaagatggaggccagaagactcagccagtctagtcctttctgtgttcttctacctgcttttattctggccttgctggcagctgattagatgtgcccatccagatggagggtgtgtctgcctttccagtccattgactcaaatgttaatctcctttggcaacaccctcacagacacacccaggaacaatactttgcatccttcaatccaatcgaattgacattcaatattaactatcacaacctccaagaccagggtagcaccagagcttgtccaaggactgcactccttgggtcctgattgctacctaaatttattctgagcctcaagccactttagtcagccaatggtgaagctggctgggactcagtttcctcttgctggggtggaggattcccctctggcccagcactgtcctaaatgctccttccgtgggcactggcagaattctgtcctgtactgtgttccactgtgacagggcagtgctgagctccaatgcaatgttgcacactcattttgctctctctttcccaggcccacagattctttctctatgctgtgctgcctggggctgggggaggggtggtgtagataatgcaagactgtctttctgagcttttcaatgcctctatccttgatattacattaaaatcgggtattgtgattgctacttaatttttttgttattatggaagtgctttcttgcattgatagttgttcagtttggggttcctgtgaggggaaaatcactggagtgttctattcagccatctttctctacctctcctcccctttacaataatgataaatatttagagaaccttcctctgtttcttttggcaaaagaactatatacaccaagatgaaaattcaagtaaaataaatataaacataatttcaaatagattttaactaaaagccagtagttttagtaaacgtatcagtgtattctcgttaggaaagaataaacagattttggttgtttcattttgttttgttttgagacagtctcactctgttgcccaggctggagtgcagtggcatgatctcggctcactgtaacttccgcctcccaggttcaagtgattctcctgcctcagcctcctgagtagttgggactacaggcgcccaccaccatgcctggctaatttttgtattttttagtagagacaggatttcaccatgttggccaggctggtctcaaacttctggcctcatgtgatccacctgccccagcctcccaaagtgttgggattacaggcgtgaggcaccaagcctggtggaataaacagattttgacttgacacaatccaaaactcaaaaaagtaaggtgaattactttgggaaatgtgaaggtagatctgaagaagaccaccaggaaaagaccagttaggacctcttcttgccaaatgtctaggactctcctgctaccctaatttcctaatcattctaaataaataggactgttatgttattagcttaatagatctggaaagaggccatggagatcaggttgccctcaggtgattcaagggtttggtttcattaagtcactgttcttagcagcttcagaaattgttcttcacctgaaattttgttgttttacaagaacctcttatatcatttagccttttgcctgaagatttctctgcttacaattggcctttcaaatcgatgttacataattgcttgtatctctcagggataaagccaaaatggtaactttaaaataccagaagcaaagactaaatcttattctctgttttatcgcaagaacctagtatactgcttggtacacagagatcttcaatacatgtttgatcggttgcatcaacatgaagtcatactcaagggatagtttagcaggtttctgagatgaagcaagatgaagattgctgacaatgctaccttttcctttcattcagctcctttttactgagacagtcctaggctatgtttaagttgataaacagctttataatgactctcccaaagcatatctgcatctcaaggaatagttgatgaatttaaaagaattaccagctaaagaagaagatctgtggactgggacaagggcctttattctaaagcaaagtctgttccatcattggtatcctgtctttggaattagaattatatagtgattatcacccacactatccacttatccagctatgtacattttcatttaggttctgatatcttaagtcaccttaagatacctaaacataccccttgaaaatagtgtcttttctcacccttctccatctcaataaatggctccatcgcccaaggcaaaatctgagttttatgcaatctgtcttcccacagcacttctatccagtccatcagcaagtcatatcagtcctactttcagaatacatctcaaatctctcttctcttctccatctccattttcaccacccccatccaggccaccacatctctcacatggaatactgcaggagcctccttacagatctccagttcttctcttacccagtagactcagctttctccacagcatccacacaagcctttaaacatatacattggatcatgttattccactccttagcttaaaaccatccaaagcttatagttaggcttttaagatttattcatactgctgcatataattgaacttcattcattttcatttctatacaatattccattgtctgcctgtaccacactgagttatccactctactgttgatgagaatgtgggttgtttcaagtttgaactgttgttacaaactttcttatataagtttcctggtacacatatgcatacatttctgtaggatgtaaacctaggagtataattgctgagttgtatattatgtgaagacaacagaattcatcaaaaccagatgacaataaactatgcttgtaaaattagatactgagatttttaaggaaggaaaagaatatatagaaagcaattaccttgaggaggtaagaggggcctgtgtttggggtgggggatgtgggagtcttctgaggtgctgatgatgttctatttcttcacctggatggtgtttattttataacagtttgctaaaatgtatatttatattttatattctcatctgtgtggttgccgtattttgtaacaaaagtaaccaagccacacaaataatataaatacacccttaaagtagtacaaatacaaaactaaaacccacgcaaggctttatattgcatttagagtaatttcagtagtttgccatgattagtaagtcctgtgtgatatggtccctggctaacccctttccattctcctttcacttatgcttttttatttcatcctaatactcatctcattttattagtcattaatttcaagagtcagcagactttttctatagagagccagtggtaaatatttttgaatgtttagtccatattggtctctgtcacagctactaaactctgcctttgtagaacaaaagccaccagagataatacctaaatcaacaggcctgattgtgtgatactaataaagcttatttacagaaataggcaagaggctgggtttggcccatgggttgtagtttgccaactcatggttagttttttatattttctttcaaactagactagtcagtgccataggatcagagttgtcctggtgtctatcataggtcttagggtgtatacatctgtaccttcattcatgaatgtatctactggcttaattccacacatttacctgtgtctctgtcccccctcaggattccatgtaaattaatactctcaccatcagaaacaaggtatttaccatgattgaatctttctatgtgctaggcattaagctagacacatttcatgcattatgtaatttaaccctcacaatgattaaattggagccattgtcattttcatttcatagatgtggaaaataagtttcagtaaggttaaggaacttgattaaggtcacacaacatcagtgctggagctgatattcaaatccttgtacttctaatatagatgttgtctggtaatttagataagagccccataatggttgagttattgttaagtttgaatacctatgctagtctgttttgcattcatatgaaggaatatctgaggctgggtaatttataatgaaaagaggtttattttggctcacagttctgcaggctgtacaagaagcatggtggctgaaacagattgtaattttgaacacttttttttttcctctgcattgtatctgtccttgcccatccatctgcttctggtaagacctcaggatgctttcattcatgacagaaggtaaaggagagttaggtggcaagagaggaagcaagagagaggaaaggaggaaacttcaattatatacaacagtatgaatgaatcttaaaagcctaactaagccaggctctttttaacatcacatctcacggtaactaatagagcaagcattcactctttacagaggggatggcacaagccattcatgggggatccacctccatgacccaaacacctcccactaggccccacctccaacactggggatcacatttcaacaagagatttggaggggatagaccttcaaagtatatataatgacatatgtgaaaagcatttagcctagaacttggcatgtggtaagaactcaggaaatgttacttacttggtgctgtatctttgttacttctctcaaagtattcaacagcattattaatactatttttactcctaatttccattatgtcctaatttaataccctaatttaaagtactattagtcctaattatattaaggagtcagtctcaaggagtttaagatatttgctcacgttcacacagttacagaaactggaatttgcatttagaattttttaccttagactttctactcgagattctgtgttagtctgttttgcgctgctagaaagaaatacctgagactggataatttatatatatatatgaggtttatttggctcatggttctacaggttgtacaagcatagcaccagcatctgcttggcttctggtgaggcctcaggaagcttctattcatggcagaaggagaagggggagcaggaatgtcacatggcaagagagggagcaagagagagaggaggaggtggcagtctctttaaccaactagctgttgtgtggacaaacagagtgagtacttactcactacaacaaggagggcatccagccattcatgagggatctgcccctatgatccaaataccttccacaaggccctacctccaacactggggctcaaatttcaacatgtgatttggagggcacagacatccaaaccatgtcaggtgccatgagagaataacagattaagtgacaagaaaattaaaaagacagggagattattaaagacctcaaaaacaaactttaaaggcattttaaagaatagataggatttggacacacagaaattttgcacgggtagaaggatggggattgggaagaggtgtttcatatttagaaaacttgttggtcaaagtgtcagagacaggaaagcacaggcccccacagaagagctcagcacacaggagtggggacaagggtgcagacgccaggcaccggatgaggtcccagggcagcacacaaggaggaagagaagcggttctggaaaactctgggcacacataagaggaagaagaatgctaatggacatggaaagggagtggtgaaggatgaaggggaaaaaacctgaggagtgggtgctagaggaagcctgggaggaactttcctagaaagctccaatcaaaagagcacaagtggtataggaggccgggtatggtggctcacgcctgtaatcccagtactttgggagggtgaggcggatggatcacctgaggtcaggagtttgagaccagcctggccaacatggcgaaaccctgtctctactaaaaatacaaaaagtagccaggcgtggtggtgggtgcctgtaatcccagctactcaggaggctgaggcaggagactcacttgaacccaggaggcggaggttgcagtgagccgagatcgtaccactgcacaccagcctgggcgacagagcgagacttcgtctcaaataacaacaaaacaaaataaggggtatgggaatccttggtgacctcagcagctgccatgccatatggaatatcctggatatagacagaagataagagttctagtgtaggtagggaaggtcacagcgagtatatttttttcctccaagaagctatgatagagtgagcagctagagcagcctgtgaaatatttaacagacgccaaggaattgtgtgcttgtttaactgcaaacaacaggctgttgtggttttttttatttgccccaaacaaattgtaattttgaatattttttccccctaaatcaggtctgtcccttccatctacctgaaaagtctgacctgcttcctgtggaaggttgtcctaatgtaaccaccctgtagccctctcattagctcagagaacacaacagtgagaatgaatgagcaaggggaagacaaggtggtgcacagggagctaggagcaagaggagtgagaggagcccaggaaagatgtcccaatggggaggggtgagtcagaaccccagtgagaatgagaactgaggacaggcctcatgtgtctttgccttgtgtgtacacatctctggggtataggttggaagtacaaaacaaaccaataaatggatgtttattgccaggcacaatgataggcaatttgggtgtaagggaaagaaaaggccaaaatcgctgtttatacacgagcctggtacttctttatacctgggaacagtgattaacgtgttcctgtattgtactcatggtccttgtgtgcctaggcaatgaagaggtgagaataatgcagtctggatttggggttgaggctagacaaatagctaaggaagaatgaataggacaaatcagctgtcatgatactgccaccttgaatttagctacctagtttctctgcaagtgagaaccaacatttttgtgcctgattttccagggctagtttgtggctagcaattagttcattgtctagtcttcttcacaagtggcttagattttagataatgagaacagtataagtaatcttttacttctttctacctgcattctgtctttagacttcagtgctcctttgaccaagtcagtatggtgtttgatcttacttagaggactaaaggaatttctgtatctgagttaaggagtactaataagaaagaatatgaaggaattttagagtctgtcccaacattgtctttttctgcctcttcataggaaaaacctgaattctctttattctgttctttgtggctaaaagtgcttctttttaaaacctgtatggcactttactgcttcttaatccaggctagatatagtttctaaagtaagcatgcatgactcagtgttggaacttttccaggtggagcaatgaaaaatgtcctatgtgatcttgtttgggttaataaacaaacccatctcagaaaggaaagagaattcaggtttttctatgaagaggtagaaaaagaatcaaactggtttgtactaaaaaaaaaacagcttaagcagggtcatttgttctgtggaatgaataatggcagtttgctgttctttcagaggtgtgcaaactttgtcattcaaacctgattcttttttggccacctacaatgccaggctctcatgagcacctagaactagggaaaggaaggcagaatgctgctgatggccatcccacaggaggcacatgcatcccttaaaatgagaacacgcttctttggccttcttaatttacctagtttacccaatgcttatttaactattttctcaacttaatccataattaccacccattttcagaaggaaagccagaaagttgtattagtccattctcacactgctataaagaaatacctgaaactgggtaatttataaggaaaagaggtttaattggctcatggttctgcaggctgtacaggaagcatagcagcttctgcttctgaggaggccccaggaaacttacaatcataggggaaggcaaagggggagccagtactttacaaggccggtgcaggaggaagagagaggaaggggaggtgcccctcaccttaaaacaaccacatctcatgataactcactcactcactatcacgagaacagcaccagggggatggtgccaacccattcatgagaatccacccatgtgatccaaccacctcccaccaggccccatctccaacactggggatgacaattcaacatgagatttggtggggacacagagccaaaccatatcaaaagtatatcctagcacttattttctgttttgaaagaacgacaaccatggccagcatatgatggcaaacaaagggttaaagtgaagaccctctctcccaccccataaataatcctctccttcttcctactgagaggagaggtggagagtgaagggggcaggaagtgaatgctcactctattgtataccttgagcacgggactgtcagtttttctctgaggctccagtcctgccagaaggtacagagatgagctgggcttgcagcatcaccagtgcaaggcttgcgggtcctccagcctgacacagaagttcctgggctacatgcaggaacctcctgaagcagatggcacaattccatcctccaaacaccacctcgtgctttttatcacctctcagaatattcacaggaaaccttacttaacacgagctcttgctccaaactgaaaaatgaaaggagaaatacatgcagatctggcatctaactaacgttcccatcaactattctgtaactctgggccagaattagacttttagaatccaagtttgagggatcaggatcctaatcctaccatatttctttttcttactcctgcttccttgttcttttgagaatgaaaatatcaggagatcaagggaaaagtaatgtgagcaaatatgtcatttggattctctaggctgagaatttatcgtctaaatgttgaatgagatataaatctttgccgggcgcagtggctcatgtctgtaatcccagcactttgggaggccgaatcatctgaggtcaggagttcaacaccagcctggccaatatggtggaaccctgtctctactaaaaacacaaaaattagctgggcttggtggcgggtgcctgtaatcccaactactcgggaggctgaggcaggctaatcacttgaacccagtaggcagaggttgcagtgagccaagattatgctactgcactccagcctgggcaatagagtgagactgtgtctccaaagaaagaagaagggagcaacagacaccaaggcctacttgggggtggagggtgggagaaaggtgaggattgaaaaactgtctatcaggtactatgctctttacctggatgatgaaataatctgtacaccaaacccctgtgacatgcagttttcccatgttacaaacctgcacacgtacccctgaaactactagaagtaccacattaatagcgtgcatctccttcttcctgccttgttacttcactttttctgttccatctcttaaagaggcatgtaaggtagaatatcaaagtattgagtgttccctttgcttgcttgctggatatccactggtacacaaacacatcttcgtatctacatggcagacttatgtaagtgacaatactgtttctggtggatggaacatagagcttatatgactgatctgtggtccctatattttgttttgttttattttgttaattttattcattttttgaataggtaatagatgcacatggtacaaaattcccaaggtacaagagtttacggtgaaaagtaagtctccctcctctttgccccagtaaatatagttcccattttgaaaggcaatcactgctctttcattcattccacatttattgagcacctactatgtgccaggttctgttctgggcaatgatatgaagcaaaacagacaaagcccccttgccctcaaggagcttacattttgattacgaatttcttgtaatattcattcaatagcatcttaagttttgtatggccagcgcactgtggtagttaaaagaagggctctagagtgacagcaactgattttgaatcctattttctgtatattctaagtaatcttggagtatttattccaccactctaaactgtgttttattttgaaatggaaataacaattctgttttataagattatgagaattaaataatacatataaaacaccaaacacagtgcctaaaacatagtaaatgctcaataaatattagtgttaattataattgatctgattctactgttctgtaatgctgactagaaataaaggatttattttcccaatagttttcatttcctctctttgctgtatgatcaaagaaaatcactttttaaaggataagcaacagtaaatttaagtcaagtttgatcattaatctcttgtgtattagactatttgctgagttctattaagaaatcaactcctagtaaatcagtagagtatagagacactgtttctctttattctttctaatctttcttaatcccatgtaatttgcagggttgtactatttggtctgtactattaactattaatttaaactttataatgggagattctgtattttacagaagaattaaacacttttgagcaaagtttctaataatacaatttggtatccttgtcttaaggaactttatgactgaagtctccagccagatgggaaaacagctttcagttcatggaaaagtgacagaagttttccttggtgatggtcttaaggtggaaagagattagaagaaaagtacatcgggtgggggaagaaaagaagagaaaataacttctaggataagaaaacacttttaaatattaggccaataactatttcctttattcgacatgaaaaaggatcattagggggcataatgaaagattgtgaggatgttgggttgggtatattacaccatgtactggaccattgacttggaatctaaaaaggaatgagggcacacctatttggcccaccacagtcctgataatcatttaatatactctctttctctcctttgttcctgtttctattttgtattgttttcctggcagacgaagttgacagatctttgaatggttgattatggtgtaggaaatctcttctttcagcctagtcatgatgtagggaggactaggaagaggagattgctgagtagttgaagtaaaatgcctctgaactgcttttattaattggttagtggtgggatcaggtagatttggggagttttgtattctttttaaatattttgtaggctctgataatttattgacagatgtagattaacaataagaacatcagtgctcaagataaaagtttcgaaatgcatcaagtcaatactaagtgaggccttctctaatggcatttgccactgtgctcctgggctttgtgtatgcacatcatttaatgcactacagagctaactctaatttattagtgatacattaggcaaccagagtgtgacctctttggtttacctttggaccttgtcatttctcatttttgttttggttacctattacaaaattacagcctccccgaaactcagtgatttaaggtcttattatctaccttggttctgtgagttaatcggggctcagctgagtcttgggatcttttatgagattgcagtcagcagctgaggtggaggaacatgaccagatgtccaagatggtgtcttcattcaaaggtctgacacctcagctaggatggcagcgacagctgagcgttggctgggcatttctctttctctctctctctctctttgactctctttttgtctctctctttccctggttctaagcagcctctccatatggctaccttgagcttctttataacatggtgctatcatcatagtcagatctcttacattgggactggcttcccccaaaccactgtttcaagagacttgaggagtctgcaaggtttctttgaacacaaactcattcattcaaaatcactttgccaaattttactgttcaaaatttcagccaacccagattcaatttaggggtactatgcaagggcatgaatagaaggaaacatagttcattggaggtaagggtgaggcgggcattttaaagatgagctaccaaaatcctctttgcctaaaaatagtcaaattcctctataacacagctcttatttcactgcaccaaataactttagaaaacataaacctacacagctcctttttagtaagtgaaaatatgtgatcttggtaacatttttaagctaaatatatctgatataaaatgcatgtcatctgttaataaattaccttggttggcttatacacacgtgttagaagctgccactagccaaaatgtgtttggattatatagtggattagagaaagttaacaaatcacacaatacaattcatctcattcctttctaatctttggtacagtagtgtgttgtactatataataatgatagaatgttttgttcattgaaaggagtgtgaatgaactttgttgttgttattgttcattcattcattccatcaacaaattttcctaacacaatgcctggcttataagtaatggagaacagggacattttactgctgtaattggattttgcctttaccagtataaatagtagcaatttaaatgctatttgagttcatgcattcagatatttgggcattggaaaaaattgtgcaacagaataatagtaatcgtgctgattaagcccttactttgtgcattatttcatttaaatctccccaggaggcttgagggtagaggcagacttattacccccagttttatagaggttggaactatgactcagagcagttaaatggtatttcaaaggtcacccagtcaatacatggtacagcttggatttgaacctagagcacctactgtggaaaacagcattaaaagaataccattgcttttatttctaaattccatgtcttttaagaaatgttctcaccattctaaaatgctaagtggataattacttaatgttataaggctattttattttcattaatctttggccaagtgtgttgacaactcccactcctaccccagacttctttttgtttcatagtgaccatttctgaagtctaagaagtacggctaaagaataatggaaacttactttcattgaaattttactgtataccagtcatttaacataatatttgaaaagagtgctaagttgccatgacatgtagatttaaaagataaacataaaaataacttatatttattatcagtcatggattccaagattatttatgagaacttccaatatacctggcccaggaagaatatggctcctaacttaggggatctcaccagccaatgggaaagactaagcagatgtgtttactggcaatacattctgatgagggacacctaatggtgagtagagggtgcgacggcttctagaaagagtcaaagattagagaagttcatcaggaaaaaacgataaagtttccatcaagagaatacaccctagtaaaggctcaaagtctaaagagtttaaggacttctagggactgaaaaaattctgtataacaggagggaaggtgggtgtggaagaatagccaagaaggaaaaatagccaagaagtcagtggaaggaacattgcatcataggccttgctgagaaattggaatgaatgacagtatttgaataacgctttgctcagttctgtagtttcgattcgaaatacagacttaaaaagtcgatgaacattcagacatttctctttaaacaagacttccccttctattctttagagttggaaattattctctgcttgggaatagttttcaatatgttccagacattataaatgacttcccttctatttccatgtatttcccatgttgattacagccaggctgatcagagtaaagcaccaggtgtcatagcatcctaatattatatgaatcatgcatttatccattcatctatgcatgtatccagggaaaacagatttttccccctactttatcggttctacagattcagattcctgtatatttaggtaacattccaaggggatagatgtgctcttataaaagactgcttacttcagcaagacagtttctaaaccctttacttttgagcccaattctccaggtattctcgggggcggtgggggctggagggaagcaaaaaaaaaaaaaaaaaaaaaaaaacagcaattgaaatggcctctccagtgtacccagatggaagatggggaagtcctgctagttttttccttcactgccaacataaacagggtggagcagctgagaaggaaggccactagtggagagagaaagaaacaatgtaacagcaaagtgacagacctcagtcctgcctcctatctggggcaacagaggcctctccagccaaccccagttctccctttgctttgcacttcctccagggacctctcgaaggagcaccagtgagtccctccatattaaatagttgaaagaacttgggccaaaaataaagcagaacacccatttgctttttccaacttgtctcacttctgctcccttcttcaaactcctgataaaaagcagcggcaattagtgtattgcaaagtgcctcttggagagttatgggaatcactgctgctttccttagccccagtttcacaacctcaactcaagggcaggccctccctctctctttttcccctccttccacctgacagggaccataaataactgaggctcccagtgttcccagctgagaacaaagttgaaagtttgcctggagctccatgccactccccgcctgggccactgctttgttttcttctaatgtttttcctctacctgggttggctgtttcttcattcatatttgagaagaatcacctcctaattaaatgtagcacttcgctctctccctacatgaaggctgtcttggttacccgactaggcaacgcgcattggtatcaaattaccgaaagtctacaccggagcagtcctcatatttacatacaaataactcaggggcttgcatttatgtcaccattctgtcctgctagaggcttgccagaggagtttttaatccaatcagaaggagctttaaaaggatgtctgcgaagtggtcaaaaggatcttaacctcaattaagtggggttttttaaaaagatttttttgggggcctgaaattttgaaaatcttcgaactctgagtggggaaagatgtataattcctcaattgcctacgaggatatcaagatgctgagaggaattcagcggtggtgaagagagtggatacaaaccagggattggtttccttgagctgttttggaggttgattctaaatcactgcttaaggaattcctggaaacatcaggaaaacatttgatcatccaagcctagtggaaatggctttaccgcagagtaagatctttgagttgtacttggtgtgtgctgtttttgtttgagatgcagtgaatgtgcaaatagcccagccgtaaatagttacttaaaataatctcttggtactgggtagcagcagtagaaagttgatctgtttagtttttacatttgcaaaaacagtagttgacagtgtatttttagacttgattggtagtttaaaagctgagctcttgcggtttcctgagtttaaatgaatggaaaatgtaaacagtaccgaatgcaggaattggaaaatatatctgggggaatgaatcacttacctttgagaaaacacaacatgtacacttttgcaatctcttggccagtgaagcttgcgtccagaaagagggtaagagtttgcctgtgtggggaaggaacttttctgcagcctgtgctaccttttgagaaggatgggaaatgtcccagagggcaaaagacaattgaaaaacctgccttgtcactcttggaatgtggtttttccatatgatgtcatgttttgcatacgtagctggtaaaagtatttcacataattaactctttgtcttgataattaaagagcaatttatatagtcctttcaaagtgctaaagcacccatattatctctggagaaggctgtgttgctttccatgtagatttcaagcattgggacagttgggctgttgttaatttgataggtttagaagcatttcaaaattgatgtgttccaaggctctccaaccaagcaagttatagttcacataacttgctagtttcttacttaagccccaaactgaaatcctgtgtgtgagaaaaccagttttttttttaaatgtctgtttccttcccacatataatttcaagaacagtaatgaagaggtggttcttattttgtaatccatgtccattcaaacaagctgccctcatcgtgggtgaggtgaggtgaggaaaactataactgacataaaacatccacctttctagtcagctgaggcttacagggaagcaaagggatacgggtaatgttttcagatttgtatttaataccaggagttgtttccgctacttaaattcactcttgaaattgtgtactaacctttacctataccttttccttctaaatgagagtttcaaaaattatccaggtgataggggaaggtgaatatgagatattgggggatttgctgataaccaaaggagtgattttctccacagctgacactttcaaaagggaagcttttgatgtgggcttactctctacatctgcaggtgaagatgcaatgaccggggacacagacaaatatcttgggccacaggaccttaaggaattgggtgatgattccctgcctgcagagggttacatgggctttagtctcggagcgcgttctgccaggtacttcgttgttgctgtctttcatagttaatttaaaacaaccatgatttgtcataaatcaaaatcatgttcatttttcacattatcccaaaatgtgttctttggatgaagatgtgaatttagcgaaatgttctcgacgcaaatacacatgctctgctattttcttttgtggtttgcggttgttaatttcatgtgattgaacatgttaattgtgtgttctttttttttttcccactttgcagtcatgctgccagcacagtagcaaaagagctcactgacaaaactgggagaaccaatctgagtcacatatttcaaaattaagttttgttccatattgaaagaaagtattatttgctaataagtgagaaatatgtgtatagattgttcactattctctgttactgaaataataattcatgattaaaagagagcatttttgaaaaaaaattatgttgtttattaaagttgtccaccaagtgtttgagtatctcttctaaaactgttccattattttgtttacaagggacatgtaagaagtataacagtgatttaccaaaagtcacagacaggaatggtgacaaattcagttcttacaactgaagtggaaaacttctgtatgggaaaaccttgactcaaacttttcttaaactagttgaaagaaacagaaccttgtgcagaatttggagacttctttgccctagtgtggattttaaagctaataattaaaccttctaagccagagccctgaggacattttcctatagtttaaggatctgttgtagaaagtttcattgtctaatagtaaatggcacttcccacaaagtaaaccctggagtttattctcagtgtagttggtgtggccagtatggatattgaattgatttttcttctagtcttttttttagtaggaatttgaaactcatatagcttggtagaacttttgccttataaatacatttataaaaggccttaaagtcttattgtagcaggtgtcattaacaggaagaggaaaaataactttaaaaaaatatgcaatcttttaggcgatcaaagatagcaacaagttaaaatggaaaatatgtagaacttttaaggttcttgagatcctgtagatcttgtttaaattgtagagatttatagcttttgaaatccaataactagcttgccttctgttcttctgataatatatgacacattttgtgatcagtcatttttatgtagaaaactgtagtagctgacctccagtgacataggaaaccagaatatcgcactgtattttttttcttaatataattccaaggctttcacacttctaattttgattgcactattatttgttgctattatatgtaactcattttttttactttgatgactcatgttatgctcagaggcaaatattttttaaaaatctataaagccaatatttttaagcacattgttagagtattatcaagtaaaatatattctgagtgtaacattttaaaaggagtacattaaatgtgtaactcattcaaccataacattttttttcttttttccctgtctgattttttgctttctatttcttgttttttttttttttttttcctaaaattactttaaaatagtcccaagataaggtaagaagacatggcacttttatagtgtttctcttccttctcctggctcatgctctcatttttattttctttagcattgtaatgtgatgtgctgtgatgtgctgcgatgtgctttctttttttctgctcaaaagctttagaaacatcagtaaaaattttctgattttaagaaaagtagaaagtatataataaatattacttacgcaaaatttaccagatacttaaggaatttctttcccttaacaagttttgtatagtgcatgaagtaattaaaggaatttcactgggtttgcagaaaaagtcctgatgtgaagggctgtttgtttgctggtttctgttttatttgagttgtgctaggtaaattagtataaatttagaattctgaggcatgtttttctaacacttcctatatttaacacttagggtgtactgatggctacaaatagttggccttagttgaaaacaatttaatgttttctagatcctcatgcaaataatctttaattttcagctgaaagtacttcgaagtattaaggattccgagtgaaacttgatggatttaattgactccatatgtctaatttaaattggtctggaatgatcagaagtaggaactttagacattatgcaaaatgaagacatctttaggcctttcggttgatagctcccaattcagggctctgttctgcagttggcactcatagagaaattaaaagaaggaggagatgtttaagaagtatcaacaaagtttagatacatttaaaaatgaaattaaaatgaataggtaattattttttaaaacttttaagtgtttgtctacatagaaaactgtttcatacaccccaatgttaacatatcatgccatggggaccataatttgaagaaatgaatgtctaatgcagagagtggccggcgactctcaaatcacaccactggagcaaaatttaacattgttattaatacttagaagctgcactaataatgtagccactagccacctatagttacttaaattaaaattagttaaattcatttgttcgttcacaccagccacatttcaagtgctcagtagccgctgttgttggatagctcagatttagcacatccccttcataggataaagttctgttggacagtgttgagttagagaattcctgctcttaggaagcttctactgtatttgagagaaggtaagagaatagaaacaggaatggcggaaagaagggcttgcaattgaaactggggaaaaaagagagtaatgggtcccatgattgggcacagagggcctgactgtgcaagtggctagagtcatgtggcttactagataagttcctctgtgcaggaattatgcttataatggtcttttagtaagttttgctgaatacattaaataatgactgcagaatgatggttgtttggggataagagaggtccatctgagattctgataaaagtgaaggctccaatcctagaagaatgtacgtacctatctgtgtagacacttagaatgaggcctctaatgtcaggaggctctgtaccttgataaaaggatacccactttctgattttctttagtatagcaggcagtggggaaaagaaattgtttcatgcaaagaatcatttatttacctcttatgtgtatcttctttgttcatttccccatcaagcacacaaaaggcaaggccaaagccaaagtctggctggttcaactggtaaagatacaagaaggcacttttagatccagatggttttttaattatataggcagtgaaagaagaagtgaaaggtgctagcttctcatgatccttgtcccctacacctaaaaggacaccagaacaaaaggggctggatgtctacaatgctagttatgggataccccattgccgaggagccaattctagacttcagctaaatggttttatattctgcagctctattccaaggagagcagaataggaagcctcatacatcattagaaagaggaagtgatgaaagctatctcatgacagcctcccaggtgagatggggaggtgagtagcagatgatctcgtggaagctcctcaccaacctccatcctctcagttcctggaagatcacagggtgttctgtgaagactcagattagcttcaattccggtctttgcctgtatgacttatgtgaatatatgcaaggtcacgagagtgacatggcagaactgttctcccaagggccctgactctattgagttttagtttagaggtcactgtgatgatggcatatcagggcatcagggtacctgcatctgagaagttcaagggccatatggaggatttgacagtggctggaaagaacagttggaggagctagaaagacaacagtagagcaaagaaagaatatttgcagaaaagaccaaataaccatgcagggaatatgaatgtttcctcaaagccaggaagatggcaaaaaggatcatgcaaagtgtattcataacactacttccttcttgatgttttctatgagtagcaacaacaaaccagagttctcagtaagtcccaaagacttataaacagacccatttaaagtagacataattcttatcagtagcgcatgtcaagtagacatagaccagaaagaggagacattctaacataagatctcatcctagaaaaatctgtcaactatctagaatcatctggttcttctcaattgtcatgtcagttcaacttcatagtgaaacatccaaagttttcatgcatttcatattctcaaaattggcctaattttaaacaaattctaatcataaggttgtctacactgaagacattttctcaaatacaagggattttacttttcactatgtcctttcaagaacaacttttgttgatatttttagccatcttgcctgttcttaaagttgcatgcattaatttttttttattcatctcatcatcatctaccactgttgaatggttaactgtaaatacaacagcctccgctccttcagttcggataggtcttacaccttgaacagaagctcctatgcacgggacagcatgatgattgaagaactccttgtgccatccaaagagcaggtatgcattcttttcaaaatagcctttgaccattaaacttacatttgtatgatttaatcaagctctctgtcttgtgacaaaaaatatatttctgcatgtttgattttacatttgtaaatcttctggtactagccagttaaaaaaaaataagttgtactataagcagaaatattcctgtcttctgcaggtgaggaagataggaatatcagagaggaactcagaaagtcctaggagatgtgtagttacctttctcttctctaggtcaaatctatttcagttttttaaaaggagagttaataatcattggtagctgaagttgctggtattaacctcatgaatgtttttgtttgtttttggagacagagtctctgtcacccaggctggagtgcagtggcatgatgtcagctcactgcagcctctgcctcctgggctcaagtgattctcatgcctcagcctcctaagtagctgggaccacaggcgcaccaccacacccagctaatttttgtatttttagtagagacggggtttcaccatgttggccaggctggtctagaactcctgaccttaagtgatacacctgcctcggcctcccaaagtgctgggaacaggtgtgaaccaccgcacccagcctgaatgttgtattttgctaaacaaactgtgtatctatgttggaatttgttagaattgtttttagtaagtaaagatgagactggtcattttttgttcccttagcttcaaagctgcctttgatgggtgtctgaagatgtgatagtattttgctttctaccagaatctctgctacatgcatttggtgtttgtgtaattgttttcttccaataattgtggttgaatagatagcgggttactataagaagttccagtaacacagtcttcctgcatgtgggctcaggatggtcctggaataattactacacagataatacctggctttaagtatgcacagtagtgatttaatgacagatgaaactatctggacaataaaacttttaaaggtggcttataatatttaaacaatgtaaataattggtgaaatcatgctgggctttttgacttactgcacaatgaacgtgaattggagcagatgaataaatgatagtcacatatcatagccaagttagaagttaagcaataggtagacttttgggactcccacatgtctgcagatgctgatgtctagacctacatatgtgtgttgtacttcataggaacctacaatatatattttattactttttactctctagaacattcttaataagcaggccttacagaggtgaatacagtggttattcagtgtttggtcagacaaaaaaactctattaaaaatgattataggctgggcatggtgggtcacacctgtaatcccagcactttggaaggccaagacaggcagatcacttaaggtcaggagttcatgaccagcctgccaacgtggtgaaaccccgtctctactaaaaatacaaaaattagccaggtgtcgtggtgggcatctgtaatctcagctactcgggaggctgaggcaggagaattgcttgaacctgggaggcagagtttgcagtgagccaagattgcaccactgtactccagcctgggcaacagagcgagactctgtcaaaaaaaaaaaaaattgattataggtgcatgtattagtctgttctcacactgctaataaagacatactagagactgggtaatttataaagaaaagaggtttaattgactcacagttccacatggctggggaggcctcacaattattgtggaagagaaagagacatcttacatggtggcaggcaagaagagaatttgtgcagggtaactcccccttataaaaccatcagatcttgtgagacttattcagtatcacgagaacagcacgggaaatacctgcccctatgattcaattacctcccaccaggtccctcccacaacaggtgagaattgtgggagctacaattcaagatgagatttggatggggacacagccaaaccatttcagtgcaatagcatgtcatgggttttaaatgggtattagcactagagaaagcacttgtctcaaataatgaaactaagtcttgggtataaggtgttgccaggaattggttgaaattttctgcttggttggctgtggtcattatttcagtctgtaatcctgctcttttcatattcccaattgaaatgagatggcagtggagatattgataccacttgtaagtataaaaatgcctgttattctctacactctaaggagaccccacaaaacgtaaaatcacaggtgaaaggagactccccaggtatcaatgacactttgctaatgtagaaagcatgtgccagggaatttctgatcaaacctaattgtggcttatatttctgcatattaacttgctatgggtcaagggcccgaaattggaaccaccaccaccatcaccatgaccttaccatcatcactgtcacctccaccactgctaccaccaccactattaccaccatagttactctaccacccaccttctgcacatcaacattgaagtaaaatgcaagtgtttgtggtgctataaaatggcttctgagggttctcacaccattgcctattaaccattaccaagacctacttactcaggtagactgtgggggcagcatttactcagaactaaggatttgtgaacagaaatagaagacaaagagaagttttgagatgaaactgatgctcttgtagtcagttgttgcttccaactcaaaaatacctctgtggacatcatgaacacttctatagacccatcagaggaaaggagagcataggacatctgaaaatctttcaaaataaactttaagttgataatgtagaaacagaaagttgctgtctttaatgagcacagaatacccacataggcattccttgtggaaccagcatgtttaataagcatataacactactcagatccatgcaaatccagaataaattggcaggagatttcagagcgggaaatgagagtcataaagacattttagggactgttgggggcatttgaaaatgtcttggagatatctgtgtatgtaggaaatcattgatcattttcttagcagtgataattttagcattgataattttcttagcttatcactgctacttattggacctactcagagaatattggggtatgcatgctgaagttttccagaattaagcaatcattaattcaactatttatttccaaatagttcagccaaaatgcatgtggataaagttaaagcaaatatagcaatgttaattgttgaatccaggtggaaggtacatgggtattttttatacagtttttcaactttttcatttgtgtgaacaatttcaaaatagtaacttggaggaaggaggaaaaatcctgaaagaggtgcattaactttttaagtctctagttttgagactaaaaaaagctaatgcatctctgtctattattatagataaataaaattatagatacagaggagaaggaaaaggctaattgctcaaagaagaagctggcagacagaagtgtctagatacactgtgcaagactcatgggaagcatttacttcagaagtgcatttaaacactttaggattaaatgacaaaattattagtttctgtttttcatttctctaattttgtatttataatgttcaaaatatagctcttccacagtaataattttgttggaaagcgtgaaagaagttttcagtatttagaattcccaaagcaatgacatataacttactgtcagatttaaaactgcactgtcattgcccagttaaatttgccctgacaagtaaaggtgaaaaatgagtaaaaatgaactctcatacacttctctttttcaatgagtagatctcactcatacaaagtacagttgcctctttattatcctgctgattaatcagtttgcatattaaccacagttaaagtgtagttgagacccagggtgattagtgcaggactgccacctcaccctctagggacctgtgctggctgaaggcacatgtggaggccagagctgggggaggggagtgggagaggtggagccatctccaccccctgttgagcctgagtacttagtcctaatccacttaattccctcctggacaatcaacagtagactgttttgttacaggttatcatgaacttcctattcttttaccttccctttacttcagaagtgcatttaaacattttctattagaattaagtgacacaaaatcattagtttttgtctttcattcctctaactctgtatttataaatttcaaaatgtagcctttccacagcaataatttcatcagaaaacatgaaagaattctgttagccaaaaattacctgaagatatgtttttgaaaatgtatatgtaaatgaaatcatgtcttggatttgtcaaaagatctttttatttaaagcaatggctcaatccagaccacttacgagcatcacttggagaactttggggtgtgtgtttgtgtgtgtgtgtgtgtgtgacagagtctcactctatcactcaggctggagtgcagtgtcgtgatctcagctcactgcaacctccacctcctgggttcaagtgattcttgtgcctcagcctccctagtagctggaattacaggcatgtgccaccatgcccagctaatttttgtattttttagtagagacggaattttgccatgttgcccaggcttgtctcgaactcctgacctcaagtgatccgcccagcttgtccttccaaagtgctgggattataggtgtgagccaccatgcccggccacctggagaacttttaaaaagacgattgctcagttcctgatttctttggcctgtgtagagactgggcatgcaattctaaatgaacccaaggttgaaagccactgattcatagtcagtattcttaactgggggtgcccaatggaattacctgtggctcttttaaaagcaagatgcctgcagaatcagaatttccatgtctgggttcttgggcatatgtatttttaagggttcccctgacaattctaaggtgtacctttagttagtaactgccgatttaaggcaactctcactggaagcttggtgtgtattggtatgtcaacatctaatgtatttgttttataagctcagatttgtatgtgtcagattgtctgagagcaacacctgtgcttggaaacattccattcctctccaaataggatttaataaataaagggatgagtctaaactgaagcctgattgtctgggatgaatgtaatagcatggtgctttcatttcttctgatgtaattattgaaagcaactgtctggtacagctaatgtacttaagacacattactgtgtgtgatccagattagacagtgctcattacataaatggaatgctattcactagataccttcagtgtcaggagatataatggtggtaacacttatggtggtggtgaaaacagctaattttgagctcctattatatgcctggaactattctaagtgatttagcagtattaagttgtttatagttcacaatatccctatgaaataatttgttaaccccattaaaaagatgaagagtccaggcacggtggctcacacctgtaatcccagcactttgggaggccaaggtgggtggatcatttgaggtcagaagttcgagaccagcctggccaacatggtgaaaccctgtctctactaaaaatacaaaaattagccgagtggtagtggtgcacgcctgtaatcccagctactcgggaggctgaggcaggagaatctcttgagcctgggaggcagaggttgcggtgagctgagattgcgccactgcactccagtctgggcaagatagtgagaccctatctcaaaaaaaaaaaaagaaaaaaaatgaagaaactgaggcacagagagcatgagtaactcacccccggggacacagcttgtaagtggcagagtcactggccatctggctccagattgcctcattttatcctgaacactctacatctgcattgctcagtgcaagaaaaaggcccttgaggagtccacgtaatttatagtctctcctccaggattttatacttgctagtattcttggttgggccacagaaccaccatcgtgatgtattttttagcatgaaagattatatttagacagtgttctttgttaacgtttatttctaatcctaataaagtcttttatttattcaatgtgctttaaaaagaactgacatattcagtaacaattataaaaagtatgaagaactggccgggcgcggtggctcacatctgtaattccagcactttgggaggccaaggtgggcagatcacgaggtaaggagatcgagaccatcctggctaacacggtgaaaccccgtctgtactaaaactacaaaaaattagccgggcatggtggcacgttcctgtaatcccagctacttgggaggctgaagcaggaaaatcgcttgaaccagtaggtggaggttgcagtgagccgagatcgcaccactgcactccagcctgggagacagagcgagactctgtctccaaaaaaaaaaaaaaagtatgaaaaactaaaaattatggcatggaaggcatcattacaggaatggaactatttgaccttcagacagataaaaggtagaaggcatgacatcagtttacaaatatttagcaggctaaccaattagtttatcttcctttaaatgacaccagaattagttgtaagactaaaaggtatgtatatactgtaggcagaaacatgtaattcagtatgattttttatagagtcattcaaagatgggagaaaagcataagtcacttatcgatgtcggttggttttgcctgcatacacccatttggctttccacatatacccatttccgtggcagtgcctggatctgatggtcgaatccctaaccccacccatttctcagctaatgttgtttagaaggggcataagtccctcctgttctgcaacagtgagacccaattctggccgttcagagcattcctatctcctggattacagcaattactttaggataaaaagtgaaatctgagcccatctagtgagactcaaatttgagactttgtctaaccttttgggaaagagaaactctactggggttcctaagctataaagatgacatacgtccaaagctgctgggagtagaatgtgaagaccaatgattcctaccatcatttgagctggattcaaccgaccttgaagttagcaccatacagattttcttgccatataaaccagcaatttaatttcagtcttcccccatccctggaaagggagtatcttaaaccagttcagtttggttttctgtcattactaatgtggttgctattggtggtaatgaaacctggtaggaacaaccacatatcaatgggaacataaaacgtctagcatcttaaagtgccattcaaccttgagattctattattttatgctttctctctagaaataagtaaatccaatattaacaaaagagaaaatgaggaactatgatttaagagaatgctataaagttggggatttcttttttcttttctttttttttttttgagacggagtctcactctgtcacccaggctggagtgcagtggcatgacctcagctcactgcaacctctacctcccggattcaagcagttttcatgcctcagcctccccagtagctaggattacaaccatgcaccaccacacctcgctaatttttttgtatttttagtagagatggagtttcaccatactggccaggttggtctcaaactcctggcctcatgtgatccacccgcctctgcctcccaaagtgctgagattacaggcgtgagccaccacacctggataaacttgggtatttctaaacaaaaactttagaaaggagccccttgccaattgatcactctaaaatgaacaccttccatttccttgtagttctgttgacttaggggcagtgcatctgtgaaaagagaggaatgggacagctgtttggccctgttctctctctgagtagatttctttcttttgaagacttccttttcagaccagatttgcctacatggtttgttcctgaggggactagtggcaggccttcaatagtgactggtttagaagacttaactagactatgatgtcaacagttgcactggctgtttgaatgctgactgtggagaaaattctgtaagtgatattggaggcctcattatagccatcatgtacaggaaggctgctgtcacatcttccaccccataactcttctcatttatttcacagccaaggattctggttcctttggattggacttggtcttttttgaggctaaggatgatttcatatacatttagtcatataatgtgtaatgtacaatttgatatgttagcaagtagtgtgaaaattggagcattcttcagaagaaacttcctgctcgtattttcaagatccaagcattttcaattacctcagtaataggaagggagaagaatacctaacccaaaagactgcctatgctaacagtcagattttcctcctctacctctcaaccctattccacccacactcccacccccatctcccacacccgtcggcagattaaccttgctatttctttcacataagctaatttctaaggggggtgctcagaaacgtgcatggtggcagaaggtagccagcctcagattaaagatttgctagagatagtccccctagaagataggcatctttgactggtgacatttaatatgctgctttctctcttcaatgtgctttgccagcattattcaggtgatgcattcaacacctctcaacaattggtcagcaagattacagattttttgttttaaggcagagaagttggtattgtgacttccttaaggtagtgcagttagttttgatgtctcaagctgggtgttgacacgctcagcttccactctgaccttgattcaccttcttttgttcgagttcataaccagattgtcttgaaatcaatccaattcggaaatttaatgaacgaaatttctttatatgctattctcaaaataagtcttaagagtaataatagttgacttcaagaaaataaataccgtaagggaaaaaagacctgctttttctattatagtaggcctttaatttttattttattttactacttgtgtcaggtttccttttatggaatccatttcttaaaagtgtttccatgtagtagtgctggatgtttaaacctactactatctatttgggtcgcggtttgccatttcactcaatatccactgcacgtcacaataattataatacttaatacactacctgccacaatattttattaaatgcatcatctcatttcgtgcttttggctacctaatggaaggggtattatgattaccactttacagacgaggagactagggctgtgaggagtgtttagcttgtccagttaaatagcttgtccacagctattaggcggtagagctgagaatggactgtaaacctgatgggtgcttaaacccattctcctgctggccactaggcaatagtgccactctaataagcaaagcatagcagatctgagtaaagcatgttagccatgggaagaatcgatgcgtagacaagtattttgcaaagcaaaaacaccactattatttctgttaatccagcaggcagctctgacttctccctgtgatgtgaaaaggatatgctatcctaaatatctacatagagggatgcaacattatagaaatataagaaataaattatcttcaattattaaaaatctagaggtaggctgggcacagtggctcattcctgtaatcccagcactttgggaggccaaggtgggtagatcagttaagccaggagttcgagacctgcctggccaacatggtgaaaccccatctctactaaaaatacaaaaaaaaataaaataaaatcagctgggcgtggtggcacatgcctgtaatcccagctactggggaggctgaggcaggagaattgcttgaacccaggaggcagaggtttcagtgagccagcacagatagcgccactgcacttgagcctaggcgacagagtgagactctgtctcaaaaaataaaataaataaatatctaggggtatgagattagcatcatctgtgtttttgtttgcatggtaatttagagttttcaagccactttcacattacttgggtcattccattctcacagtgaatcagggcaattaatattttctacctgtcaccctaatgcagaaatggagattcagtgagttttttgacttgccagtcactgggctatggagtgacagagcctgattcaaacccaagtcatcttattcttcgtgtggggaactgacacccacatgacttcctctgccttggccctgtccaagttgtggccgtagagtgaagttatccctgatagccctttactttctgtggctcctagtctgattgtatcatccaactgttactaaactaaattgtatttacaatctcccagaattgttgcactgagtgttgcatgtgacctgttattgggagatttcctggttgctgttaacattagcctgtcaaggctaccagttaatttgcaagaccaccttcacccatagatggtagagctgttagataaggaaacttgcagggttagttctggaccttaactcatgtcatctaacactggaggttgacagtcagcaacgtagagaattactaatattggagttaattggatttctcctttttttctctctctcttgcaaacactttcttgaccctgcctctttccttccctgcctggacaattatttccagacctgggcatttgggtgtgtccttgtttgtaaggccagtgtgtacttgttctcctctttgctctgatgaataggactagtgagaaactatttttggaaagtattaagctcttggagacggtgatatcatcattagtcaggctttggactccattaaataatgtgcattttcagttgaataatccttgacatcacttccaaaatgaaaagtaatgtgcttattcatattatctttgacatgggaataaaaattattaaaaattccgtgtgaatttttctttaacatagtgttctattaaagccacccagtgctaggtgttgacttcgtattgcctagtttttgaagtctttctaaacctcattttcctcatctgtcaaatggctccattactctcagggctaataggttctgacaactcaaacaaaaaatgaatgtatgggcctaggtcagtccttaccattgaactgatgcacagtaagttgtggtagtgctgttaacaaaggaatgtaaatattttgagtcaataataagacctaggcattgataagatgcattcttgaatggcctccattggtttgataaaagcatcctatgtgtattactataatgccccagtgctgggactggaatatttttatttttgctgttttccaccataaatgatcagattgtgacaaatgagctaatataagtgaaagtcttttgaaaagtatagaaggctttacacatataaggagacattatgataattccatgccaacaccagcactgcattggtgccagactttgacgtatatgttttcttttatctccatatcaaccatccccagtttgaaaatgcagaaactaagactgaaaaaagttgagtaatctgctaatgatcacaaaaccagcaggtgatgctggggcatctctgaaggagctttcaataagtaaagataaggaaaggtcaatgacaaaatatctcctttattcctgatggaggccaggcgaggactggcttagtgtctgagccacgtgggcctgctaactgaatccctgagataggcacactcccctacccaatgactgtggtgctggcccaggccaggcacactctttgcagaagtaggctttggagagaagaggagactgctcactctctgtgcccatagattgaaaactggatctgagcagaaccttcctggctacctttcccaaatctatcattcagatacatcactttaatttccagggctaaaatgaatataaaggggtagggagaggcccatagttacacaactgggttgtcttttcaaactggaaaaatcgggagtgggaaagaagtgttttcattaacaagtggcaaaggcaatttccaaatctaagtctgtgactcaacttcaaagccaagcttttccattgagcccaggcaacacccctccttgctgagaaaacttaaaagtcaggtctagttcatctttaaccatcatcatatgtggtatcctgtttatcatttttattttaaaatttttgtgaatacatagtaggcatatatatttatgggtgacatgagatatttttatacaggcatgcagtgcacaatcacatcatggcaaatggggtatctatcacctcaagcatttgtcctttgtgctacaaacaatccaattatgtacttttagttattttacaatgtacaattaaattacttttgactgtagtcactctgttgtactaccaaatactagggtcttatacttttttttttttttttgagaaagggtctggccctctcacctagactggagtgcagtagcactaccttggctcactgcaacctccacctcccagctcaagccatcctccctcctcagccttccaagtagctgggactacaggcacacaccaccacgcttggctcttttttgcaatttttatagagatggaattttgccatgttgcccaggctggtcttaaactcctgagctcaagtcatctgcccactttgacctcccaaagtgctgggattacagacatgtgccatgcaccctgcctttattcattcttcctttttttttttttttttggtgcattttaaccattcccactaccctccaccccctgcactccctcactacccttcccagcctctggtaacaatttttctactttcgatctccatgaactcaattattttaatttttagctttcacaaatcagtgagaacatgagaaatttgtctttctgtgcccagcttattttagctaacataattacctccagttccatccatgttgttgcaaatgacaggctctcattcttttttatggctgaacagtactccgttgcgtgtacatactccattgtgtatgtattttctatttctattcatctgttgatggacacttaggttgcttccaaatcttggctattgtgaatagtgctgcaataaacatgggcgtgcagatgtctctttgatatacttcttttcttttgggtatatacctagcagtgggcttgctggatagcatggtagctctattttcagtttttcgaggaacctccagactgctctctgtggtggttacattcccaccaacagtgtaagagggttcccttttctccaaatcctggttagaatttgttattgcctaacttctggataaaagctattttaactaaggtgagatgatatctcattctggtttggatttaaatttctctgatgatcagtgatgttgaggactttttcacataccggtttgccatttgtatgtcttcttttgagaaatgtctattcagttcttttgcctatttttagttggattattagattttttttttccttagagagttgtttgagctcattatatattccggttattaatcccttgtcagatggagagtttgtcaatacattctcccattctgtgggttgtctcttcactttgctgattgtttcttttgctgtgcggaagcttttcaacttgatgtgatcccagttgtctatttttgccttggttgcctgtgcttgtggggtattactcaagaaatttttgcacagttcaatgtcccggagagtttccctaatgtatttttttttagtagtttcatagtttgaggtcttagatttaagtctttaattcattttgatttgatttttgtatatggcgagagataggggcctagtttcattcttttgcatatggctatctgattttcccagcatcatttattgaagagactattattcctccaatgtacgttcttagcacctttgtcaaaaatcagttcactgtagatgtatggatttatctctgggttctatattgtgttccactgatctatgtgcctgattttttcccagcaccatgccgttttggtgattatatctctgtagtataatttaaagtcagataatgtgattcttccagttttgttctttttacttaggatagctttggctgttctgagtcttttgtagttccacatacattttaggatttttttttaaatttctgtgaagaatatcattattttgatagagattgcattgaatcctttgattactttgggcagtatggacatactgttaaatatttaacaatatttaacactattgattcccccaatccatgaacatggaatctctgttaatcattttatttctttttatttatttattatttttttgagatgaagtcttgctctttcgcccaggatagagtgcaacggcacgatctcggctcactgcgacttctgtaccccgggttcaagcgattctcctgtctcagcctcccgattagatgggattacaggtgcatgccaccacacccgtctagttttctttttgaatttttaatagatatggggtttcaccatattggccaggctgatcttgaactcctgacctgaagtgatccacccacctcagcctcccaaagtgttgggattataggcatgagccaccaccgcacctggccctgttaatcattttaaatgtgtatttgttcagtaattaaatagaggcaaagtttttttgttagtactgtggtgctatgcacagtaacatgtcagaacaaacataagtgaatagttgaaattttatatttcggttttaagtagattctaatctgtaggagtaagtcttcgcagacaggtagcatggaaatgaaataccaattcagtatctatgtataaaaccgtaggttccattgaattgcttcattttatatttagatggatgcgccataggaagagtattttgtttccctgtatttaggttattaaaattgagttacgtctgctcataaacctgaggaaaccacaaaactcagaagagaaagcactaaggtacctaaaaacatgtttaagtgttactatctgggacaaatattgggacatatagctcaaaataatatatagctcattgttttgatcaagtatgagatttgttcgtgttacaacaaagcttcaatgagtggcagagttgcaagactaaagaagttaagaaaggactcagagggatgtggaatccatgtcctggcacactctggctttgataaatattacatgattgcagtgatacctttttgtgagacataattcattgtttcaataattaatggcaccagtgcatgtttctaagagtaccaaaggtaaataatttactgtaattaccaaagaggaatgatattatttatttatgagaactttttttaaaaaaatgaacctttgtgaaaaataaccttaggctccccagtgtaggaactgtagcttgccctccactccactcatgccaaaaaaattaaaggaacatcactactttgtattaagtgttttgccctactctgaaggtttgttggtttgggtctccaaaagtcagtataagttgttgttaaatgaggccagactgaaaccaacacctcatatttggttaatccatatagaatttgggaactttcctaaatggtttattgcttttgacgggttagaatcttggttccgtagattcttattagaagcttaattgcacacccattcactagatgtgtcctcgctcattaaatgcagataaagctgttcctcattcatgtttgcattttcctaggatgtgggtgagatagtgacttgcatgtaattgctctacaaatttatttttcaatttgacttcagggctattttttaaaaatctgtgtaattcagagtaagtttttaaatttagattttattattaccaaagttatgcaattaaataaaaagccacatcattctacaagacacacttgttaggaaaaaacataatccccatatacaccttcagtccccaagttctgctttccagagacgagtgcttggaataatttttgataactcgtatgatgtgcttggatatctctaaatactgcatgtatattgttcttgttgatttttctccatttcaggaattatttattgacttccccaaatgaaagatgaagcttttttttccacacttttcctccctatgcacacttcgtatcctcccatttccgcaaacagttgtaatttattttgcttatatctgtatttgatgcttatcttgttatgcctgtgtaaatgttactcacatatgtggcttatattatgattgctttttctttcttttttttgagacggagtcttgctctgtcacccaggctggagtgcagtggcgcaatctcggctcactgcaacctccgcctcccgggttcaggcgattctcctgcctcagcctcccaactgggattacaggtacgtgccaccacgcccagctaattttttgtatttttagtagagaaggggtttcaccatgttggccaggctggtctcaaactcctgacctcaagtgatctacctgcctcagcctcccaaagtgctgggattagtcatgagccaccgtgcctgacctgattgctttttctttccagcacaatattttattttccctggagttttttcacttgcttgatgtcctctgtgcatatcaatagtccaaccccaaaactctcccccagttgtacaaatctctcaatgtgttcacattcattaggtgatctatgtgtctcgtctacttacctcatctcgcttagagctttcttacttgtcatattccttgtaggtccactgcacacagatgtgctcttgggtcttccttcatcataaccatgaaaattccctttgttttctcttgtgttggagtccatgccctcccttttcttgggtcagtccttcactttggtggagtacatcttccattagtttcctcagagagtgcatgagaaatatgttttttaaggtgttatatatctgaaaatatctgtctagtttatacttgtttttaatttagctggttatagaattctgacttgaagtcatttcctgtcagcatgttaaaggaattgctctattgccttttaccttcacgttttgctgttaaaagtctgacacagaccctccatctgtgaccattttttctctccatgtttatagaccctgtctttgtctccgaattctgaaatgttacgatgatgtaccataatgggttctgtattcatagtgttggtcactcactgggtcattttacgctggcaacctctgtctttggctctggaaaagtttcttaaattgtttccttgatttattttcctttgttcacaattttttttctttctaggacttctttttttttagactgaggggaggatttgaacctcctgaacttatcttttgctttcttgtattttctctcctattttctagagttaaaaatttctctatactttctaaggtttttttcaatatatttgttacttctaagagttatttttccctaaatgtttcttttttttttaataagtagtctattgtttcataggtgtaaaaatatctcatctctctctagatattaatgaataattttaagttttcttctccctgaaaagcctgtttcctgcaatttgctttccttctgtttgcttgtttgttttgtttttatactggatgcttttttcagcagtctagtgacggtcagctgtctactcattaataagctcattggaagctctctgtatggtgtagaggttgttatccatgatttccactgaagtaataagccagaacatttcactgggaaattccaatgggcaggtcagaatcctcagagacttcccattttttgcctagaactctgtccccagctgtgtctgggagaccagtaaaggaagggtgcgattctgaatattcagtgtacaatccccattttcaatatggtgcctctagccttctagtctcctgcctgtagtcttctgctagggttggtggtagtgatggcaggggatcattatttgacaactgaggggattatgaaggtcaaatcactttttaaagagaattctagccaatccttctgtttttctgctgatgtgttttctcttattctctctgtcctttctgtgtctgtatttttaactatgtgactgtcatttcactgaggtttcagtaggcagcagattgtgggggatctgtgggctaataccttttatcacattggcacattcatagccattatcttttcaaatacagcttctactttattctcttcttctcttctatttctaagggtccaatttacacctatgttaaaatctctcaatgttccacatcttgtactgttttctttcttttttttaacctatccttcattttgtatatttttccatttagggctctaacttaaccctcttttatattgtgtctaagtaaagaactgacattgtatttagcactgaaccaatgcccatttgattccttcttatgtatattctagcattctatcccatttaatttattttctctatctttccctgtgtttttgtaaacatactaatcatagttattataaagcacttattagcttacctcagaatcgggatggcctgggagtctatttatagtgtctctctagcttggtttggttttatttcatttttctggttttatccacacactctgaccatgcttggcaatttttcactttatgctagacatggtgtataaaaaattgtggacacacccgatggtgatatattccttcacagaatgtttgccctccctctgctaggcaaatagaatagtaaattttaattcaattaagattttgctgaaatgaggctggtctgcagccctggtgaaagctcacactacctctggtttccccccagcacaccagcatccttatttaaaatcgttgtatgatcttcaaatctcttcccattataagttctaaacttttaagtcattttctcattactgccaaaaatctccattatgctcttcagagatatttctggttaggttttgagcttcctgttctgcacagcttcggaattcagcaaatgttcttagcaggaaactgtagcatgcttgaggccacccaaatctccaccaaaactctcctggcttttctgttcaacaacagtgacccctgtaggttaaaagtacaaatctgtttgcactggtaactgacaaaagcctgtaagttaaaaatgggcaacagaaagtcaactcaactcctgaagatgttcaccctcccagagtttggtagttcttttagttctcgatgcttcaaccgccctctgctgcattcagatacaattgctgtattttatctggcttacttggaagaagcactaggctgctactagctactccgccccacttggaaccagaagtcatcaagattgaatttttcattttttattttgagaattgggaaaaaaaattacagttgttataggattaatttgaagacatgttgaaaatgtgacatgtgcttaaaatcatagttggagttagttatgtgatatttctttgccatgtcagttacccagggagctttcttaaaagattgaaataaaacaatacatcaatagactttgttttctaacattacactcagatttcaatgtatttctatagaggagaatttaaaaattatttatgttgaatgtaagtctatctggaattagaggaatacaaatatattttatatgtgtagagaaatcagtcttgtatggtttgttgatgtaatttaatttaccattttatttttcagcatctaacattcacaagggaatttgattcagattctcttagacattacagctgggctgcagacaccttagacaatgtcaatcttgtttcaagccccattcattctgggtaagtaacctaaatgtcacttttcattatcctactacatgaacagtgcatttattacttagagttataaattcacatcaacaagcttcatatatatgaatacattcatgtatgaaatgtatattcattagtatatgtgagatgtatttgtaaatcattgtttttttctaagtaattctgtatgagttttttttttgagaaaaatttaattttgttagaaaaataatgaaattactagtacaacaaactttcctggctgttctaatcttctaggtctttaattttccttttcagaaaatttcctttttaagttttttaaaatttgaaacataatgatttttctccgttttacttttctattcaaatgaagtttttctaggtatctgatttttctttccaatagaaaattaaatatgtaagtatgcctgttaatttaccttaactgacttttgtgcttcccttaataatagaagaatttctctcaaatatttagtagttgtttttgttttttgtttttgactgggtctggctctgtcagccaggctggagtgcagtggtgcagtcttagcttactgaaacctctacctcctgggcccaagccattctcccacctcagtttcttgagcacctgggaccacaggtgtgcaccaccatgctcggataatttttgtattttttcatagagatgaagtctcgccatgttgcctaggctgttctcaaactcctgagcttaagcaatctgcccgcctttgcctcccaaactgctgggattacaggcatgagccgccacacctagcaaatatttagtttttaaatgagcagtaagctctggtattgtcatttttttctcatatgatacaggtctttgatttgataaatgatttgtgtgattttccttttaaaagaatatataaatttgaactttcgagttggtgcctctgcatttctgaagtaaaattacaattaagttgtattaaattgtaattttaaaaaatgaataaaaagaataaagatatttacttaaaaaaaaaacataccagtgtctacactggaagtgctgtggttaaaaaccacaccgagtagcctcctcatcctgcctccctggtcaatggaattcgaggcaggaggctaaaaggggacctgcttcaattactgaattaataaattagtgtatctttagatactggattcttcatctttgggtaattcaaatttgggataattgacatccatataagtagaatcaaaataattcattaaaatgatgaatatctcaaggtgtttttgcctttgaaattggcatttaggccataagttaattgtgatcaaggacaagggcagattattttggaattaaataaattaacaacaattaacttttgtgaagtgcttcatatattatatgaagtatttgctgctgctcctaattaaaataaattgtaatagctaacgtttacttacttcttgtcgtgtacctggcattgtgctaaatcttttacatgtattgtctcatttatatttacttgaaccttataatgatactgtgagatacgtattactcattatcctcattttacaaataaaaaatcagactcagaggaatgcttcaggttaaaataccgttatagattttggctttgtaatactacaattctgagaaacagaacaatatcgttcaaatgggaataattgacatgaaagtgtttcataaattataaactttatggtggcttttgagttagtaacattgcatttctttaactcaattagagaaaccttgaattattataattttaaactgctaaaaatatttatataatttatattcaatgcatatgggtctaatattggaaaagcaaaagaaaaaatcagattcaagaaggaaactatataacatctgggatacattcagggagcaaagatgttgaagagttttttgaatcacgcttgatgaattgccgccatatttcaaagacctgaaaccatcactttgtattctctacaaatcaaagacaaggtactagggcttaatttagtaaactgagaagttgaagaaacatgataacaaaatcagaaatgaactttcccatacattaaaaacaatgaagtatttgagtatgcaagttatctccccttcaccttgaatgttattgaagacaagagagacaatagacatgtgcaggaaagcaaaagtaatggcagcaggtgtgggcttatttgaaaaggaaaatatagacctggtgtgcacttagaaatatttcactgatgccaggtccttgcagtttatgcagctacataaggcagatatttttctaggttgtcccacaaatgccagatgccctggtttcattttctgatggtttttatttttcctttgcttgtcattgacattttctgttgcttgcttctaattatattacattaattcttcccatttgctttctaaattattttgcagctattcttctccacttcctcagtatgattcaaggtgataactgtgtcctttatgtgaaccatcctttttgtatttttaatttatgtgaatttttgccatagttagatcgtgtcaatgtctgtagtatatcagcatttgtcatcctgctgttcctaaaactagaaacattcatgtattagttttaggatcatttgtagaatttgtgctatagtttaaatattaatgatacaaatattattatatatcacctttttaatttgttctataagttatgttgcatgactttttcacacaatatgtaagacatgagtttgtaaaacaaatcactatattttataatgttattaaataataggacccatgtcctgtttaatgaatagtcccacttttcctcagtctgttgactctatgaagttgagaacctcagaacaataaatggttgctggtgagcaccagccatgtactgtgtgctatacagaacacagagaaagagactcttccagtttgttgttaatatcatgttaactagtgttttttccattggttctgatattctttacagctgagatatttttattttaatctgataaactgtacgctaccttcagtccactcagctccaatcagctatctacctatctatccacccatcaatccattagtattagtaaccgagtctcacctacacagtttctaagcaaaatagttttattcattggttcattcagtaagcatttatcacgtccctattttgtgctagaattgtgcttggctctgcaggtcaatcagtgaacaagacagacccaatcagaattactctctatattgttgagactcagcggttgccagggcaaacattcccctctcagtggaaacattccagtgtgtgtgtatgtgtgtatgtgtgtactgacacaactgaatcttcaagcccagagtttgtcgtgaatcgttttaaatccattctgttactattattcctaatgaaaaattgatttttgtagttacaactacgaagtgcagggaatgatttgatttttgtcttataatattgccatattgccttcattattgaataaaagtagttgttaaatatacgtatgtctaagaaaatgtaggcagcccagagcaatttcaggtgagcctcatgtcttttagcattggtaacaattcatcccgacacttgtacaagtgaacaagtatctttttctttgactagggaggagtgatttttgttttctttttgtttttgagagagtcagtgttttccccttttaccttgattatcgtagtggtcccaatctcccaaaatcgatagaatgttgtaagagacataaattcattcagagtaaaatggttaaatccaaaatgagcaaaagggtatgaagacgagtccaccttactgatgagcagagttggttctaggaatctgataggctgaaaaatgatcgccagcccattgcctctgcctgtggggatcacaggccagtttgcttgaaaaggtcactctttcaaggtcaagaggtagcattcttcagaagacggtccccagctaggaagtccatgcaaggtcttaaaatctgtttgcaggatgttagcattgtttttaggggaaaaagtagtaaagatttttgatggatgggactttttttttctaaaaacactttaagaattccgacaattttctaattatcaccattttgtactgtgctagtagtaatctgtgtattttcatacgtggaaactagaatacagggatatatttgtgttcccctgtctgaccttaactcttccacacattgaactcattgatttatgtttacttataactctgtgataacgataactgtgttataactctgtgatgatgatagtgggaccatgcatatgtgatagaagacagtgattccaatatgcttctacccaaaaataacagttaatttctttatagttctatacctattaatacatgcagacagttttttccttattagctttaataaaaggccaatgacagaattatgttatttagagccattttctaaaagtctaagttccacttttttaatcattgtataaaatattcaaatgtaggttatttcagacagcttttaagcccatatttatactgaaaacatttaatctctttccatcaaaatcaccgtagcaaatctagtcatctcctgcttttattcttatattctgcttcatcatagtaaaaattagtgttggtatgattaaaaatacatttattttatgagtcgtaaatatcaagacatactgtggagtttcatcttacttgtaagagaccatatggcagcatatggcaaaaaccacttatagttaaaatgacctttgaatataaagaccacagtttttttgttttaaatgcatgagaatcctgttactagaccgattttactccagttttgaaaccttccttattccttccatttgagcctggtaaagtagttggcttttctatgggggccatgttccaccaaaaacaagttgtgtttcagtttttgcaaagtgcacaagttaaatgcatgtttgatgtgactccactgtattgacttctgatttatctttagaggaaatgatagctacattgtctgtcgctttaaataaacttaaacatttaatttccaaacttgctgtgagcacagtttatttccgtccttgaattggcctctgatcttctcccctcaggtttctggttagctttatggtggacgcgagagggggctccatgagaggaagccgtcatcacgggatgagaatcatcattcctccacgcaagtgtacggcccccactcgaatcacctgccgtttggtaaagagacataaactggccaacccaccccccatggtggaaggagagggattagccagtaggctggtagaaatgggtcctgcaggggcacaatttttagggtaagttgttttgtcaattttaaccttggccctcacaatgcatctttgattttctttacccttgttaactcaaggagataactcttaaaactgcttagttgtacctgattgagtatactttttgtaaagtgtcaaaggtcacaaagctgtgtgattctgtgaaaggctaataggctgatactttcttaactcagtttgctagtcaaggcttttactaaccgagaagcatgttctctgctcagcaagtgcacggaaccccagtggtccctgtagaagtcaaggcaccattctagggaaaaaatacagatgctggaattattttaccgcattgaatatatggctactttggggacatgtctttttaaagaaaattttttgggaaacagttcattgtgatatggtattttacaaaaaggaaaaatgaatttaattcattttctgaggtggcacttgggtacaaatcaggcaggctctgtcgtgactgacagtttgttcacaatttccccttctcgtttctctttctgctgcatggatgttattcagtaaactgcatcttcctaccaatcctccccctgtaaatgagggtgagagcttggttagccgaatcctgcagcttgggcctcaaggaacaaaatttattgggtaggacctttatagacaagatacagaatgtctacaatttttttttttccattttcaatttttttctgtcacacccatggtctgattcttgtcttaagtttatttttattttttaagttttttttaatgctttcagttgatgtgtgtcactgaaagaaaaaaaaatcatagtggcttgacttaatgtagcaccgctacctatcttgtgcttttcaggcatgtggaattcactgcaagcattctgctttcataacttcgtgcttttgtaaacctttcttttatttgaaatgtttcttctgaatatgatactttttaagacagcaaaagtctttaacccagtgtaagagaaggtatttgcaggctttgagtcaacatttgctatcaattacatgtatgtacacctgtgtgtgtgtgtgcgcgtgcgcatgtgtgtgtgtgtgtaattagatcttttaaaagtacatgagtactgtgtaattttttatgggctttgagaagaagtcatcaataagtaaactgattttgaaaagtgttgggaaaataagatatttaaataaaattaaataggcagcagatagagtattcttttaaagttataaaattgtttcgtttggttttgtttgagctgaaatgcattggtatttgttgtttgttcacttgtctgtttgattgttgtatttgccttggcagtctgcatgaagaaacctgttaatgaaaagctatgcttggctttcaccttgatcaaagacccttgttcataccttctctccaatatcattgaacatcatacataaagccacattccttaaatatttacagagacagtatctgacatattaacctgcaaagattgtatcttgttctcaaaaataaatacaatttaatgtttaattataaggtgtagttaaaaactctggtaaatatcttaatcttgaaattattaatactgctaagaacacttgattttgtttctacctattgaagaataaaggcattataaaaattattttttaatctttaatttgaatgaattatgattttgctaaaagcaaaatgaccatatttatcatccccgtttgaagcaaatgcttttctaataaatcgatattcatgtttttatttatattatttgatcattacaactactatccctttttctgctcttacttacttaagcctgtatcttctgttatcacatatacctaaacacataggttaagaaatggggttccatacaacctctgtaggagaataatgatactgtctacttaaatgtcataaaataaagctgcacaatccaactacataaactgtgtgtgattgtggtctgcttacttccattcatctcttttagtatttatcctattttaaaatttaacaaaattatttcccgtggcttgattggctatgttcaatttgcagccattcttttacattcctttgcaaaaggacactgtcaaaaattactgtgtcattatgtgacaatttcaaaccaacaagtacttttacagaaagtgtaagtattcctatgcaggttatattagagccaggaatggaagctacctactaccatttcacaaattgaaaaacacaggaattgtcttaactgtacaggccatgaaaagcatggaatctgcctgttggaggagtcgttaacatattgattgttttcttgctaaggagaaaatatagcaatcatctttcaaactaggaactttatagaatttttttttaaagaaatgactgtgtccttttaaatcattagcatttgtataatatacctattgtgtcttttaaaaatggaccaactttcttatggtctactttaataagtttccattctgattcaaaattcctatttatatgtactgaaaaatttcccccattaaatcctatgcctaacatatggtagtcctccaagaactgtttgtgaatgaatgaatgatggcatgttttcaggcttcgaaaatattctttaattagcaaatgattctgcagctttgaaatcattcccaaccttagtggcacctctgattttcaaatgaatactgttaacgaaacattttttaagtatgatactataaatatatttaatttgataccaaaataatgtggattttttttccagccctgtcatagtggaaatccctcactttgggtccatgagaggaaaagagagagaactcattgttcttcgaagtgaaaatggtgaaacttggaaggagcatcagtttgacagcaaaaatgaagatttaaccgagttacttaatggcatggatgaaggtaataatgatggctccttggttctgtaaatgtctgcaggcagaaattaaaggaatgactagattacatgaaacaggacctgaatttcacacatttgtattttaagctaggacccaagttcttcagcttttgttgctgttttctatatcataatgctgaagttccatttaatctaacaaactttattctccgtaatatagaagtataagtattttgatgattccatctttaatcacatacatcaatctttccaataccaaagaaagttttctaagtcaaaaatgagcaagaagagggtgaaataataatggaaagtatgcaaggcatgctgagcattttgaagaaaatatgttcacattttatttttggaattatttctggactctttcagctttttcaagtttctcccagataatttcagtatccttcataaatttttgatttctcttgggccataattagtctttaaaaaatgtttcagggtaattattggggtctgtgttgtttcaatgtctcattctttgacctagtaagactggtatatatctgagcatgtcactttttcatacacaacttcttcaggctgtctgaccctaagaaccagagcaatttttcttagtagacattgggaatagtctggttttgagaataggtgtttgacgcagagttttcctttaaaaatgtaaaaaaaaaaaaattagagaacaggctcaccataacgtctgatgctgagagaaaaatatcagagctaattcttcctttatactcacttcctaatcactccaaatccaggaattatttaaacaacagctttattcgagatataattcatattccataagatccactctttttcaattcactgacttttggaatgcactcagcatagtctccagtgagtttcaaggtgtgaacaaaggagcgaggtgaaccgtagggtacttgaggaatgaccttgggcaaatttattgaactctgtgagcctgtctttcttctgcaaaatggagattaccttcctaacttcctatggttattgttgagaataaataaaataattatgtgaggcacatgtgaaatacagtccttgttacatagtaagcccttgataattatgagttattatcaccattatatttgttctgtagaaaaaattgtcatgccaaaggtttggtataagacacaatcgccaccaaccatgaatttaaagatgtctttacagcaaggtagagggagaatagtaattgttgagtgtctagcattcatgaagcactgataaatgccttcatatgtgaaaaatttaaaaagaaaggatagcactgcaaatcaggtggttttaattccactttactgataagggtgctaatcaggtggttttaattccacttataaggaaactgaagttcagagatgtcaagtaacatatctaaggttattccactgagtagtaaggctggggtccaaatgtaggtctacttcttttcttttcttttcttttctttctttctttgtttctttttttttttttttttttttttttttttttttttgagatggagtctcactctgtcacccaggctggagtgccgtggcacaatctcagctcactgcaacgtccgcctcctgggttcaagcaattctcctccctcagcctaaactaaggctcagagagattgagtgccaaactcaaacctacacgtgtaggtttgttatataggtaaacttgtattgcaggtgtttattatacaaattattctttcacccaggttcaaagcctagtacctactagttactttttgtgatcctctcactcctcctaccctccaccttcaagtaggccccagtgtctgttgtctttgtgtccacaagttctcatttagctcccacttataagtgagaatatgcagtatttggttttctgttcctgcattagtttgctaaggataatggcctccagctccatccatgttcctgcaaaagacaggatctcattcttttttatggctgcatagttttccaaggtgtaaagaaacaatgatgtaatcttctgtcttggattctatgtgttattttggaaaaactggatagcatttccttgccacatttttaaagaccagataaactttggttccattttagacaattcaaaggaaatgcatatacttccaggcttaaagaatcaagtactggagtccactagagcaaaaatgaggatggaattttcaaggcacagattttcttcatgtattaaacttaatagtaatgaagcaaccactacacacattttataattgaagctcagttaatcaaattgtatgccaaactcgaacccttctcgccactcttttcatatccccaaaaacacttcattcttaccagaactttcctctcttcaaaagcagaccagccaaaaaaaaaatcccaaatctgtctttttaaaaagccaacttcttccttgaagggacaactgttcaaagttctagttcagagagaagcataagcacagtttaggaggtttcatgttttttatgttcttttatcctctctgttcccctcccattttgctactgaataactgttaattaacaagataaaaatagttcctgaattaaaccagtgaccaggtcactcaaggtttccttaaaaaagacaaataggccgggtgcagtgtggttcacgcctgtaatcccagcactttgggaggccgaggcaagtggatcacgaagtcaagagatggagaccatcctggccaacatggtgaaacccccgtctctactaaaaatacaaaaattagctgggcgtggtggcatgtgcttgtagtcccagctactcgggaggctgaggcaagagaatcacttgaacccgggaggcgcaggttgcagtgagccaagatcgcgccactgcactccagcctgacgacagcaagactttgtctcagaaaaaaaaaaataaattgtcttaccattatttaatataacgtattaatttcataacaattaagctttatctgtcatctgtggcaagtgacccttgataatgtctgtcttgttataaatgtttactttttcaacccccttctccatagatgaattctatgtgctactttataaccaatctacatgccacttttataaccagtcctgttgtaggttcttctctgaaaatcttaaaactcaagtatttaaaaatcatcttagcaaatattctgatttattaacacaattgtaaatatcagtttatgttcctatagtgtgttaaaatgtgtgaagcctttccatgtacgcaatcaaatttaactagtagaataactcctgggaaagagaagtttaaggagcaggataatttgccccatgtaatgtggtggttgggatcatgatttatggaagttacacagactagacttctcatcttggctccaccgcttactcgttgtgtgaccgtaatgaagcactcaatctctgagccttggtttaaatgtgtaaagtgaggatgcctaatagtgaactaataaggaatagatgagctaatatatgtaaagctcctagcttgatgcctgatatatgagaatcactcaatcagtgtttagtcatagtcacaactgccgtgtaagttgtgcaggagagcaaatggggtctgaaatcttgcccttttcacttgtcaagccatctgccctgacactggcctgtaagacataggggtactttcttctaatttgctcaaagctgctatctagttgccaacctgtgtacctacaaggttgtatacaccccaagtgggcacccttttccaaatcgtacaaagacactacatcagctagtaaaagccctggtcatcgttgattatgatgacacacactcaacatcgccaccacccggaaacagtaaatagatttagtcttccaaacctggacttctgactccacacctagttgtctctctgcactgctcctttgcctctgtatgctctcaaatgaatgatgcctgtgaaagtgctttgtgtagaacaaaagagccacatatatgtcagctggtatttaagttgtccattactaatgaagacacctcttagtttctttgtatgacacaaaaaatatggtatgtattcaggaaaaactgtagctgcaaaataagggggaattaaaagttactccttatcaccagcaagcccagggactgaaatatcagtggttttgctaacgaagtaggtgtattagcaaaggtctattgaagaggctagaatcacagaaaggacagttggtctgggtgtgaagaacttgccatcaccactaaggtatcatgcaacaagaacaactttaactttggcagcagacatagattttgttctagtctttgtcaatttttgttttctcagccaagaaaaagatgctgcaaacagaaaacaaacattcattccccccaccaaattataacgcagcgaactgaattaactttttaagtttaatgaaaaccttcctttaattaaactcacaaagtttaattaaacatgtttaaagttacatctccaaagtcagaccccaaagagtgttttgtagtttgctgttatcttggatctggaattttctagtagaagaggtccttaatttacaaaccaaaagctccagaaatgttctagtcctgccctgtcccatacagtagccactagctccagggaacaacagagcacttgaaataaaattagtacaaatggaaatatgctgcaaatgtaaaatacaccagatacgcgaggatgagtaccctcctccaaatacatatctcattattaatttttacattggttacacattgaaatggtaatattttggatatattaatctaaataaaatgtacctataatcccagctactcaggaggctgaggtggggggattgcttgaggtcaagatttcaggagctcagcctgggcaacatagactccatctctaaaaaacaaataaaaaattaatttcacctgtttatttttattttttagtgtggctataggaaatttaaaattacatacccagtttacattatatttttactggacagtgcctctctggacagtgtgtatgctttgttttacatatctattttgttttaacacaaaaattgttgctacctaagtattacacggaaggctttgagtatatatgaattatgccattatttaaaaatcccaatcgctgtcttggaacaaaatgttgctgaagttcccccaaacaattttacaatgctaggaacatattttcttgtcattgctgaactttcaaatgagagcaaatgaagtttttaagataatacattttagattgaatagttacactattgttttattgtaaacaggaaagggaaattggtacttgctatgtaacagaaaattttttaaatttactgtctgactacataaacagtatcttagaaacagacttctcagaagttgccaattgggttcatttcaatataatttaattgtttttgccatgagaccaatagtgttaagtcattgtagaagcagttgagcactgatgtgaaatgtgtagctttatgttgtgcacagcaccatctgctggagaaatctagtaacagttttgaaaaattcccaaggagagaataaaaatacaatttaaccaaatcaggactgtggttggggtgcaaaaaaaaaaaaaaaaaaaaaaccatagcaaaatactgactttcagcctattgccataaactggcattttaaatcaattgaatgatgtccatcgtgttggaaaggaaaggaaactgtagcagaacagtcccccaaactagtagaaataaaaattctagtttagaaatgaaaattaggacaaagcaaataagcattaataaggacaggtttttaatgcatttgcatatatggatttgccagaaattacatgtctttatgaaacattagtggatcaaaataatgacataagccatcctgccccccaccccccatatcaggcacagtagagcttttagccctctgagggcagtgaagcaggtccacgaggttggacatcagcctccactacctttagtgttgatgtgaacagagagaccagtgtgccagaaactgcaggtctaagcttttggagtttagtgtgttctgtatttgctgctcatgcgaggttattgattcattgtgtttaagacactatttatgatcctggattttgaagatagaatcatattaattgatttttcccttagatgtaacagtaatggcttaaacaatggggtgaaaaaagtgacatatagggactaattgcctgaaaccatgtttttatttgcacaaatggaaaagtaaacaaatgtaagtctcttaatctgcagtcatggaagaaaaccttagaaggattattccagtgtggccagacgtcccctacttctcttcctccaggaagccctccctaatccccagactcagatcaaactggtaaatacacccacagtaccataactgcaactttgaactttgatatcttccttggtgcactgcaaaagtccaagagggcagagaccaactctgacttgttgacagccattatgcccactgcatataacaactcttgatacagagttgtcagttcatcatagtctgttgcatgaacggagaaatgaatgacttgtgtcaggcatatgccccccctgctggtgacactttttctcaatccagtgacccatacccaagagagagaaaaactttctggaagaagggaggctacaccaaatggagagaggaagtctggggcctggggaaggctctggggcaggttatggtcattctacacacagagtacaaagtaatcttaaatgtcaacactgaaggtagagttcaaaaaatggtcacatttgtccctgatttttaaagtaatatctcataagcacataatgattaaaaattaatcttctaaaaatagctttaaaaatatatgattgtcagaaattatattaatagactgctaaaactggagggaaaaacaagcaggtatatcattgtttccagacattctgcatcatcagcacttattacacgtgcaaatctaaacagcaaagaggatctctaccctgaataaagatgtgaaataatgctgacccaaatatatataaaccagatgacagaattggataagaatatgagttaaacactaaaattataaaaggtgcatggagcctttcgtactatctttgccatgccccatgaatttataattattttaaaataaatgttttttaaaacattgaaaagatctctatgatgttaacttcaaggaagaaggatcaagttatatcatttgaggatttttccctataacatcttatgtgaacttattatgaaatttgtgtattttgatggagctgaactttaattccaaagggataaatgcctgtagttttctaaactagttcagtaaatatattacaatgctatgttgttctacatattctataactagagttgaatattatagatttattttttattttcttcatttctcccaacttatttgatatttaattttcagtaattggtgattttctttaatggaatgaaatggaaatgatagcaattcatatttatattttgtagagaattatttttaaaatataacttgtgtattttcttagatctgctacagattgactctctggctgccctcaaaagctgtgtgacctcgaaaagaatatataactcttctaagttattatgtgaacagaattgtgctgggtggttttctgtcatttttttttgtcatatccatcccagaggaaactgctcatcctaatcacatagatgaggaacatatggctcagagaagttcaggaacttgcctgaggtccaggtgcactgactatagagctatatttcaaccctgggcacctgtctacagtgacttaccacagaccccataacttgctttttgaaatctaacattctaaaaatcctttactttttcacctctcaatatcaaataccccattcttagaggagctgagaaaagcctgcacctgactagaaattaaccctgatacacaaatcatcctttgggaaaccttgaggccatttgtattccttccatggactattcacactccaccctgaccaggtcacaagtagcctttgaaatctaaattgatacaggaaacagagctgtgtccccatttaacgaagtgatcgagacatttaattgtgtgcccataagagtgaggcaaaaactaatcaagatggtcatttgaaagcgttaagagtaacccatttagtcagaacatgatttcagtcatgttatttatgcttcgttgtattatggtctccataaccatttatatttgcaaagcattttatgattcttgttgtttgtaacaaagcctcagtcacagagaatgctgtcccaccttttacaaataaactgagttacaaggtgcttaagaaatttatcatttatctatgaggcaagaaggctatagaacattagtggctctgtaatcaggcctgctgcttagatgggtcaatgagaagtcaggtcaccttttcgaccacggcatttgcaaatctattcattactcatccgtttatcaaccaccactcgtgtgaggtagtctgcaaagacactgttaaagagtggttgaagtccatgtctgtgtgacttcatctctttccaacacccctttcctagacctaggttctaagctctaaaactgacgagctaaatccatctggacaagtcacttcacctctctgaacttcagacacctattttaccaaaatgctgtgtgggccaaatgataattgacctgacacaaaatagaccttcagtaagtgtaaagttcaatcttcctcctggccaaaactgcctatttcagaactcacttctcttttccctctaatcctctttttgtatgtgagaatttagtaacagattttaaaaagagagaggagagaggaatttcagggtcttttcatagtctatggcattatgaatcaccctgaaaggtaagaagctcttatgtttatgttctattgtttactttacagcaacttatgccatttttctccctcaattctgtagctgtggagttatttagaatatccttttaaaaaacaaaaccatataaaagtaatgaatatttatttttgccaataagcttttcttctcatattaaaccattcttattttttatagggtcctgttgtcatgtttttaacaatttgggttctgaatttttaagacaaagtacaggatgagagtctaccaagacattactttttcaaatgtgtcaaaaagtcacctgggtagagtgtgaaaacagatttttaggtttcactccaggtctgcctagtcagaagcccagcaatctgtggtactaacatgtagtacgattgtttcttacgaactggccaggttggaggacattgcattaggagctaggaactctgcagatgtgaatgtgatagtggcattgcatttgtgccgcagattattttgtcgagcttttttctgtaatgtataggatgggacaaaacaaaggattcttggtaatatattgctgcttctttgacctaattagtaaggaccgtttttaaaatctaaatacatataagttcaatcccagaaagaatattggcactgttcatttttacattatcaggctttattactatttgtctggaaatctgacttctctgatatacttttatcttattttattttatttctttctttatttttgagatggagtctcgctgtgtcacccaggctgcagtgcagtggcatgatcttggctcactgcaatctccacctcccgggttctagtgattctcctgcctcagcctcccgatagctgggattacaggcacctaccgacacacctggctaatttttgtatttttagtagagacagggtttcaccatgttggccacactggtcttgaactcctgatctcaggtgatccacccaccccagccttccaaaatgctgggattacaggcatgagccactgtacccggcctctgatatacttttaaaatatgtaatacaaaacttccagaaagaggtttatattcttatgaaagttaaactcattttgtgtaaatgttcattaagtaaacagtaatttgagttataaacacatggacataatagatttcactgtggattaaaaagtaggaagattagaaccactttttcacatgcattttttttaataaaaataaaactaggccaggcacagcggctcacgcctgtaatccaaatactttgagaggttgaggcagaggattgcttgaggccaggagttcaagaccagcctgggcaatatagcaagggccagtctctacaaaaaaagtttagaaattagcagggcgtggtgatgtacatctgtagtgtcagctactcaggaggctgaagtgggaggattgcttgagcccagaagttcaaggctggaatgagctatgatcataccactgcattccagccaaagtgacaaagtgaaacctcgtatctaataaaataaagtaatctaaaagaacaaacaataaccagtctctactagtacgtatattttatagcaagacttaaagaactgtacagttgtttgatgtgaaaagtgtctgagtctcattgattcccagctgatttctttggtagatgcttgtttagcacctgctgtgtgccgggtctcaatatcaaacatcatttaatttaatatagtttaactatggctaccttgctctttatgaaaagaacacctaatttttaaaacaactaataattttattagactcaaaagccttaggggaaggtactcatgatgccgagcaatgcggcccacagtcagggtgtgagagttagctgagtgtggagggtccttgcctccttcccccttggggcctctctccagctgtctggggatttcgttctctattttccagcactgagctaaggatattttgttttgtatttcactttccttttttaaaagcaagaaacagggaaaaaacaggtttgagttgaatgtgttaacacattaaaatgttatctagggttttatttacatataatatttattaatgctaatcctattaatggtcaggtaataagttttcagatcctaagaattctgtagtgacattactgatggctttacttcctccttttgccttttcacacttacctactatctatgtcatttattttttttttgacttatgcaatatcctagaatttcatagcctagccatcaactgcagcccttgaagaagagattatgcctttctttacaaaagaatatttaagtaatactttttgtatatttttgtatttttcttggcttttattcttagagaaaaaacttataaatatcttaagcacacaaacaggatgaaacctggttataagaaaccagagaggctgggcgtggttttcacgggtcatgcctgtaatcccagaactttgggaggctgaggcgggcacatcacttgagctcaggagttcaataccagcttggccaacattgtgaaaccccatctctactaaaaatacaaaaattagctgggcatggtagcgcatggctgtaatcccagctacttgggaggctgagacaggagaactgcttgaatccgggaggtgaaaattgtagtgagcagagattataccactgcactctatcctaagcaacagagtgagtgagaccctgtccaaaaaaaaaaaaaaaaaaaaatagaatactgtttctccatttcatcatgtagacacctggaaatctgactgttgaagaaggcagtgcatgtgattctatttaaggaatagtacatggagacactaaatgtcccccttgcctacagcagtgcctgaaattcccacattagttgtgtctttgagttggggcttatcttcaaaatactgttaaaatgtacattgaaggtcaataaccatgcaagttttaatggtgtcaaaagaattgctaaaagctttgaaaaaaaatgaacacaacacagagggtccctgagctgctgggaaattataaaatatgtcagaatttgaatgtggagggtactgatcgcttctcctcggagcttctctgtttatatagttagaaatctgagcatttccacttgcaacttgtctgctgcatctgaaatgtacatgttcactttatatttggggtggctttaatgccttatcaaaggtgacagagtagagcttaagtgtggtcagcctgcctctatcacgcaaagtggcaattcttctcaattcagtgctgtcatcgttttcgggggtgttatagctgtttctttctacttttaatcctcacaaatgtgtgcacatatacccagaactctctcacacacaaaaatagctaagaagtgtacagtacttccagttccccaaaagatgcctcagttcctctggtgggtctagactgatctcaagtaaatttcatactcacaggatacacagcttgttataagcagaattaggaaatctgccccatttgaaggatgtaatttcatgatctgtcttcttaaattgctagcaccataaggagtcctgagccattttgaaggagaacatgacatctttgtggctgaagtgaaaaaatatctgcttagctgatgatgatatgttgtatagcgatttaaacagataatcagaactttctcagttgcagcatgagttatgaacttgaggaattcactctcttaagccaaatcatggagagggaaatatatttgctttctatggaaaacgtttatctcctttcagttacattgaataggtgaaaactcccccagaatattctcctaagcaaactgtttgattctttcctatttttctgtaggaaaactttctttttaaaaattctggccgggtgcagtggctcacacctgtaatcccagcattttgggaggccaaggcagccggattgcctgaggtcaggagttcgagaccagcctggccaacatggtgaaaccccatctctactaaaaatacaaaaattagctgggcgtggtggcacacgcctgtaatcacagctacttgggaggctgagacagaagaattgcttgagcccaggaggcggaggttgcagtgagctgagatcatgcccctgcactccagcctagccaacagagtgagattctgtttcaaaacaaaacaaaacaaaacaaaattatttgttttcttttcttttcctacactaggatttcagtgtttaggtttacagagaagaagatacttgaggaggcaaaaaggagtaaaattgcagttccttttttttctaatagttacttttttaattaaagaagaaaatagttctatagtcattgttccatttgggaaatcaatgtttgataataaaagttctgttggtggctcattttttaaatctgggttgaaccctgtttctctcctagttgataatttgatcctcccatctcagagtttagtggttgatccgtaaaatgaaaaagatgtattgatccaattacctaatcattcattttgtcattctacaagtttctatttgaaataagccataatctcagcctcacgtatctgataaaggaggcagaaatgttaatagtgaagggacagggggacctgtgcagtatgtatcggaggtctgaaaagagtcctgtaggagtaatgaacaacaaaacaaccccccatcccccaaagtttgggaatttttcctttattttgttaataggtaaaacaagcatagctatatcaacccaagggtaatactccctgttccctaccctcttctcatcttccttccccaattccatttcctgttcctctgaggtaaccattgctaacagcctagaatgtttcttctacatatttcttataaaaatatacaaacgtagcctggcgcggtggctcacgcccgtaatcccagcactttgggaggctgaggtgggcagatcacgaggtcaagagatcgagaccatcctggccaacatggtgaaaccccatctctactaaaagtacgaaaattagctgggcatggtggcgcatgcctgtagtcccagctactcgggaggctgaggcaggaggggtgcttgaacccgggaggcagagcttgcagtgagtggagattgtgccactgcactccagcctagcgatagagcgagactccgtctcaaaaaaaaaaaaacaaaaatgtgcagattacattttcccctataaaggatgatcctgtgcacattgctgtgcatcttgctcaggtgtacagcaatttccgcaggttatacagggcagtcgctctttgtctggctccctcctatcctccctccagtctaccctctagtgtcacatctcaaatcatcctgttcaaacgagaaactctcctcccacccccaccctccctggtcacattctagtccctcactttgatttattttttcttcatatttgtttagtgatgtatctaccccctttatcccctattagaataaaatttccatgtgagagtgactttaatttcctttctaccctatccccagtgactagatcagtgctctacatggtggtccctcagtaaaaacttggtaaatgaatgaattggaatcattctgtttactaactgcaggaatgtctaggatatgggtaaactgttacttatgtaaccattcccttattcatagagatgcaagttctttcaagctttagtctttataagcaatgctgccgggtgctgtggctcatgcctgtaatcccaacactttgggggtccaaggttggggggatcacctgaggtcaggagtttgagaccaggctggccaacatggtgaaaccctgtctctactaaaaatacaaaaattagctgggcgtggtggcgtgtgcctgtaatcccagctattcaggaggccaaagcaggagaatcactagaactgggaaggcagaggttgcagtgagccgagatcgtgccattgcactcgtgggcgacacggcgagatctgtctcaaaaaaaaaaagatgtcagtaaatggtattgctgcgtccagggtaggtgcattttcaatttgaatagatgatgcccagttacactgttaaaaaattattgccattcacacccacttgcagtaatgaaagcacttatttcccttaatttttctctgataacaagatgtgattagtgtttaattttagctaatccaagaagtgggtgtggagggagatagtatctcattctaattggcatttccatgtaaattatccagtttgaacattgtaatatgttttattgaccatttttcagcttctgtgaattgcctgtttataatattttgctatcatctattgacttatctgccatcctattattaatacgtttggtattgagcatattaatcttttacttgtcaggtgtggctatttttccagtctactttttgcttttcaagtttactctttttgtcatggaaatctttacatttttatgtagtcaaatatattaccttttatattatgcttttaggcttctgggtttccagttttgtataggaaagtttcccctaactaaagcgaaaccatattttcctgaattttttggtaagattttaattttttttttggaaatggagtctcactctgttgcccaggatggagtgagtggcgtgatctcggctcactgcaaccttcgcctcccaggttcaagtaattctcctgtctcagcaccccaagtagctaggattacaggcgcatgccaccacacccagctaaattttgtactttttagtagagatgggatttcaccatgttggcccggctggtcttgaactcctgacctcgtaatctgcctcggcctcccaaagtgctgggattacaggtgtgagccaccacgcctggccagattttaatttttaaaaatagttgtctcctaagcaaatgtaattttttatttatatacaataagatgtgatttagctttgtttttccaaatagatttcctattatgtaaataccatcttttaaataaatcatctttctctcacttatttgaaatttaaatatattaccttgatttaaatataacttaaatacataatacatatataaaagtatatgtggatttatatatattcagtatacatatttaaacttgaatctatttcttgattctctattattgtcccccaacctatttgtctattcctatgtataattcttatatttctatatgtgtgtgtttaactgtttaattattgtacttctgagtaaatcttaatatcatataagataaattctccgtcacaaacctacttttccaaaatactcttgctaatctcaaacacttattatgccataaaaatttttaatcatttattccaatgaagcccaccagaattatgcataaaatttggctttgaaacacacatacatacacacacacacacacacacacacacacacacacacacacacacacacaacctggatggactggagtgagagaggtgagttggttgggaggtggtcttagcaattaggcaaactaaaacagggcctgaacacccgggtgacaggagggtgagccacgtccaaaagagaatcaactggacttggactttgaccatttgttaaggaagttgagtcataactattagagtgaaggaatgagcagattgtaaacccttcctagagttaggactatggaggaaagtacttttggaggtagacagcagggaagaagatgtatccatttgtggacaggttgagttccacgcatgagagccatcagtgggcacaaagaaattggtgatgatgatgctaaacatttggataactttaaaatatttgaaagaggtttttaaatgaagttctggaactttcaggcatacttaagttcttattcactttcttatgaggcctcacttttttttctttttcctaactcatttctacttttggcagcttgggggcaaattattgtaaattcccattcttgttcttgaaaactgggaatttatccacaggtggcaaaatgtcagttcttgaaaatgtttgttcccactctgtaaaaatattttctacaaatacttatattaatagttttataatatttttgcaaaacccaatattttatggtcactaccattttctctttatcataaaaactgtttaggctatggagtataaatgattttgactattaaaatgatgtattgcctgggcccagtggctcatgcctgtaatcccagcaccttgggaggtcgaggcgggcagatcaccggaggtcgcgagttcgagaccatcctggccaacatggagaaaccctgtctctactgagaatacaaaattagctgggcatggaggtgcatgcccgtaatcccagctacttgggaggctgaggcaggagaatcacttgaacccagaaggctgaggttgtggtgagccaagatcacgccattgcacttcagcctgggtaacaagagtgaaactccatctcaaaaaaaaagatatatcattttgacttaaggtatgttgtagatatgcttattctcatggcattttctttcatttgtcttttcagaacttgatagcccagaagagttagggaaaaagcgtatctgcaggattatcacgaaagatttcccccagtattttgcagtggtttcccggattaagcaggaaagcaaccagattggtcctgaaggtggaattctgagcagcaccacagtgccccttgttcaagcatctttcccagagggtgccctaactaaaagaattcgagtgggcctccaggtaatgttcacaaaaagttgtttccctcagtatgcgcagagagcatgtgagtgcatgttttgctctggaaagagttattctaacatcctaatgatactgctaattaggccgtttggggaatcatttacctatttcagataaaaagcatcaagtataaagttagcttactggcttgttaaataaggtacatattttagggttgttctgtttaaaagtctcagttggtttctgatgaaaaataattttttaaatcataggttattggtctcagtatgtggaacaacataccaagccatggtttatgatatgccacatcataaaaatcagttatagtgaagcctgcagactttagtgttttcatttgattgaagtaaatcataaatactgggttttatccaaaccagttggaacttgatttggtttggaaagctggctggaaatcttggatcaaaagatttttcttgtgtttatttcagctagactttagttctttttttctttattgaataaggaaaatgaactaaagtaacttaatagatgttattaatattgtaattaatagtttaactgaaggttcatgttcttcttgtgaggctggactctcctgcccaatggagttaactgggttttgtttgtttgttttgagccaagcatacttaagtcctgagatgacctttaataagtagttagcactaacgagaccaccttacatttcaggggtatgaagctcccttcacctgcctcccataccaagttattttaccaaacagaaaagaaaccaagtggtagaagagaggcttagtagactagaattgaaatcttttgaaattttgaatgcattttgttattaactctgaaagcctcggtttttatgtgggtatgagttgcctttaggaggttttactgaatgtcctgcataggtttaaaatatattggactcagcatttattgtcctttaatctggactagactaagaaacttctatgccgtgagactggatcccctctctttcctgcaagccagtgctatttgtgttctactggggaaatactcagactgaccaattcctgtcatagtgtttggtttcgtttattcatgctttcctaaaatagtaagaaaggttaaaaaagacctgggttttttttttttttttttggttgtctgtttttgtttttttccttctcacttaaaaagtaaacttcatgattgggaaaaaaaaaaaaaaaagtcactttcatttaaagtcctttctctgtctctaggcccagcctgttccagatgaaattgtgaaaaagatccttggaaacaaagcaacttttagcccaattgtcactgtggaaccaagaagacggaaattccataaaccaatcacaatgaccattccggtgcccccgccctcaggagaaggtgtatccaatggatacaaaggggacactacacccaatctgcgtcttctctgtagcattacaggtttggttaagtcactgctgtacttcctattgattcacaaagattgtgtacaaagatatatttgtgtacaaagatataaaacctttgaaatatccatgccaacattataagagaaaataaaagaacaaaacattttacttgtccatcacctcatctctggtttcccaaggatcatttcttgggaagatcctggtcaagatcctggtctcatgactcatttaaaatttagtgatagcatctttcctgctattaaggttagcattagtagaagtatcattgaatctactggagcatctaggtaatttctagattcaatctaggtaatttcttggtgacctagacagaggtaatggacttagcaacatactttaaactacaaggaaattgggtggactttgggaaaaatacatgtcccacagagcactagtaataggaaattgttcagtacatggttattctcacctactgtactcgccagtgtaatccgagagtttaaacattcagggctcagaagaacacattttgtgataagcacctggaatctagagctcaattcatcctttgattatcctagtccgatttttaactgcaattccaagattattaaagatagattttgtttttgatcttcttttgttctctgaggagtaattttaatggctgatgcccctttttaccctcggtaattaattgtacagaatgccatgtacagaatgagctgtttcttaactttggtagttcttacctttttaaagagtaagaggctgggcgcggtggctcacgcctgtaatcccagcactttgggaagccaaggcggtggatcacctgaggtcaggagttcgagaccagcctggccaacatgatgaaaccccgtctctactaaaaatacaaaacttagctgggcgtggtcgcaggcacctgtaatcccagctactggggaggctgaggcaggagaatcgcttgaacccaggaggcggaggttgcagtgagccgagatcgcaccattgcactccagtcttggcaacaagagcgagactccgtctcaaaaaaaaaaaaaaaaaaaaaagagtaagagacttaattatccatctgaaacaaccaatctttgcacttacaaattgcatttataaaatatacttataaattgtggctgccccaagtttaagccattcattagtacccagacaaaaaacaaggaatttttttttaatttaatatcatcttacaaggaaatcacaataagcctggtaaaagtataaaaggagagtagagaggaaaactacctttagtacacactattaaactgaaggtgttgaagttttgccagtttgtggctatgcagaaagaagaacaggatctgatgaaaattttacaaggagcatctcccatgataaagtcaacatatctgctgttgttctctcagggggcacttcgcctgctcagtgggaagacatcacaggaacaactcctttgacgtttataaaagattgtgtctcctttacaaccaatgtttcagccaggtatggaaataaaggattccaaaaagcagtaaggaattagtttttattaccttttggaaagtaaaaattgttgtgttcaatactaaaaaaaattgttgtgagaaaaaaaatccgtagtatttgcttatcaaaattatcctcaaataacaaacagagggtttctgtgtttgatacatcgaaaaagcatctttgctgtttaaatgaacaagttaataacgttttgggttagttcctttacatattctgatttttttaattgtgagtctttttaagatttggcttttaaatagccacattttcatacttctgttttttgttttgctcagattttggcttgcagactgccatcaagttttagaaactgtggggttagccacgcaactgtacagagaattgatatgtgttccatatatggccaagtttgttgtttttgccaaaatgaatgatcccgtagaatcttccttgcgatgtttctgcatgacagatgacaaagtggacaaaactttagagcaacaagagaattttgaggaagtcgcaagaagcaaagatattgaggtaccttgttcacaaaaacaagttcatttcattacgtactccagatatgaggttttattttgtggtcttaatagcactcactataaaataccaagtgcattattgattttacttttactttaaaaaatttgatatagattaatactcaaatttttttatcttttttaatttaatttaatttaatttttttttttttgagacggagccttgctctgttgccgaggctggagtgcagtggcgcggtctcagcttactgcaacctccgcctcctgggttcaaacaattctcctgcctcagcctcccaagtagctcggattacaggcgcctgccaccatgcccagctaattttctgtattttcagtagagatggggtttcaccatgttagccaggctggtctcaaactcctgacctcgtgatccacccaccttggcctcccaaagcgctggcattacatgagtcaccacgcccggccaatactcaaattattttaagtgtctctggggctgtcttagctggttaaaacatagcactaatgaatttaagttatggtctccattttcctgtggccacttgagttacctacttttcagaatcactgtttatacacattactatgattttcctttttcaaacccagtgagcatgtaagtatctaacagtgcaaaaaaaaaaaaaaagctttcaaaatctatacgaataagtgattgatgtcaggcacattcttaaatatttttaaagttgccagaataaaaataaatgtgtaattctgttctgtatatgtccatgatatggattccaattacagttggtgagttgtaagcacacaacattatttttgttgcaaatagcaccacagaagtaactgcctaatagagacacgtgtaacatagtaacgtcagtcttttaacgttacgtgacataaaatctcaaaatattttaaactcagattaacattaaattgtttatttcttttactctaaaaggttctggaaggaaaacctatttatgttgattgttatggaaatttggccccacttaccaaaggaggacagcaacttgtttttaacttttattctttcaaagaaaatagactgccattttccatcaaggtaaatcatctttaacagagaatctgtgaattatggggaaaaaatactcttagagaataaaaataaaaggttttaatgatttatttaatttgaaataccccgtcaaatctgaactcataaggtcagattttgttctggttctaccagagtatactttcaagccagtaaagctttacaattggtaaaaaggatcattatttttcaaagagtttaataacatttatgtttaagcaaacatttgtaaaaccaaacaatttagagtaatacaatgtgttatttctggttaatgttcagtaatcaaataatggatgaaatgcaaatacagtattcaagtttcattttcatttctggtggagcccagggacgttctagagggatcaccttctctctccaagaacagaaggagagaggaaaattgttttgtcattattatttgctgttactgttgcaaaagctggagctttcagaaaaaaaaactgttagaaggaaaatgcacataactcagactgtactatgaattgtcaggattagatcatcagacacaacaatcctgcgtttaggaatcgggcatctaactcttgctgagttcagatgtgaccaccccggttgctgcataatcgtaatcatcatcttttccctttacctttcctgcctctcatagggcttgataaaacaaccatgcttaactcttatacagttaaaaatcctcagataagtctcattctataaccatcaactaccaaaattcttctagattagagacaccagccaagagccctgtggtcgtctgtcttttctgaaagaaccaaagacaacaaaaggactgcctcaaacagcggtttgcaacttaaatatcactctgccagcacataaaaaggtatcttttaatactgctttaaattgtctttccctggtcttgaagaagtgggcctttggtatgcaattaaggaatgctttgtaacatgaataaagctcttgaaactgaagttgtattagtctcctcgtgtagattgcctaagtcttgttaatgtggtgtcaaattcttatagtttgtatgatggagtcttctctgtttatcgcttttgcttctgctggtagcgcatagatttttatgcttttaaataacgtcatatgttaatttgccatggatgtacagttcttgatattttttgttggctttttttaaaatttgctttgctttctaaatcagcttgcatttgtgctccctactcagtccttttcatatcctgatattcttttccctgctgtccattataatattccttgtctctgcaatgcatcttggaaccaaaaggagacagagtcagatcaagatgatgaggtaatataaacacttctgcttttattctatcagaagtagaatagaaattgaatctgtatgacagaagttgcagagggctaaagtgtgggaaacatataaattatatttttcaggtcttaagtaggtaaaagggtatatatttttcttaaatggttcactcttcttccacacgtacttaagagtacttaaatatattcaacgaaattataattcagctgatgattcagaaactgaaggtctttaaacatttttaaatatggtagattggcatgtataaataaacgttaaaaatttttttagacaagtcaagtgcaatagtgagaaagggggaaaagagtaggaccaggaagttctatctatgactgacgagaacagtcaactgagataacgcactaccttcgaacccgccaaatagacattttgtgaaagtttcatgtgcctattttactatcaactatatcctactatccagcatgttataacatttaaatcaagatcacgtttaatatgtgcaattttattgtacaaataaacttatgttgtatgtgatacaaaatatttgcttactagctattgataaatctttgatactctcactaaagaaatttatcttgaccatttttttaagaatatagttcaattaagttgtctcctaatgtttctctaagttatatgataattaggtttttgaatcccacacatcaatagtaataaatagaatcaagtagccttaggatgcagtaatagtacctctggccaggcgtggtggctcacgcctgtaatcctagcactttgggaggccgaggcggggatggggtgggggaatcacctgaggtcaggagttcgacaccagcctagccaacatggcaaaaccctgtctctactaaaaatacaaaaattagctggacgtggtgctgcatgcctgtaatcccatctactcaggaggctgaggcagaattgcttgatcccaggaggcagaggttgcagtgaggcgggatctcaccactgtactccagcctgggctacaagagcaagactccgtccctaccctcctctgcccgccccaccaaaaaaaaagtacttctaacaaaaccattcatctgttttcaatctcctcatctacactttatgcctgttaacatacagaatccccagcagtaattggaataataaactttgtgtgcctttctcccttgaatgtactcacatagagtgagtgtactttgtgatatatgtgctttcaatatgaacagttccaggaaaatttaatgctcagcatcagaagtctctgtaatgcttgtcttttacttgtacttccctgtagtctgctgtgttggtgctcttaaatttgccaaatgatgattttggttaagacatggggggtggggttacaaaatcccagtgggaaattaacatttcctaagaaggaaaataaacaagttatcaacatgccatcctacaaaatgtcttaaaactgaagatgtcacagggaagttggaaatagagttgtctttttttttttccttttcagattgagaaaacagatagacgacagagcttcgcatccttagctttacgtaagcgctacagctacttgactgagcctggaatgagtgagtttcctaacacatttactaatctacgtggattttcataagaagagacattttttctatacaaaccaaattttatcatttggaaactcaatggcaaaagaaaaattgcctgcaggaaaaccctgtcatacaacctaagtaatattttgtgcctagttgaagatgtgaggtaaaaacgcccctagctcatacttcaaaacagtttttaaagccattaactatttttaaattagaaacatgtattacttttcttttaaaaccttgatttttactttgattaactatgctaggagataaatatgaatgttgctttagatctatgctcagatgaaaaaaattactcaaatatttggaatggtagaaaaatgataaagttactttgtcatctcatttttctcagtatagataggttgtcatatcctagtcccgattctttttcttcccactttgcaagaatcacgtttccttaccttcttgaggtagcacttgtttacagagttcttctttcctccctccctccctctcacttcctctcctcctgtcctttattaaaatatcagttctaaggctggtcttcactagaccagttagacccttttcttttctcaatgatcgttttggttcattgttagctggcatgcacttattaagatacagattcattcagtcctatctgtttatatattctccctctctctctctctttctgtctgcctcctcctccctttccttccatcatccttgtaatcatcacctctggtgatctctacagccctcaagataaccccctccaccagcaggaactaagggtattgagctcagcattgtatttgactgacatattggtgccactttaaccattctcctcattttaaatgaggggaaattatacaaaaattattttttaattagtgaatcattcctagctgtttcccactgacacagtttcttaagttcaaggaggtctggaaatttgccagtaagagtcacatctttggcttttcccaccttttctgaagtcttgtttttatgggccaacagcatagcatataagatctgcggcaggacactactgcaccacttagttgagatggtcttagcgtcatcttctggagcctagctccttgactattagagaagtttcaatatttaaatacaaaatggagaatataagagaaatgaaagaaacctaccacattcaagaatgtttcctcagatctctgttctcctctagcagaaatgtcgaaatcctcccagaaacataagggctgaaattaactcatattatgctacagagcagaagaggggtgtgtgtgtgtgtgtgtgtgtgtgtgtgtgtgtgtgtgtgtgtgtgtgtgtagctaggtagctaggtggtttccagtagaattaaatacactggggaagttttctttggaatactattttgccctagagatcctcagtgggtagttggttgagaccctgtaggcaacatcgttaagctttggacaggctcaatggaccagccgctttaggtcggaggccccttcaggcaggtgagtttccatctgattctggttgctaaggcaaagtcaattgaatgtttcccacttataatagtgttactggttagatccagctaaggtgtatgcagcttgtgttcctggacttttggtagaagaggagcgaagttttctgttttatgaaagggtacataagggtggtaaacaagggaatgaataggaataggaagtgactaaaagaaaagtaagtctcaaaactggtgttatgggaactccaagtgaatgccacttttccttcaccacgctgcctttccaaccccttccccccaggaaaaagattctggattagttcggtgcctgacatccagaaattccctcttataaagggatcccaaaatatatgtcattaaagcataaaatgtgtaactgattggtaggttggttgttccttgcgaagtataaaaccatagacgtggttcaaaagatttctttgcctgatagagccagccttcagtggtaaaggatagatgctttgtcagtgtctgatagttacaaaaataaatgcttgtgagacacagactaagctcaaatcattgaatttgaaggaatctgcaaaccttccatttgcagcgtggcatttccaaaagagttcagcaatataatattgagaattatggcaagaaggggtaatgaataggcgagtttttccttagttcttccactttctttagaataatatgtaagcctaggaaaggatatgtttggaatgtttgaatttaaatgtacactagaaatgaccatcttcacccttgtgagagtagctgctaatccaaagactggactgtagcaatggcacgggcacagcatgaagaagaacataaaagctgaagcagattctcattttctctttgagtttcactattctgaaccagggctttcttggagcaaaactgtattcacctttgatgtagaacattagccgttggcaggccttgcaaatctctgaccagtttggtttgtttgagttgtagaagcagagaggaccaagtatgtgtttgtgctccccagcaagtgtgcttacttcatttgtgtgtttcttgctccattgccagaagaaatgctggtattactatatccattcttcctagtggtaggtctccctcgtgactgcttcagtgtttgtgatatccataagtcccatgaatattatgggaaggcaccagaattggtacctttgaaattgataaacatatatacacacaccccacatatcctactgtaggtacttaaatatggggtgttaaaaatatgaatgtagtttttagatgtcccccatgatagcttttgaaaattaaatgtagattaggttatgaaaaaatatctgagataaactatatgcttttatccatattgaagagttgcagacatggacgtatgtagttgcaggtcattttataacttgcagtagaaaatattttcctaaaatctcaaaaggtaccaagacttcatatctcatggaaaaagtgtactcttctttctaaatgcccttgtgaaagtatctttaaagtttatatattgtgcataatatggcatacgaattgtattacttcattggcttgtttgccatgatatattgtgcatgataaaatgttttcagttgctttgcttgcttatggtaaccatgaaccatattttctgtttttttctttgtgtgtgtatatgtacacatgcattttaaagtcatttcatattatgttttcttttcctctcatcaaaaggaatatactgcatggaaaagataaatgcaaacattccttttctttgttttttttgtttaaaattctgactcagaaaacttcttgctcttattggctttttatgggtgtaaagcataaccgaactgtgcatgggagatacagatttaaaatccagtggcttcacagtttgcacatcagttgcctgtcacttaaaagttattttggattctgcatgaaataggcttgagtggttttggaaaaaagttttagatatttaatgtatagctacatatattgaaatggttctaagtaggtgcaatctgtatcatggaaaggctaaaggagagagaggacattagaaattactaaaatgaaagttgtatggttgcacgaaacaaacatgtacctatacaggcaaaatagaatggctactgatatttcaaaaccaacacataagaaagtcaataggaagtagggaacagttttccattatggttatttttctcatcattaattctttcctcatgttttctatttttcattgtttgcctctttggttgcaatgtgctttttctttcatttcacattactctgttttttatttagttgtttttttttaacttcagattagttatgtctgtagaaatttgtttttcctcttaattgttccttttgcctcttccattctaaatcatgcaaacaattgtacttgcttttgtaatatttcaaagtttactgaccaatttttttctctggtctctctgtttctcaaccatttttgttgatttttgtgtttgatttcattttaaaatttaagaaacagttgaacggagtacaggagcaacaagatccctccccaccacttactcatacaagccattcttttctacaagaccataccagtcctggacaacagctccgattacagtgcctgggccagccaagtcaggcttcacttccttatcaagttcttcctctaatacgccatcagcttctccgttaaaatcaatatggtctgtttcgacaccttctccaatcaaatccacattaggcgcgtcaactacatcttcagttaaatccattagtgacgtggcatctccaattagatcctttcggacaatgtcttcgccgataaaaactgtggtgtcacaatctccatacaatatccaagtttcctctggtaccctggctagagctccagcagtcacggaagctacgcccttaaaagggctggcatccaattctacgttttcctctcgaacctctccagtgactacagcagggtctcttttggagaggtcatcaattactatgacaccccctgcctcccccaaatcaaacattaatatgtattcctcaagtttgccatttaagtcaattattacatcagcagcaccgctaatatcttcacctttaaagtcagtggtgtctccagttaaatcagcagttgatgtcatttcatcagccaaaattacaatggcatcttctctctcatcacctgtgaagcagatgcctggacatgcagaggtagcattagtcaatggatctatttcccctctaaaatatccatcatcctcaactttaattaatggatgcaaagccactgccacgttacaggaaaaaatttcttctgctacaaactctgtgagctctgtggtcagtgcagccactgacacagttgagaaagtgttttctaccacgactgcaatgccattttccccactcaggtcatatgtttctgcagcaccatcagcttttcagtctctaagaactccttccgcaagtgcactctatacatcccttgggtcgtcaatatctgcaactacctcatctgtaacttcatcaattataacagtgccagtatactctgtagtcaatgttttgccagaaccagcattaaagaaacttccagactctaattcatttacaaaatcagcagcagccttgctgtcacccattaaaacattgactacggagacacatcctcagcctcacttcagtcgaacttcatctccagttaagtcatctttgttccttgcaccctctgcccttaagttgtctacaccatcttctttatcttccagtcaggagatactaaaagatgtagctgaaatgaaagaggacctaatgcggatgaccgcaatactacagacagatgtgcctgaggagaagccattccaacctgaactcccaaaggaagggagaatagatgatgaagaacctttcaaaattgtagagaaagtaaaggaagacttagtgaaagttagtgaaatccttaaaaaggatgtatgtgtagataataaaggatcacccaaatcaccaaagagtgacaaaggacactctcctgaagatgactggatagaatttagttcggaagaaatccgggaagccagacaacaagctgctgcgagccagtctccatctctgccagagagagtgcaagtaaaagcaaaagccgcctccgaaaaggattataacttgaccaaagttattgattacctaacaaatgatattgggagtagttcactgacaaacttaaaatacaagtttgaggatgcaaagaaggatggtgaggagagacagaaaagagttttaaaaccagcaattgctttgcaggaacacaaactcaaaatgcctccagcctccatgaggacttccacctctgagaaagaattgtgtaaaatggctgattccttttttggaacagatactattttagagtctcctgatgacttttctcaacacgaccaagataaaagtcccttgtctgacagtggctttgaaacaagaagtgaaaagacaccttcagccccacaaagcgctgaaagcactggtcctaaaccactttttcatgaagttcccatccctcctgtcattacagaaacaagaactgaagtggttcatgttatcaggagctatgatccctcagctggggatgttccccagacccaaccagaggagcctgtgtcacctaaaccttcacctacttttatggaattggaaccaaagcccaccacctctagtattaaagaaaaggttaaagcatttcaaatgaaagccagtagtgaagaagatgaccacaatcgggttttaagcaaaggcatgcgtgttaaagaagagactcacataaccacaaccaccagaatggtttatcattctccaccaggcggtgaaggtgcatctgaaagaattgaagaaaccatgtcagtccatgacatcatgaaggcctttcagtccgggcgggatccttccaaagaactggcaggtctgtttgaacataagtcggcagtgtctccagatgttcacaagtctgctgctgaaacctcagcccagcatgcagagaaggacaaccaaatgaaacccaaactggagcgtataatagaagtccacatcgaaaaaggtaaccaagctgagcccactgaagtcattattagagaaaccaaaaagcatccagaaaaagaaatgtatgtatatcagaaagacttatcccggggagatattaacctaaaagattttctgccagaaaaacacgatgcttttccttgttcagaggaacagggtcagcaagaagaagaagaacttactgctgaagagtcattgccttcttatctggagtcttccagagtaaacactcctgtgtcccaagaagaagatagccgccctagttctgctcaactcatatctgatgactcttataaaacattgaagcttttgagtcaacactcaatagaataccatgacgatgagttgtcagaactaagaggggagtcttacaggtttgctgagaaaatgcttctgtcagaaaagctagatgtgtctcattctgatactgaggaatcggttacagaccatgcaggaccccctagctcagagttacaggggtctgataagcggtccagagaaaaaatagccactgcccccaaaaaagaaattctctccaaaatctataaagatgtttctgaaaatggtgtaggtaaagtgtctaaagatgagcattttgataaagtgacagtgttgcactattctggcaatgttagtagtccaaaacatgccatgtggatgcgctttactgaggacagattagacagaggtagagagaagttgatatatgaagatagggtggacaggactgtgaaggaggctgaagaaaaactgactgaagtgtcacagttttttcgtgacaaaactgaaaagctaaatgatgaactgcagtccccagagaaaaaggcacgccctaaaaatggcaaagaatattcttctcaaagccctaccagtagcagccctgagaaagtgctactgacagaactgctggcatccaatgatgagtgggttaaggcaagacagcatggccctgatggacaaggcttccccaaggccgaggagaaggcacccagtctgcccagcagcccagagaagatggttctctcccaacagactgaggacagcaagtccacagtggaagccaaaggaagtatttcacagagcaaagcaccagatgggccccagtctggattccagctcaaacaatctaaactcagttccattagattaaaatttgaacaaggcacacacgcaaaaagtaaggacatgtctcaagaagacagaaagtcagatggccagtccagaatcccagttaaaaaaatacaggagagcaagctacccgtctaccaagtttttgctagagaaaaacagcagaaggccatagacctcccagatgaaagtgtatctgtgcaaaaagattttatggtattaaaaaccaaagatgagcatgcccaaagcaacgaaattgttgtaaatgattctggctctgataatgtgaaaaaacagagaactgaaatgtcaagtaaagcaatgcctgactctttttctgagcagcaggctaaagacttggcatgtcatataacctcagatttagcaactaggggaccatgggacaaaaaggtctttagaacatgggagagttcgggagccactaacaataagtctcagaaagaaaaactttcgcatgtacttgttcatgatgtaagagagaatcacattggtcaccctgagagtaaaagtgttgatcaaaagaatgaatttatgtctgtgactgagagagaacgcaaattgttaacaaacggctctctctcagaaattaaagaaatgactgtaaaatctccctccaaaaaagtcttatatagggaatatgttgtgaaagaaggggaccatccaggcggattgcttgatcagccttccaggaggagcgagagctcagcagtgtcacacattcccgtcagagttgctgatgagaggagaatgctgtcttctaatattcccgatggtttttgtgaacagtcggcatttccaaaacatgaactatcacaaaaattgtcccagtcaagcatgagtaaagagacagttgagacacagcactttaattctatagaagatgaaaaagttacctattcagaaatcagcaaagtttccaaacaccagagttatgtaggtttatgcccacctctcgaggaaaccgaaacctcccccaccaaatctcctgattctttagagtttagcccaggaaaggaatctccctctagtgatgtattcgaccacagtcccattgatggattggaaaaactcgcaccactagcccagacagagggagggaaagagataaaaactttacccgtttatgtcagttttgtacaagtggggaagcaatatgaaaaggagatacaacaaggaggtgtaaaaaaaatcataagtcaggaatgtaagacagtacaagaaaccagggggaccttttatacaactagacagcaaaagcaacctccttctccccaaggtagtccagaagatgatactctagagcaagtatcctttctagacagctctgggaaaagccctttaaccccagaaacacccagttcagaggaagtgagttatgaatttacatctaagacacctgactcgctcatagcttatataccaggcaaacccagcccaattcccgaggtttctgaggagtcagaggaggaggaacaggccaagtcaacctcccttaagcagactacagtggaggaaacagcagttgagcgtgaaatgcctaatgacgtgagcaaagactctaaccaaagacccaaaaataacagagttgcctatattgaatttccccctcctccaccactggatgcggaccagattgagtcagataagaagcatcattatctcccagaaaaagaggttgacatgattgaagtcaatctgcaagatgagcatgacaagtaccagctggctgaacctgtcattagagtgcagccaccttcaccagttcctcccggggcagacgtcagtgattcaagcgatgacgaatctatttatcagccagtcccagttaaaaaatataccttcaaattaaaggaagtggacgatgaacaaaaagaaaaacccaaagcttctgctgaaaaggcttccaaccagaaagaactggaaagtaatggatctggaaaagataatgaatttggccttggccttgattcacctcagaatgaaattgcccagaatgggaacaacgaccagtccatcacagagtgttccattgccaccacagcagagttttctcatgacacggatgccacagagatcgactctctggatggctatgacctgcaagatgaagatgatggcttgacagagagtgattctaaactcccaattcaagccatggaaattaagaaagatatctggaacacagagggcattctgaagccagctgaccgctcttttagccaaagtaaacttgaagttatcgaggaggagggaaaggtgggaccagatgaggacaagccaccttctaaaagttcttcatctgaaaagactcctgataagactgatcagaagtcaggggcccagttcttcacactggaaggcagacatcctgacagatcagtgtttcctgatacttacttcagttacaaagtagatgaagaatttgccactccttttaaaacagtagctaccaaaggtctagattttgacccttggtctaataaccgaggggatgatgaagtttttgacagtaaatcacgggaagatgaaactaagccatttgggctggcggtagaagaccgctctccagcaacaacccctgatacaacgccagccagaacgccaactgatgaaagtaccccaactagtgagcctaaccccttcccatttcatgaaggaaaaatgtttgagatgactcgcagtggtgcaattgacatgagcaagagggattttgttgaagagaggctccaatttttccagattggtgagcatacttctgaagggaagtcaggggaccagggggaaggggataaaagtatggtcactgccacaccacagccacagtcaggggacaccactgtagaaaccaatctagagagaaatgtagagacacctacagtggaacctaaccccagcatcccgaccagcggagagtgtcaggaaggcacatccagtagtggctccctggagaaatcagcagcagccactaacacctctaaagttgaccccaagttgcgcacgcctataaaaatgggaatttctgcatccaccatgaccatgaagaaagaaggccctggagaaataacagataagatagaagcggtgatgaccagttgtcagggattagaaaatgaaactataacaatgatttcaaatacagccaatagccagatgggcgttaggccccatgaaaaacatgattttcaaaaagataactttaataacaacaacaatttggattcttccactatacagacagataacattatgagtaatatagttctgacagaacattctgcacccacttgtaccacagagaaagataacccagtgaaagtctcatcaggaaaaaagacaggggtactacaaggacactgtgtaagagataagcagaaagttcttggagaacagcaaaaaacaaaggaattgatagggattaggcaaaaatccaaacttcccataaaggccacttcaccaaaagataccttcccaccgaaccatatgtcaaacactaaagcaagtaaaatgaagcaggttagtcaatccgagaaaaccaaagcccttactacttcttcatgtgtagatgtaaagtccagaattccagtgaaaaacacacacagggataacataattgcagttagaaaagcatgtgccacacaaaagcaagggcagccagagaaaggcaaggccaaacagcttccatccaagttgccagtaaaggtaagatccacctgtgtcactaccaccaccaccactgccaccaccaccaccactaccaccactaccaccaccaccagctgcacagttaaagttaggaaaagtcagctcaaggaagtatgtaaacattccattgaatattttaagggaattagtggtgagaccttaaagcttgtggaccgcctctctgaagaagaaaaaaagatgcagtccgagttgtccgatgaggaagaaagtacctcaagaaacacgtcgttgtccgagacttcccggggtggccagccttcggttacaacgaagtctgctagagataagaaaacagaggcagcacctttaaaatcaaagagtgaaaaggccggcagtgagaaaaggagcagtagaaggactggtgagaatgaaggcagtcaggtctctcgagcactctgctcacatcctggagaacgagcatagtttgtaaacactttccaactcgtagaccctagtgcatgaactgttgtgattgcctgtggagtgacttaaccgtagtttctcattatgtcattgtcatctgtatgtgctgtcgtatatactcttctttctgccttttgatcaaactacacggtagacagctagggaagcatgctgaagatattggtgtcattcaagatgaacaaccttcttttttcttttttaatgtgctaatggatatgattctgtcaaagtaaaagcacagatgttgaaatcccatcatggtgttttcaccaacacgacacttctgtaactgtttaaactagctagctcgtcagcatgttcaatcccattacattgagcatccatgtagtctgacatttggcctgatgcaggtgaaaaacaagtgagccatgtgcaaagaagtgttcatgtaggtgactaggacacatttcagtgtacagtgttagcattagtctctctgtaaaatctgcgtactgctaaaagcaattttccagtatcgtatctttcttgatgattattttaattaagaaattgtaaatcgtaggtccacagagtccatgtgaacggacagatatcaggatggcaatagtagccgatcacctgggacttagttggacaggtaagtgcatacactcctgaatggaacaaattagtttcttcatttctttgtcttactcacaagcagttcaatatatatattttaaaaatagaaacaagcagctagtaaaaaacatttttatcaccaataattttatctacccagagataaatactgattgtaccttgtatactgtgtttttccaaagccttttctatgcatatgcactaagaaatagaaatttaaatttattttaccttaaatttaagcattttcttcacaatgtcacttctgtaatataggttaaccttctactgaatagcaaatttatcttgtagcacaaaagaaaacacagctaaggcctatgacttaattaatcaaaattctttcacatggtttatgtccttagggcagttttctaggcaacagttcaattaacccacgcctaggctgcacaaattttagtcattcactgtgaacttctcttcacattttgtacgatatacacataaaactctatgtttatttatctgatactcttctttaagtaaactcacttttctgcccaaatatttatttaaaagaaaaatcttatatcacttcgataatgggaaaggattatttgcattatctatgtaaacaagaaaacaatgacagtaagtttaaattttgaattaaaaatttttaaatgtgatttttaaaatatgataaacatgtaaataaatatatttaattcacaaaagttgaattctataaaattcatgcctgtaatcccagtactgtggggaggccaaggcaggtagatcacttaatgtcaggactagcctacccaacatggtgaaaccctgtctctactaaaaatacaaaaattagccaggtgtggtggtgcatgcctgtcgtcctggctacttgggaggctgagacaggagaatcgcttgaacccgggaggcagaggctgcagtgagctgagattgcaccactgcactccagtctgggtaatagcgtgagactccatctcaataaaacaaaataaaataaaagatgatgagatttcatatcaattggacaaattggacaattctgcattgtaattttgagcttaacaggacccttaaaatcctacctcacatgaatctgagaaattttaagttttataggttaagtgtattttttaatgcatggccaaataataaatattcattatcatcacatctaaattcatcctgcataccattagcaacatacattccatacagttatctctatttaatgggagaatatgaaactagataataggaagcagtttcatctaattttttttttcctttgaatgccctcagtccccgtccacccccaccaccactaccccatttcaaaccctcctctcttcatcaacctagtctctgctctcaggtatactgctaatggttgggagctgagtggagttctgaaaagatagataggtggtctgaataatgttttgtaggcagttgagagttaacagtaatttattatgtatacatatttactaatatcaactttatattttaacattggacattgtaatctgaaaatatactggagcaaatgtttgttttgcattattatatgcctagaactgttagattattttccttaagcaaatacagtcagagtaaatttttggagatgtggcttaatagccagacgaaaagccataaacctaaaattcctagtgtcagtgtctttgctctttattaagtctctagacaatggatacagttttgtcatgaaggcttattgggcagtaggagtattgtctcttaagacacagagatgaagaacttaaaataattaacttctctaactagaattactgtatgctcaatgataattattaagaatattaagcatttaagagaacaaaatttatatctgtccctcgaaaccactattaacatcttatgtgctttttttaaaacaagaacgttttataatgttatacatacaatgtaatctgcttatttgtaactgtgtcattctacaaaattaaatattttctgatcttggttttaatgcataaaaaaatatccaatagatgtaccttatgatggtggttttctaactgtggttcacaatgcttcaatgagatgtgaaatcagttcatactttgtttttgtttttaaatggaatattatataaaagaaaatgactgtgtttaagtgtattaaggctaaattctgttccggggagatctgattttatttatgtaaacaccatgatatataatgtatttctaactgtaggccatgatcacaacagttgtttgcaagccactgccttaaattaactcttatccttttgttcaacatgcagattgttttcaatgaacattcatgtatataaatcattgtatataactcatatattgtcagggtaaatttctaaatgtgaatcacttggtcaaaagataatggacttttttgagcctctgaatgcattttgcaaaattgctggaagtattttgtaagggggatagagtcttgaccaattccttttccatgggatcatttttgcccatttcttactttttgttatcatttaaggtaatacacacttgataaattgttttaatataaaaaaatacagtgggaactaagtctccttcccttctctgactcctaagtttccctcttccaaggcagccactaatagtgagatcatatgtatctttccaaagacactctgcaatttacaagattgaatatgagtatatctgagtgtatacgagtagatggacagaaagctgtctcccttttattttttactcaagtagcttcatatcatataagatgatctggcctggagtcatcatataacctcctgtgtggagtttatgaaacttgaaggcatagagggtggcatattatgtgagtaaaagataccttcatgaagattgcttagcacaaaccctatcagcatctcttgtgccatatacatgaattgtatacctctacgtatcttgtaatttgctcaaattatagagaatttggctgaattaaaacaatcatccaacatcctctttgcaaactccaaaaatcttgttttattttttgagatagggtctcgctctattgcccaggctgaagtgcagtggcacaatctcagctcactgcaccccctgcctcctgggctcaagtgatccaactcagcctcctgagtagctgggaccacaggcatgtgccaccacacctggataatttttgtgttgttgttgttgttgttgttgttgttgttgttgttgctgtgtgtatggagaccggggttttgccatgttgcccaggctggtctcaaatcctgggtgcaagcaatccacctgcctcagcctcctgaagtgctgggattataggtatgggccactgtgcccagcctaagtctaaaaatctttataagatggtctctaaaaaaaatctgattgtaagtcattacctaaggagagttaagtcacagcctgtgtatggtcactactttgctatgaagccaagtatataaaaattaattcctgaggctgtacttgagcttgactataaaattcccttttctttttgtggcaattgagcattacttttatgaaacgtgtgataaaagtagaatatgcaatcttagtaactctctttcttttctacagaactggcaagggaactgaatttttcagtggatgaaatcaatcaaatacgtgtggaaaatccaaattctttaatttctcagagcttcatgttattaaaaaaatgggttaccagagacggaaaaaatgccacaagtatgccgaaattatattattttaactttcaaaactgcataaatgtaatattttagataagccaactgttaggttcatccaagtagtgttgtaattttctgtaatctttaatatagaaaactaagtgatcatgaggtaatagcaagtcttttgaagttatacttgtttaatttagtgttaacagtctaaacttctattcttcagaagctttttggaaagcaagtagcagggaatttttcgcatctggcctgacattctctctgtgaccataaaaactgaaaacataattttagttgttaaatcatgggacacagtcatcagaaacactccgaagttaccactatggctggaggtggatgtgcagagagggaagacaggatcatattaggggagcaaatagttttattcagcttggttggctctactgttgttgggtttggttttgttggctggtgggattgggtggtagtcctatattttggcaagtgccaacccacaacaatgtggaataaattattatgggtttgcctgtgtcaacttgaccctagaaagtcattaaaatgctaagtaccaaatatgagggtgacctattttgacattctaagaggaaaggaaactttagttttattagatccccttatagccaacaggaatctagttattttaaggcccatccgcactgttccagtggaacacagctttacaaagtgatgattaagactctgacaccttccctgtagcagcgagcattctgagtcctctggatagggagattgcagagatggagtaagaaggagctaaaatgtcagcagggctgcaaaagccatgcctttgtgtagatattgtgctgactgaaagaacataatttaattgggttttcaacctttttttctccttttcagctgatgccttaacttcggtcttgacaaaaattaatcgaatagatatagtgacactgctagaaggaccaatatttgattatggaaatatttcaggcaccagaagttttgcagatgagaacaatgttttccatgaccctgttgatggtaatcgaatttagtgttcatatttatttaatcatttgataaaatttgaaagtgcagtcagacaaggcagtcacttaaaagcaactaaactgtgatttgcttgacttagtttctcattttctctgccagagtctgcaaataaacactctgatatcagagcaaacttggtaaatacctctgtttatatacaatataaatatacaatataaatcatgacgtatgaacgcctaaggtatctgaaagagttggtatttctaatatttcataaaagttaaatatctagagaatgcattgcttttgtcacttttaatttttatattaaccctcctaaactagttacctcttttattcgtatataggtaaaacaaacgatgagccatttttatcaaataagcaaggtattgagtaaagtgtaagcatatagtatacaaattgtaaggtaaaatggcaatttactgtgtggcaccaggtatttaaatgtgcactgaaaaaatttaatgtatcattcaagtatgtgctttagttatttagcgttcgttgttattttaacttcatgaatatgctgccatttattctttggaaaaactgcttgatctattgtatatcaaaggcagcataatttctaattcagtcggcatacatgttactaacaacaattcctctttcacattagcttaatttatataatgatcttgtcattttttcctcattatgtaaattgtgctttcttcactgaaatattaagaaaaacataataaatatcttcctatgtttttcaaaatagtcctgtcttaggctcacaaatgaaaatttattcctacaatgaatttttgttctgtttttgagacgaagtctcgctctgtcgcctaagctggagtgcaatggcacgatctcggctcactgcaacctctgcctcctgggttcaagccattctcctgtctcagcctcctgagtagctgggattacaggcatgcaccaccgtgcccagcaaattttttgtatttttagtaaagatgggggtttcaccacgttggccaggctggtctcgaactcttgacctcaagtgatccacccacctctgcctcccaaagtgctggaattacaggcatgagccaccccacccagcctctataatgaattttgagtagaaaatttgatgatggtgtggaggcaggaataagaactaaggatatttttctagtattccatttttaaactggcaaagttagattaacaagagtcacaaacttctaattaacttctaattctgcatatattttgtggaaaaaatcttaaaattcttagaaagttcctgcttattaaaaagtttaagtctggccaagcactgtctgtctcttaaaaaaaaaaaaagtttaagtcaacaaaagatttaaagcatacttgttatacatgtaacaaacacaatgggtaatgaagtaaaaagcggttctttttaagtttataaagaccatagaaccttggaaaaacgctccctttgaggccttgtcttatatgcaaggccatatattagtaaccacatgctttttgcactagataaatatagatcatcttatcaaattttaaattattgataagttatagtttatacattcttctaatattctttattggaaaaaatagttgttaagtaactctaataaaaaagatcaccagaacacaacagaagtagttgtgttgaaagcttcatttaatttgaacattttaaaattggaatatccttaaaatacagtcaaaaatgaaatggctttttgttgctgtatcttaatatttttaaattcctttttcaaaatttcttagggaaatttagaaacatgtatatgaagtaatttcacttaggcagattataaacctcagctaatcttagccagcttttcaacaagagtctggtttatagatgaccataactgaaaaatgttcacttacctatagcaatttgagtttacaacagcagctaagttggtatttacctgggactgatggaaaaattagacttttattttgtagaccaacaattcagaaactgtggtttgttgcttttttcctgtctctcctcttcgttgaacttttatgaaacttcctttcctcaccatgaccagaccattgttgacttttctctctgctgaggcagaaaaatgcttccatagtccatgcagcaatgtttaaaacaagggattcgttcccccctccccttttgtgtaggctggttaataaactctatgtttcatagcattgtcgtgaatattcagagtgctccctgcgaatggttttcctactatctctgttgtgtatcatttctgtttatttgattcgtggttctgagtggaccctaccactgacttcaccaagaccttcatgtactccacaaccctttcatcttggtcatatctgtttttgtacaacaccctaaaactacatggagtcttttaaacttggtctgttttttcaatccttttcttaacatcgtttaaaatttttttcccagtgccactgctctaaaatctaacaaacaatcatttctttccaaagattaaatccgtttttctgtgctataatttcatgtgaaagaagaactaggttgctttgctcatatgtacagttcttaaaataagttgtaggtaattaatataaaagttgtaggtaattaatgataaaaattggtttcttgtggcttgctgtattcagtccaccacagtatgaacttcgcatgctaaatatagaaagataataagtatctcatgtaatgacaactaactttatattggtctttatataaacttaaatatataaactttatatatttagtctgcatactttggattagtgtgcatatttacttattgtatcataatttccaaaacagaaacaattgatatcttaattagtattctattttattggagtttgcactaggctttttatttcattgtgttacatttaattgaactaaaccgataaatttattgacattaatctgtaattcatcatacatttttcatgcctgatataattttagtcattccatgtgtttttgtttgatgtattctaattcattccagtcagtccaaatgtactgtcttccataggttatccttcccttcaagtggaactggaaacccccacagggttgcactacacaccacctacccctttccagcaagatgattattttagtgatatctctagcatagaatctccccttagaacccctagtagactgagtgatgggctagtgccttcccaggggaacatagagcattccgcagatggacctccagtcgtaactgcagaagacgcttccttagaagacagcaaactggaagactcagtgcctttaacagaaatgcctgaagcagtggatgtagatgagagccagttggagaatgtatgtctgagtgagtatcctcaataccttggaaatttggctgggtccccaaaagatgttaaaccagcagagcctagaaaactaggagtaagctctgagcagcaggagaaaggaaaatctggtcctgatgaggagatgatggaagagaaactcaaatctctatttgaggacattcaacttgaagaaggagtagagtctgaggagatgacagaagaaaaagtacaggctattcttaagcgtgttcagcaagcagaactggaaatgtcttcaattacaggttggcagaatgagacatcaagtggaaacctagagtcctgcgctcaagctcgaagagtaactggtgggttactagatcgactggatgacaggtatggctgtttcaaaaaaaggaaagtgaacacaggttacttgttaatagtttatcttaaatacatgctttttagtggtgacttcttctaaattaccattctagttctgggataaaacctgctttaaagaccagttcattatgctaatctggaaaggaaagtgaatttaaatttaaatttaattctcaaaactgttgaaataaaatacaagaaaatttacatacatgcccaagatttatacgttgtctttactttagaatactattcttttctactttattacttgtatgattcttttcatatagccagtaattattgttcctttaaaataatgaggtgggtggatcacctgaggtcaggagttcaagaccagcctggccaacatggtgaaacctcatctttactaaaaatacaaaaatcagctgggtgtggtgtcacgcacctgtaatcccagctactcaggaggctgaggcaggagaactgcttgaacacatgagggtggaggttgcagtgagctgagatcacaccactgcactccagcctgggtgacagagtgagactctgtctcaaaaacataagaagaataatgaatgaaagtccatgttatttagaaatataaacattactgtttttttcctaactgcaaacataaatatgctcattattaaaacttaaaatgcagattaaacaaatcaatacaccccatcatctaccaataacattttggtggattttcttctacgcatgattttttaaatgtcttaatgtaaaaagtgcagagtagcaaaaagaaaagccatccattctcctaccatactaggaaaaactgattttacatatccttctatttttccacgagtcttatttttcataatttgaaagatacacagttttttacaccaaataatattgccatgatgaacatttgtctttacccaaaataatttcctggtcacatttgtctttacccaaaataatttcctggtcatgaatttggttaattcttatactggccttgctctagaaaggtgaaagtctagaatctgagacatagtttcaaatcccaccaccattaggaatgtagtttgtgatttgggatgaatctctaagctctaagaatgtcactctaattatctttaaatataagaatactactaccttccttaaacagatttatagatagaaaaagagaggatgtatcatgtctaccaaatgactgacacaaatagtaatttctcagtagcactaggcattatttttatttacatacacattagactaaaatatattttacttcagtgccagctagtgattaaattggacacaagagaacttatttcataaccatattttatatttttatgtcattaataagcttcttgctcaataaaaattcccaaagagggagtttacaaaactacttttgaaaaattgcaggcatgaatgaactttatctacagcctacaaaagagacagttgcaaagaagacaaacagtactaattttgatgtctatgttcagatatagtcacacaatttatagttacatatcagggaatagatataggaaaggtgttcatcattattaaaccgctgaaattccttgttttatataggctctgccagtgaattatatagaaaaaacactagtgaatcccctggttccatagaaggaggaaaatgccagtcactttgctcctgttatcagaatatgcagggtaggagaacgccggcaagcaatgtggactggggaatagaaaattaaaccaaagtcataaagctatatgttacaggatcttcacagtatgcttggattgtttatccttacacataaagaatagagtgtgctatggatgtcttttaaaaataagtatgttcagataatcagaatctgatttaaaggaatacacacacatatataagtatatattatacatataaagcattgtactagttattgccttctagcggtaataaacaaagatgctcaaaataatacgcaagctacaaaaaaagtgaaaaatagtctatactgaaacttgtaaaaaacttagaagtcaatttaaaagaaagcattggaaaggaaagagttttaatagttaagggaaaaacagttctctcagtaggtagaaaagggtgtgcaaccctcaaatcactagtgagattagcagaggtcaagagtagagaaaaatgagattcaagtaaaggtattagagttggaaaagtaacggcaggattcatgactgaaaacatatacaaagaattggaatttggggtacttgggggaataccacagtcttgaccacaggaatttgttttgttcttttttggagacagggcgcaattttttgtacagtagctcaatccttgctcactgcaacctctgcctcccaggctcaagcgatcctcccacctcagcctcccaagtagctgggactacaggcatgcaccactgtgcccactaatttttgtagttttttggtagagacatggttttaccacatcacccaggccgaactcaaattcctgggctcaagggatccttctgcctcagcctcccaaaatgctgggaatataggcaagaaccactgagtccggccagcagtttattttttactggtgatagagaagcgttctgaaatctcttctcctttaagattggtgggcttggaactctaggtatgtccatgagcctttcaggatcactcatcaagatgatagaattcaagtagctgtagaactgcagtttgtttatttagacgagagcatagctaggcaatttggcaactgagatatgggggatgtctagaagctgtgtagcacctcctgacaccgcacccatgagagccctttacattttatttatttattttgagacagagtctcactctgtcacccaggctgaaatacagtggcacaatctcagctcactgcaacctccacctcccgggttcaagcaatcctcctgcctcaggttcctgagtagctgggattacaggcacgtgccatcacgcctggctaattttagtatttttagtagagatggggttttgccacgttggccaggctggtctcgaactcctgacctcaggtgatctcccgcctcagcctcccaaggtgctgggattacaggcatgagccactgcgcccagctacattttaaatccagtggccacacttttcacacttttctattttatgccttcagaagtaggcaaaagacacagttcttaaaactttagagtttctgcaacctatattcagtcatagtttgccattgtgaatttgcaaattttctgttgcagccctgaccagtgtagagattccattacctcatatctcaaaggagaagctggcaaatttgaagcaaatggaagccatacagaaatcactccagaagcaaagacaaaatcttactttccagaatcccaaaatgatgtaggaaaacagagtaccaaggaaactctgaaaccaaaaatacatggatctggtcatgttgaagaaccagcatcaccactagcagcatatcagaaatctctagaagaaaccagcaagcttataatagaagagactaaaccctgtgtgcctgtcagtatgaaaaagatgagtaggacttctccagcagatggcaagccaaggcttagcctccatgaagaagaggggtccagtgggtctgagcaaaaggtacgtcatctggtcatccggtagcagtcattgaaatggaaagtatcggtgctttacttctttggattgatcttgcagccgggggcccaaggttttttacgatttctaaattataaatgtgtgaaattgtagcactaatggtggaggtaaagaaagtactgagttaaacacataggtaaaaaaaaaagttccaagtaaaatgtatgccatttcgttataccttcattcatggtgcaggaaaagggaataagtatctgtttagccatttttaggagggacaagaaccagagagacgttaagtaactagtttaagacccagtattttatctgggatttaggtttcctaactcccactccgtgttcttccttatgggaggaggataatcattctgatcctttctggctccttggcataaacagtctatagcatctgacccatctaagttctgttctgtatggtctgttgtctgaaagcgtgttttaaaaattaaagagatgaaattccaagcctaaaatgaggtgagttgacagcagttagttagaaatttaaaattagaagtataatttttataatttatataagttgatgatgattgtcttaacatgtatttctaatcactttaaaacctcactgtgatagatttgcttgttctttgtacttttgtggtacaatctaatagatttttttctttgaggtttactctatttttagatattaaaagtattttaaactgaaatgatgactcatacgtggatataagaaaataaaaagcagctctgtttcctacattttttactgctttttactctcccaatttttatgtcttttcatcaattctgcaatagacagagattaatagtagcacttgcagttttcgctgagacatatccagttcactgaagacccactttagtgttttgggaggaaaaaacaagtcttttctgaaataatgagttcaagattgatttgaggtttaggaagacttttagcaaactcaatcgctcaggagctgattctcagcttatcagtaatcacatcctttcctattcccttctgcagacaatatctgactattttcaggcttgttagaagggagagtaagaggaagtttagttctagatcatctatttttttttccctgtaagtaagttgctttgatataagatttggtggtggtaatcagttgcttaaatgatatcctaaaataatctccagctcatttaataactgccttcactaaatttttattaatggttttgttttagttttaagctcttttaagtctttttcaggccttctttaactccgtcctgacaagtgtggttttgaatactgatttctgtctttgacttgacttttagtatatttaagtggtgtgagttttggataagtttccttttaaaatgatcccacaaaatatagagagaagcaataacatagtggtatttttcctgtgaatatttattctgcaaaagcctgttaaagttctaaaggcaaatttctatacaaacacatataaacaccgctgtgtgtgtacatgtgcatatgtatgggccactggaaaatcatattggccattggcataaagacggttgaaaatttagttttaaaccttgagtggaaacttagctgagtttgtcagtaatggaaaataatttaccattagaaaacattttcaggatttcttgtaaatgagtttgtgcctctgatattggtttcgagtcctattataatgcagaaagacttcatgacctaaaaaatccataatggagttaaagcttctaggagacatgaacctgacctcacaagaaaaccaaagatgtttaggatgtatcgtttgtggctataccatagtataatagcaaccaactaggtcatctgatgtatgatctcagaaaacagccccctttttatcccctaaaaaatcaggtcaaaagtccgggtgcggctcctacacggatgactgcctgctgttataaggtaaaattctgctattttccacctgtttccatgcagcaacccatggcaaagagtactgagaaaattccatttggtttccttgttttcccctttaccaattcctagataattcactaaaaggaatcctgagcctgagattcttcctccattttcactttaaggttagcagagattccagggaaaaagtggaaactgaaacaatgaccaaatggccactttttctttatgtaaggggttggcctcacatgatttttttgtaggattatgctataatcacctctaggtttgttgtttgtgtttgctttaacatagatgctcttctacttttgaattcacccaagtgaaaacctttcctcaacttatgattccatgtacagataattcagattcagttttcccttttgcctcatccaacccattaatcctggaatgctaataattcttttctttcgtcaacacagattccttttacctctttctgacttcttgagcctttgcaaagcttccttccacaatacttaaatcattctaagtctcctaaatttactgtcctttactgaaaaatttaaaataataatagcaaacttagttcaagttcttactccttgtaaggatagtggctatgattttcttttaaaaccatattattcagtggggtggtttgttgaggtgaaatttcctgtaaagtcaaggctgatagtactgtttaacattttaaaatacttgtcaagtttactgttgatgaaaaagatggcctagtttattatctatacaactaacatttcataaagcattttatctaacacctgtacctcctatagcagttttatttttttttttaaacaaatactggaattcatttttccagcggatgttaactaaattctgtctctgggactattagatttgaggtaatgaattaacttcaaagataaagtaccagaattattttcatagttccaccattaaaatttagaaatttaaccactcagtaaatactcttccccatggcatctaagtgaaagctaaagatattttccccttcaaattatgaactatttgccccttggtagtttttccagattcccacctttattgcctaaaaattaatattttgtgcagcaactatattcttgtctgtgaaaggtattctattttatattctaatttcattatcagttctttaaaaaaagatttcaagctttcatacatttattccttcattaaattctttctcagtaccagttatgtgttaggtacaaattatgctgatattaatctcttgaatataaatatatgtgccaaaatatgctaatataaattctttacttgttgttgttgttgttgttgagacggagtcttgccctattgcccaggctggagtgcagtggcgcgatttcagctcactgcaacctctgcctcccaggttcaagcaattctcctgcctcagcctcctaaggagctattttttgtattttagtagagacagggtttcaccgtgttggtcaggctggtctcgaactcctgacctcaagtgatccacccgccttggcctcccaaagtgctgggattacaggtgtgagccaccgtgcccagctagattctttactttttaataaagttcaaaatagcttttaataaggttgtcaaatttgaccaaaatttcatagaagtccaaaatattatgcctctttctgtagatcaaatgaaatatggcccaatttacaagggtatacaccttcatggtagatgaatatagattttaaactagttttaaaaggaatatgaatgatttaattgtagtttctgctgccaaaaagtctccataattattttttaataacttataactaccttgatctttacctgtacacacacacacacacacacatgcacagagtaatttcacttagaatcctggtcaaaaattttcttccacttaaattttttttaagactctcacaaatatacatcatggttttctttagtcggcaaaaaaaaaaaaaaaaaaagaagaaaacatcaagtaagtgtaattctttcttgatttcccttctcagaatgtcttttattttaagtgtgatggtaaaattatactaaaaatgcatttgtcaggacttgaaagacagtgagagtgattcaagctcagaggaagagcggagagtcactacccgagttattcgccggcgtttgattataaaggtatcctgtagctggatcattatgtggcattgctctactattagaaactccttccttgtggttgtagaaactccttccttgtggttgtgaaatttcagcatgcttgataatgaaatggctttgtgtaatttttttgcacccttgaaagcttgtaaaaacaacaaccaaaaagaaaagaagccatgttgcatggtattctgtataggcctatttgatatgtggcggttgtagttttatttgagaattcttggcatttgtatcctgctttccttgaagaagtgttatgtgaatgagcaaagattctgtcttggtgacacagtagttcatatcaaatgaaatgtttaattgaaaccttagaaactgtaacaaggtatgaggcacgataaagaagaaagagaatgaaagaattaaaaggcttccttctcagtctcaaattcctactgccttaagaatttttaaattaaaaccagttcttcataagcaatcagtggctgagaatttgaggttataacctggcatggatatatgtgacacaatgcaagtcaagtaaaaaaaaaaaaaaatctgaaataggtgtttgtttaactttactaacacacaagaaaaaaatcaagctgcatttttaagtataggagtcaatttaaaaaaaaaaggaaaatagaattcttccctattacggcacaattgaaaacactattaataaatattctgtctttccttcacaaaggtctgttgaagcacttaccttttgcgtagtaaggttccacagaatgcttcttgtagtctcccccttgtcttcattacttcgtcatcagatctttctaagggttagaataattgagttcagagaactagaaagccattttcaatgcgcagacttttgaatatgatccaaataacttgaggcttcttggttactgccctagagagaaagaggaagagaatatctattgaaaaccatttatcaaacttaaccaatcccaaagtgtcaagagacccaacagaaagcacagaagttggcacaggtgtccaaaatttcttaatcctggtgcttttcacttttcatgaagaaactccaccaaatctgccctaatacagtttttctaagactctggaaacattagggaagaaaataaatcgttgtctaaattttgagttatcctgcaaatcaattgtaagctcaatagggttcctttaaaaaccatgaatcacttctttgaaaattccatgtatataagcaagccaaattacttattgctgtctagcacatttgcaagtatttaacctgctatcaataaaatcctcataatcagtcacctcacacatgttctctgggttggggtgggggaatgcttgattctgtttttctgagtttttgctattctcataatcagtgtcttcaagatatgatattttaaagtgaaaggtctagaaaaagcacatagtgcttcgaacttgtcttttatgcttaacatatcacatactaatgttacatctaaatccaccacattcctttataatagctgcccatgatagaagttgactttcttctatccaggacaaaagaaaacaaatatagccatgcaaaaaaagtggaaggcggggataaagaagtttttctctgagaaaacaaaaacaataacttcaaaacctctcaaatcaataagggctatttcctttggtctcctagaattctagatatgcaccagcaagttagctattaagtaattttcttagagtaagttatctttgtttttcagcttaaaatatgattataacatattaacatatttattaagaacttaggtttaaaagacaaaaatccactataatgttgtaggtttcataaaaacaggggagtccgtattctccccaaatactttttttttgagacagagtcttgctctgtggccaggctggagtgcagtggtgtaatctcggctcactgcaacctccacctccccagttcaagcaattctcctgccccagcctcccaagtagctgagactacaggcgtgcgacaccacacccggctaatttttgtatttttaatagagatggggtttcaccatgttggccatgatggtctcgatctcttgaccttgtgatctgcccaccttggcctcccacagtgctgggattacaggcgtgagccactgcgcccagacccattacttcttgaagttaatgtaattttagagagattgagtgaagtcatcagagaataggttttataactgaggaaggcattgtataaacaataggatcattcacaaacaagctttgagagatatctttcatatgagatggaaaaaccaaaggctaaaaaatagttataatcatcattggaagctataggtataacaaaaacactttataaattatttttctgttcagatttttggggcaattgcaaagagtcacacttctgttgcttttctctttactccatatgttgctatctatctttctaatggaaaagagcttgaggactataatagtatatggtgaatatgacatgggaaccatctcttgtcaaaaacataaaatgggaatgtagtacctaaatgggtcattgagactaaaattactgtgtttccaagatctcagaactgaagattggagataaatttatttactcaaaatcacacagccagacagcagcagctctgggactagaacctaatccctagccctctagtgaagtgctttttcctcaatactatacaattggacctccatatctgggcattccacatgcacaaactcaaccaaccttgagaaaataaaacaataaacagtagaagtaagaagcaatatagtataacaattacttacatagcatttacattatattaggtattataagttatctagaggtgatttaaagtatatgggagaatatgtgtagcttatatgcaaatactgcaccattttatatctgggacttgagcatctgcagattttgctatctgcaggggtcctggaaccaatccctgtggatactaaggaacaagtgtattctcttccagaacaaatgaaaaagtattcctttttgctaggctaaatcaggtatttgaccattcagatcttttcagcagcacagaagagggcagcattgggctgtcattcctgggaaccatttgatggggctggaatgctgggaatttgacttacctcatggatgctgtccaaacctggactgaaccagcatagttaacactgtttgccatagtaagccccctagcacttagtatcccagttctgaaaactagtctggggtggttccatccctcccagagctagctctggctgggaagtatctcccagaggaagcagtatgtatgctaagcattggattgccaaaagtctgggcaaatctgtcttcttagaattccatttgtataataaatgaggtgacggcgatttttctctttactttcaaagtggatccattctttttctatgaagttttaaccttttttttacatttaatgttttcaaactcctatagaatgagtcaagtcaacaaaatctcccatttgtcatgggacttaaatgaatgtgctgataaaattctgatctctatacaatttgataatatacagtggtttcaaatgcttagaagcaatttatgttactaaccagtcgtgagtttaccttattagcttagcaaatccagtaactgcaaaggtaaaaaactgtaaaccaacacacaaccaaactattgtgaaatttcataaaattcaaataactgaatttttactatatagtacaactgtatttttatttcaatttttcaacatttttactggttttctaaataagagcttacatgtatgtttctgctaactcaggcagttcaaacgtatggtaagttctatccgttcattccatttcccagaggtaaccactcttcacaagcttcagattgtttttacatacatatacaaatatgtgtgtaaaatatgtaggtttcgtactattcatattgcttagtatttgctttttgtaaaatatatcgcatcaatcctatttttggacaattcaagttttaacgtatccatcaaagcaaattggtacatttcatattgtcactcttccattttattcaaaaattctaagagaaataaaagttataaaatgcagtgcttctagcaggagtccagagggaagtacagttaattttcattaataccgtcaccagaggtgaaaatgtaacaccacatgtgctataattttcctttataatggttggggggaagggaagggaggttgccagaaatgatgttgtcaacaagaccacggggacaattttgtttacttaaaaatactaagtgttttcaagaactttaaaaacctcattgaggccgggcgcggtggctcaggcctgtaatcccagcactttgggagcccgaggcgggtggatcacgaggtcaggagatcaaaaccatcctggctaacacggtgaaaccccgtctctcctaaaaaatacaaaaaattagccaggcatggtggcgggcgcctgtagtcccagctactcaggaggctgaggcaggagaatggcatgaacccgggaggcggagcttgcagtgagccaagatcgcgccactgcactccagctggggcaacagagcgagactccatctcaaaaaaaaaaaaaaaattgagattactttctcccattgaagagaggccttagagctctctcttaggtaacatttggtctctaatatagttgacagaattaaagatggataaattttttaaaaatgtattttatgactccctgctgtctttcctatctatttaatcaactcctatctaatctattcctcctattcattttggcttattatttataaataggttttgctttttgtaaggctattaatctaagtcaatgaatctaagtcaatgaatacatacttgtatgtattcactatgcttatacatatgcttacttcatagtcctttcagagattgtccaaacaattcaaaaattaactgacatcttttcccacaaaaagattcattcagtacctgcccaataggataccattttagggattttcctgggttctttaattgtctatcactcaaagatgtgtacatttccaaaagttagctcaaaaatatttgtcattcgtgtttaagctataaggaaaactttcattactttttattggctttttttgctgtccttatgactttacttttaaaataaaattttgggttttctccaaacatttgaaaccaccaaccatagaaaatacaaataacactgccattaaaaacgtgttgcaaattttagtgtatttacacaagacctctacatttttccagtttttctcccctctcttcactgcgctgattcaaacttgtcataagcaagattggagatgcactaaacaagatcaagcaacaccttgttttattttcattccacctataccacagtgaggaaaaacaagttaaatgtcccgcccattgtcatgaactatgcacccacaaactgtaagaacacaaagtcactttgtaataagaaaaaaaaaaaatgagaacaaaactttgctagcaaaacaatagtgttctagtctttattctgttattttgaaccagaactgcctttctactgattgtgacatatggtcacatgacatatggcaatcatagaatgttctcaccattggctggcactgaccaaattatcagagccactatcttttccatgccagtaacacaaagagttagaatctcacttttccaggaaggcagctgtttttgtgattggccattttccctaaaacaaaacaaaaccacatctgtacactgccaagcagcattatccatttcaccttttcagtaagaagtttgactgacagatcaataggaccctggaatactagtccatccttaagatctttatccttgttctcccgaactataagtggcacaaatcttaagttaaacacaaatgaaggtaatgtattgcagatatggtcctacttctgctgagtagtttgtcgtgttatacaatcatagagctagtggagagatactatggagccatctaaatccaccaagctgtctatgacaggaaaataggcgcccaccctggagagttaagaatgtattctatttttaaaactcatagtgagacctttcagagtttcccctccaaaattagataacaaatcagaaagccagattctaactctgtattactggaatgtaaaagatagtgactctgataattttgtcaatgccagccaatggtgagcacattctatgactgccatatgttacagccaatagagatgcagcagttctggtttaaaaatgacagaataaagactaaaacactattgttttgttctcatttttttttattacgaaacaactttgtgttcttatagattgtgggtgcatagatcagaagatatcatcttaaattcccttggtattgattttatctatttttttgcctatggcaatgaagatacttcagtgtataaactatgtactatatccgacacaattattctcacttaagagctatgaaagattcagtcttcaagattctctctgtaccctcaacttttctcataatctttcaaaaaatgtgtgtattatctttagtgaatgaatttttaaataaaccagagtgataaatatcatgcccaaactaaggtactatcttagttcaagttagataaaactcaatccacaaaaatctctagagattcggtagaactaatgaagaaacagtgcttaaagtgagacgatctaatcagagctctaatccttggctaaaatttgtctcaacatatgaagcctttcggtttacagtgtgtaactgcatcctataattatgtattttcaaattcttccttctggaatctgttgctaaccatcacgcttatacatacttgaggtttaatgcttgaatgttgttgactgctaaataactgtcagtgaagtcagcctttttcccttgcactggagtagcaagtagaatttacaacttatttctctaaaattccagagcatgtgtgtggtgtttggagtagtgtggagatttctccatctagtatgttgctaatctttatgccacatcctttagggagaggaagcaaaaaacattcctggtgaatctgtcacagaagaacaatttactgatgaagaaggcaacctcatcaccagaaaagtaatcatcattcagatttcatgcttctcttggaatttagattttctgcattaaaaactctgctacttttgtgctgtagtgtcatctcctaaaacagaaaaatctctacttttcaccattacttcctacagatcactcggaaagtattaagacgaattgttatcccacaagagagaaaacgtgatgatgtggtaatggagagggattgccaaagagaatgtagaggacaaaagctttgtgcactccctagaaattgctgctaacaggctggcatctgcagtgtggcagcttgaagtgtttgctgcttttgacatcttatgcatttgatcagggtcaaagaaaaatacttttcttcctaacattctttgttacatactttttttttttaactgtcttcagagttttcacaaagataaggtcatttataggggacagaatgtgccagtttgagggagaaagaagataaaaccttcaccattcaccaccaaacctcagagcagtgcttcagccccacccagggcttggccttcagcagagtgtctgttgggacaggggcggagagcactccaaaagcacaggctttaaaagttagaatggcaaaaggctcagttcaagatctgcacatcggatccatacattttctctttccagtatgttctgcagggaaatctgaattcctccatcttcgtctgaggagggggttcccctctttgggtttataacagcccatttccaatgtgccagttaaagaatccctccagtcaacccctttctctcagagaaaacatctctggttatttttcacttgtttctcagatctctacccttttcaatttaaaaatagaaacttcaatagacaatgtttacattagaaaaagtaaactgaaaatttatcagaagtacaaatcacaaaattgaaaaggcttcatttgttttctgttaaaaattgggtaaaaactgagtatttgtgccacaaccttgctctcggggaactgtattcctgatgctcagtgaagagaggatttgtttatgcaaaatagatgccttcttggtctgacagtaagaggaagtcattggcaattccactaacttaaaaaagtccctcagatcaacagcatttccatggattagtacttaactaagaagtctgaatctcattgcaacagattgtttacaattctgctgccttgtgagctgtggtgctgatttcttttagcttactataggaaatggataggctgctcgttattttgatttatcactaacttactgaattattgtcaagtacaattatgttgtattcattttgacagtgctctctagcttgcttgatgatgctaaactgtgtggttaagctaaagattgtacgtatttttggacatgaagtgacaaaatgctttaaactgtttcgcttgtcctaatccagcctccaaggatcagaatggactgctttataactaacactgtttcactgtgaaatcttaatatgtacactcctttcaaagcagggagaaggttttaaggtgaaaacgaagaaagaaatccggcatgtggaaaagaagagccactcgtaacagcgaacggtcagtcaaggtgaggtgtgttcatatcaacaacagtaggacttaaattcctgtgaaacttatatttttcactaaataagtgattctgattttccccgtcctttccttttcactgaatttcagctttgaaaatcaaatacgaagttgttcaagttctgttgatgtttgcatatatacacacaatgaaacttgacttcggtttcacagtccattaactttctcctcacaaattaggcagcaatttaattgtaaattatgtttgcagaagcaagtataaatagtgataagagtaaaggctcactatgaaatacaatagccttatacaatctaacaggaagactatttggcaacgaatacttcttacagttatactcagagttttattgatccagactttcaccattttagcagaacggcatctgaggatatcattttggttgaaataagtgactttccaagtctaaattaaatgactgacatatctatctggtgttttatagaaacaaaaggaaaaaataggaggttaatggcactgttgtttgttttttaagttaaatgtttagtaagtgagctttgtttacatttgcctggacttttctttacagatcacgttattttccttttacattgtcctatttatttctacttagctacaattaggccatatggggtgaaaaagaaagtcctctatagtctgtaaagtaaagcaaaatcacttcctttagttcaccaccagtcttcttagccccacaggttaaagtagtaagaaagagcaaacagattctagttttcattttcatgcatctgctgttccctgcttgccagaatactggtatgcagagtgctgagggaaggaactgggaagtaatctagtttcactgcctgtaattttatgtgtgagctaactaaggcccaggtaagttctcaattctccctccccgcaagccttatcatttgtttattcagtataacatttacttcatttctttctgtgagactttctcacatgaccatttaatggcattgagaagaccactcagaactgcagagcattctggaaagaatgtttactacacatcctcttcccagtgtttcatgcgtgctcttcaggcaatcctcacagccaaccctcttggataaggccttcatcatccccatttgatagatgaggaaacaggcccaaagtggttaaataaattgcccacgctcacataagtaaaaagtggcagaactaggatacaaacccgaacaagctgcctccagtgtccacttgtttgccagagacttaacctgggtcggaggtgacggggaaggtttccttgagaatatgatgtttgagctgaattttaaagaatgagtagcagtcagtcatccctgtaaggattctgggctgtacccgaaaagcagtgggaaaccactaagggattttaggcaagagtgtggtatgatccagtttatatgttctgcatcactcgctctaaatgcagggtagttgttaatgaattggaaggggcactggtggatgaacagaaaacctgttgagagactattgcagaagctagcttggcagtgaggatggctaaataaaaaaatttcaacacaacttggtttttattggatgagaaggatccaagatgagaaaatgaaggatgacatcaatgtagcagtagctagaatgaacccactcctatgcatgtcctactgctgaacctggtgaaagacttctccctatagcagatccacaaaatactaagcatgagtttgttatcttgaattcgtctatttatgcaattctaagtgaaaaatgaaacgaaagtagaaaagaggtcagtcatctgtagtatgcccctaaagtttagcagcttgttcaatcatattctcaggctcctagtggaaaagaaccaaaagggttacctacaccagctgagccattttctacaatgacatattcctaatacctgtgaataaatgacaccaaaaaatatgacagtgctatgcttccagggtcctttagactgtgttgatttaaaaacagcttgctcactaaatataaagaaagttttaaaattttaaataatcatcctataaagaagttgtcagactcacttgctgcaccactcaaaggagagagaacgttgggtagattcatatgaatgtgaaaataacttcagctaaagcaaacaatgtgtcagattgaaagaacagtgacttgacaagcctaattttactttccaggtagtgtttaccttccgtaagtgaacttagggaatgagtccaagaatactgcctggaattccaggagactgaatgtatgtgctccggaaaaatcaatttgcaaatatattgagagtttttatagtcatgctggctgcctctttaaaaaaaaaaaaagaaaactaagcaagtagaatgctgccaaatatgactgagtcttagatggtaacatcaaaatttgtatttcccattttagaagcagttgaattttgagctatctgaactctgcccctgcttttctttaatattgagtcatagccatcctatttttaaagagaaaagccaatgactttcaagatttgtacatagtatatagtgatttatagtttacaaagtacttttacatttttgtcttatttaatccttccaacaagccttaaggcaagtcaggcaattttgcttgtgaccttttacagatgaggatattaaggctcggacagctcaaatgatgtttctgccttcacacagtttatgactggtatagctaagacttgaagtcaagattattgattctcagcctaatgttctgttacactaagctatctctctaaaattatttacaaagaataataacaatcatcttctgtgaaatgattgctatgtggcaggcactaggtaaataattatatatataaccttaggaaatccccaaaacaatgctataaggtaaatacaactatcccccaaccccttttttaaaaaaatagggaaactgaggttcagaaaacttaaatgatttactcaaggtactacagctagggagcaaaagaataaaatttgaacttatctagaacatagatcttaactactacttatattaataaatagtatttgatcattaaagacccaaaagcaaattctgaatcaaatacaagcacaaaagcaacctgtcgtaaatttcttcttactctacacagtgaaaggactcatagttttttattcttttttcttaaacaaagcaagacttcatttctaaatctctagatttttacttcaaataccaaaaaagggggctgatttgtgaggtcatggcaagggaagatccccagataaaaggtcatttaagccatggcaaagacttgcatgacacatactgtattctaaacctcctctaggaaaatgctcaggttctcacagccatgtgtaagccaagagtggcaagagtgcccatgcttgtcaaggcagccctttacctgaggccaaaaagttaacccatttcatttatttcttcaaagaatatttggccatctgcctggcttaaagtggaaggactagatatacaatagtgaataaatgcttcatggtccctgtctttctggatctcccagtctgcaatgggaaaaagaaatgggacaaatgtttaaacactgaaaatacaaagtccaggatccaatgaaagaatgtaagaatgtacttagactttggggctagggaaggtctctctgaaatcatgacatttaagctaagacctcatcagtggcaccaattatgaaaataatggagaagaagaggaccccaagcaaagggtacaacatgtgcaagcaccctgaggtgggaaaaggcctaacatagttgaagaaatgatagatcagtgcatgatctttcatttcttcaaatatgtaagattggtgtgtgatctttcatttcttcaaatatgttaggtgagctggtggtaggtaagataggcacaagataacattaaaacacacacacacacaccatcattcagagccctgtaggccagaggaaaggatttagatttcattctaaagggaatttaaattccttatagatgctcgatgttagacttttgtcagatacatagtttgcaaatattttctcccattatgtaggttatctctttattctgttgatagtttcttttgctgtgtagaagctccttaattaggtccagtttgtcaatttttgctttttacaagcaaaaaaccacccaccccattaacaagtgggcaaagaacatgaacagacactttttgtttcttcttttatttttgagacagtctcacctgttgcccaggctggagtgcagtagcacaatatcggctcattgcaacctctgcctcctgggttcaagcaattctcatgccccaaccttctgagtaactgggattacaggcacatgctaccatgccccgctaatttttgtatttttagtagagacggggtttcaccatgttggccagggtggtctcaaactcctgacctcaagtgatccactcaccttggcctcccaaagtgcttgaattacgggcgtgagccactgtgcccagccacgcacagacacttttcaaaagaagacaggcatgtggccaacaagcatatgaataaaagttcagcatcactgttcattagagaattgcacattaaaaccacaatgagataccatgtcacaccagtcagaatggctattattaaaaactcaaaaaataacaggtgctggcaaggttgtggagaaaaggaaacatttatacactattggtgggagtgcaaattagttcaaccattatggaaagtggtgtggcaattcctcaaagagctaaaaacagaacgaccgttcaacccagcaatcccattattgggtgtataaaccaaaggaatataaattgttctatcacaaaggcacttgcacatgtatgttcactgcagcactattcacaatagcaaagaatggaatcaacctaaatgcccatcaatggtagactggataaagaaaatgtacacacacatacaccatggaatactatgcaggtataaaaaaaagagtgagagcatgtcctttgcaggaacggaacatagatagagaccattatccttagcaaactaacataggaacagaaaaccaaataccatatgttctcatttagtggaagctaaatgatgagaacacatggacacaaaaagggaaaaaacagacactgggatctacttgagggtgagaggggagaggagaggaaaaagtaactattgggtactaggcttagtacctgggtggcaaaataatgtgtaacaaacctgcacatgtacccttgaacttaataaaataattgtttgtgtgcatgtttagaggaattcgaagcctctgaaggattttaagcaaggacctaacttggtcttttttccctctttaaaaaaaacacaagagcacggactatctagagaatggatagggggacaagaataaaatgaaggtaaccagttaggaacttattgcttcagttcaactaagccataatggtggcttcagctgggaagattgacagcacttgatagattagcatggtgggtagagtggagaagaatcattgagtcaaaaatgactcctagatttctggcataagcaactggatgatagagaaagaagcagaagtggaagaggaatgagttttaagaagaatgacaggcattcaggcttggacttgggtttgaaatgctatgagacatccaagtatttatgttacatatgcaagtccgaagctctgaggaaaagttggggctgtgcatataaaaatgtgggaatcatcacaaaagaaatgggtattgaataccagtgaacagatgtgattacctagggagaaaactgaagtaagccaagaaggggctcaaaagttgagtcctcaaaagcaacatttcagagtttaaaaaaatttcctcagccagatgcagtggctcacgcctgtattcccagcactttaggaggccgaggcaggcagatcacgaagtcaggagatgtagaccatcctggctaacacggtgaaaccctgtctctagtaaaaatacaaaaagactagccaggtgtggtggcgggcacctgtagtcccaggtacttgggaggctgaggcaggagaatggcgtgaacctgggaggtggagctttcagtgagcctagatcttgccactgcactccagcctgggcgacagagcaagactccgtctcaaaaaaaaaaaaaaaaaaaaaaaaaaaaaaattgcctctgacctctctcttccgcagagctccaaccatgaccctccttagtaagcactcaataagcgtcagctattgctactagtattaaaaaaaccaagaatagaaccttgaagagctttggattacagaggctggtggactaagcagcagcagccagtgatggctagaatataacagtgggagaagtgagaacagcagtgtctgaaatcctctgcatgtgatggtggtttacacttcagaaaagtttccactatttcacatcacttgtttttcacagtagccctaggaagttagtacaacaggtatccttattcctctttactaagcaatgaacagtgacaaagagagagcaaaatctctaaggctgagtgcagttaatgacaggtctggatttcctgattctgattctcagaagtcagagctatgggctgaattgcttcactacaaattcaggaccctgccctccagaatattttaccggaattcatatagagtaaatatgtttttatattatgtattttttatttttcttaaaaatatataatattttttattttaagaaataaaattagcccagctaattttgtatttttagtagcgatggggtttctccatgttggtcaggctggtctcaaactcccgacctcaggtaatctgcctgcctcagcatcccaaagtgctgggattataggtgtgagccaccgcaccccgccttttttttcttacccttaaaaaattcctgttaacaaaagccttggcttcaagataagagctagaggcaggtggcttgatttccagttctggctccactatatattagctgtgtaaccttgagctcactatttaaaagctttgtggctctctttttggccgggcgcagtggctcacacctgtaatcccagcacttcgggaggccaaggcaggtggatcacctgaggtcagaagttagagaccagcctggccaacatggtgaaaccccacccatttctactaaaaagataaaaattagccaggcatggtggcacatgcctgtggtcccagctactcaggaggctgaggcaggagaatcgcttgaacctaggaggcagaggttgcagcaagccaagatcgtaccactgtactccagcctgggcgacagagcaagactccatctggaaagaactaaattaattaaaaaataaataagaaaatagagccacaaagcttttatttatctacaaaatggaaaaaataatagtacctcagggttattcggattaaattagctaatccactttagaacagtttagaataaatatctttacctaataaaaataataacagtaataaaattttattactgttaggtttttctttcactgctaaaacacgaatgaacagttttccagtatttttttccagccctttgacttaagatactttttaatcacaagtgaacagaaaagaacaatcaaaaaagccctacttattggtattagtgaagaaacaaagctacctgaattgggaattactttaaaactgcactgtagtgtattttagttacataaagtaattaaaattaatgtttagaaaaaagtcttagtccatgatttctgtaactacagagaaggaaaaagagaaaagaagggaaagagagaggtgggtagggagagaaacaaagaactagagtaaagacctctttgtcctcagtgggctcaggctttccttaagccatgacacagctaagtcttaaagatgagtaagagttgaactacaaaggtggatttcattagggaaagaaatctgaactttcaaggaggtggcatttgaaacaaatttgaagggtagaagaggaattagccacagatgataatcagagaaggcaagtataggtggatacaaaatcatgagcaaagacaatgaagttggaaaacaatttgtagttgatacctggcatgtaatctagatcctcaaagtgaagtctgtggaccacagtatcagcatgcctaaaagtctgttagaaacacagaatttcaggctgggcatggtgacacgcctgtaatcccagcactttgggaggttgaggcgggcagatcacctgcggtcaggagttcaagaccaccctggccagcgtggtgaaaccccatctgtaccaaaaatgcaaaaaattagccaggcatggtggtgggcgcctttaatcccagctactcaggaagctgaggcaggggaatcactggagcccgggaggtggaggttgcagtgagccaagatcatgcctttgcattccagcatgggcgacagagcaagactctgtctcaaaaaaaaaaaaaaaaaaccaaaaaacaaaacaaaaaaaaaaacaaaaacagaatttcagacacactgacctactgaatcagaatctatactcaaagactcctgtgtaatgcagattaaactttgagaagcactgttccagaacatttgactggctctcaaattatcgagttttaaaaaatttttgatgctggccccatcccgaaaacttctatataaactggtatgggatgtggcctggatattgttgttgttttaatcttcccaggtaagtctaatgtgcaaccaagtttgagaaccactggagattgcaaaacagcttttcagtgagggacagtgggaattaagcctaaaaaaggttcattgggctggaccagagagcttcagatgccaaactaaagataggagaccctttttaaagctaggcattagggtctaaaatccacaggtatgtccatttgcctataaaaaacaagtcagttctgtaccagagcatgctgctgacttgaagatgtgatgtatgcagtacatatttaactgtaaagtatcagctgccatgaaaatccaatgaattgctgtttccaagtttttttttttttttttttttttttgagactgagtctcgctatgttgtccaggctggagtgtgatggcccgatttcagctcactgcaacctccgcctcctgggttcaagcaattctcctgcctcagcctcctgagtagttgggattataggtgcctgccacctcacccggccaatttttgtatttttagtagaggctgggtttcaccatgttgtccaggctggtcttgaactcctgatctcaggtgatccgcccccctcccctgcccccggcttggcctcccaaagtgctgggattacagacgtgagccaccgtgcgtggccctgttttcgtatattttaaaatgtttcttaaaaatacagtgaaatggctaaaaggaatgattggttttctgatttagtttctcccacctttaggtttgaaaggcatacaaaacccaaagcaagacagattcctaagtgcaactgcatctatctcatatccattatctaaaccagaaaagggagatgagtcaaaattctatttctgaaatgtcatcttgatggcttctgccctcacaccttcccatcagatggcgctgtcatcacagtttataccaagtgtcaatatttttatagcaagtacacagtcacttagccaaggttctcatgctttttatgcaacattgtacttggtgtaaagtcttttgtccaatgaatgaccttcctgtacccagtgtggttggggccaacaggctctgattgcataaccaagaaaagaaaaagttataagaggaactaactcccacttaaaaaaaatcacccaaaacatcctcactggaatataagtgggcataattcacagcatttttttaaatgatagaaacatatccaatatatccagaaagataacatttgcttggattgaggtgagaagagaaaggccttgctactcattacgaaattaacctgggaagttggattggtttttaggagacatggagaaaagtagtgatgatcacacatctacataaatattaaaaattatcaagccaggccaggcgcagtggctcatgtctataatcccagcactttgggaggccgaggcaggtggatcacttgaggtcaggagtacaagactagcctggccaacatggtgaaactccatctctactaaaaatacaaaaaattagccagacttggtggcacacacctataatcccagctactcgggagactgagacaggagaattgcttgaacccgggaggcggaggttgcagttagccgtgatcatgccattccattccattccagcctgggcgacagagtgagacttcgtctcaaaaaaaaaaaaaaaaaaaaaaaaagaagctgtgtatttataatagctgaagtatgatatacaaattatatatcaagcttcaaaaagtcagggggaggggtttagagaaagcagggagtgagactgtagtaacattatcataggaccatctaagaagcctggtgcctacaagattaggattaaatgataaaaacaggtgagaaaatcctgatcatcatcttctgatttgcccaccctctgcaagatgatctacccaagtgagtcactttccttctttggaacctcagcagagtcacaggggaggggtgttgaaatcacataggaggaattgatactttcatgttcttggctccaagcattagtgacctggggcatggaggtcagtagcacttttaatactaaaaaggaagccaggtcctgtaggggggcagagagaggaagtgctctaccaacatgtttccataagccaggctgtcctaggtgacccatctaaagaggaagatacttgtctgaggtaagtaaacatcttcaaggtcactggaactcctgggccccaagagaagtcgaattctaaaggttgtcctagatctgcaaatatagtctgttgtttatatgggagtgagcagggttattcttaaaattgttcttgccttactcaggatttctataggagctgtatcttgttctcaggcaggtaggcatgcaagtttgtcagcttttcacactaaacaaggaggagagacaatatatgggaagaactttgttttatggaaaaggcaaattcataccacaatagcacacaaaagtatgaaaacctctgccaaagaatgatttattttgacacagtaagactggttataaaacacagatgctttatgcaggaatcttccagcaagacaagacattctcagtggagcctccactaaaaagctcaaatacaattaattcatcccattatgactgacatggacaggaaaagcgaaagttctttgcagtggtagaagtttgtctctaattttaatttggttatggaaaagaaatttcattgtaatgaagtaatgacgcttttcttccttttgaaagattagttgaatttttggagaagtgagagacttacttacaaagcattcagaaatagctgagatgctctatcctgactccttatctctggccctttctgctcatggaagtcccaaacttcttacattttgatatttagggaagtctcagagattacctctctcagccacctcatttcacagataagactaaggcccaaagggctacaaatggcttccccaagcagctgaataacctgagcttcagacagaactagaagagggtcttcccaacacagtctaaaactgtcaccaaaccaaactgggtgtttgcccgtgcacaatggacagtcgaacaccaaacaccaaagcaccaggtttttgcaggagaaaggtgtattgccacttgactgacaaggagacaggaggaaccactcaaatctgtctctccaagctgggggctgggtcatgtttcagaagcatagggtaatgaggcatgatctgactggatcctgcaatggggtgacgccaaggctctatctgactggatcctgccatgagacataagcttcttaattagctccccagcctgagaacttaggttcctcctatggttgcatatttagttcatctgggcatgctcacattatgtgaccttcatcctgggggtgtccatggcaactcaaaaacaactcacaactttgttacataaaagttgagggccgggcgtggtggctcatgcctgtaatcccagcactttgggaggccaaggtgggcggctcacgaggtcaggagatcgagaccatcctgactaacatagtgaaaccccgtctctactaaaaatacaaaaaattagccaggcgtggtggtgggcacctgtagtcccagctactcgggaggctgaggcaggagaatggtgtgaacccaggaggcagagcttgcagtgagccaatttcgggccactgcactccagcctgggcaacagagcaagactccgtctcaaaaaagaaaaaaagttgaaccaggtggtctggtgcaattacaaaacacagatacaataataagcaaggctctctggaggtcacctagaaaagctcactgccttctaagagctttccagtacaccttagggccttgtcctctaaggcatctagcaggtagcagcatcatgttaaaccaccccatagggaatggagggcctctattccctaagacttttctattgaatggcaagtaaggcttacactagttgtcttaaaaaaaaaaaaaaaaaaaaaaaaaaaaaagaaaaagaaaaagaaagctaaactcactatctactgtctctttccacaggatcataagtttttactgccagtattgagaaattcgtggaagaaatgtcagcaggaagtaaaaattcaccgagaagtgtgtgtgtgttcgctgcttccacacattaatggcatgattttttttatgcaaaaagaaaagaaaagaaaaccacccacattttaatttagcatgagccaatttacagagcatggaaatcactttcatttccggattggcgcgtgtgcaattagcaatgcagtgtatatacaagaagccatgctgttaacagtttatctcaagtaatttggtgtcatttacaaaaggaagaaattcctgccatcagaagggacagaaggagatggaatgatcaaatcacagagaaacactaaaattactaaatctacaacagctcgccttatttttcttggacccaaactgtcagggtataaacactatttgtttcttttttaaaacatcgatagttttgctgtaaataataacactgtataaattctaacagaaaaatagaataaaatgttgataaggcactgcctcttagaacacaaacagaatattgcaaatgcatttaacaaataggggtctcaagtgacttcaccctagaagaggagggagggattctgggtgggggtgactcttcactgattcttgtatattagcaattataatgtttgtatatgcaaaactgctagcttgattttaaaaaaaaacaaatctttaaaatctgctgcaaatttaaataattcccaaaatgaggaattctgtagttctgtgaaaaatttttttcttcagaatactaatattttgatgcatgtgtatcaccttattttgattaaatcttttccaattttgcaaacactacagtatactgcaacacaaaagattttatctgtaaacacaaagcccttcatctaatatttgttgctattgccaatttttcaatgaaatgacctaaaaacaacaaaaaaaaataacctatacggtagttgctttagggggtggggggatgctatctgttagtgcttaaaagggggtaaatgcttgccgctttagaggtggatggtgctcataaaaggccccagtcgggggtatttaaaaaggactgaacagaaatccttagctagtagaatggcagcacgctgtaaaattattactgtattgtgtactggctataagatgtagacacctttcagtaagccaatcatttgtaaccattctagcagtgtcatattaggttaataaggctgctgtgttttaaagggcatttttatttgggttttggtgaaattctttaatttgttgattatattcacataaaatcagcattcattgacacatagctctaatgacatatgtatgaaaaaccatacactggatgacctagtcgattatttaagcataaaataaattgtgttaaactcttcaccta

SEQ ID NO: 36857 - DNA, 96821 bp, Homo sapiens
agcaggaggagccgggcgcgcctgccacgcaaaactaccgggctggcagggcggcgggcgcggtgcgcgatcccgggtggcggcggcaacggcggtggtgacggcggcgactgcagcggccggctctcacctctcccctgtgcacccgcatctcgccgcgccgccgagcagccagcagtccccgggtcgcccagcccacgcgcgcacggccgagcccagcgcacaatagcggcgacagccatggggaaaccggcgaggaaaggatgcgagtggaagcgcttcctgaagaataactgggtgttgctgtccaccgtggccgcggtggtgctaggtgagcggcgcggcgggtgggcgatgcgcgcaccctcacgcgctctctgcgcccaggccgcgtgcggctgagggtgggcttggcgctggcgcactccatgcagggtccctcgatgccccctcggccttagcctcgggccccctgcgggggctttcccccaagcgctctaattactgcacaccaagaacaaagctcctctgggactcccatttgagtgctccttgagctgctggttcctgctctacccaaaatgatcaaaggggcttgggggtagaaagggaagcaagtagctcttggttctgctcgtttgaaaacagggttcgatttttttctttgttaatcccgcaccgtatctccccctatcaccgccaccttcctcaccccacacccccagcctcgctgcgcgggcagagattgagtgtggattacagttctcagtcgaattggaagaggcaccctggcctccgggatgggccggacccttaggggagggaggctgagaacgctgtcgccgctcatcctgggcagtgcgtggaaaggtgccttcccacgcggcgagcgccgactgcctgcacccgggctctgaaaagctgccagattcgtgcctgaattctgggatgtgccactgtggcccgcgggaggtcaccggggaagagagctaagagaactcagccgtctcttctcctgccttccttgctctccacgttgtttttgtatttaagataatgtttaagccatccttgcctgtttttaaacaagggtgtatttaagtgatccacccctcacagatcactggaccaggtggatgtctgagccattgctcagaggtatgagttattcctatttagattctgattttttaccaaggttgtgtgtttctagctccggcccggggatgcacttccttgggattagcgccatatctgtcgccttcccagtgatagctcctcagcaggtgagggctgttgcaccctctgaggaatgtggattcctcggcaggctccaccttccccttggaaactgcagctgtgtttgctgaaaaggcaagtggggacagcttgtttcctcccaacctcaggtaccttcctctccaactgctgctcctaaatctcagaatatatggtgttgcttgcttctcctccgaaccgccccctcccctcagggtggggatagggcatggaaatggcctttggaagttaatgggattcttggggtcagattggattctccagaaccttggggaaaggaaagtcaggtttctagtaaataaataacatcctggaatggccctagcagaggctatttgtaggaggaaaggagagaagtacagaagcaaatcttgactatttcccccaagaagtgccaagtggttttggaacttttttttttcggttttgaacatttttaagggaaagtttatcctactctaccatatttaaatagcatacgctacaaagaacgacttgatttcctttaggccaaagagaagagatggccttgtttgttttcctagtgataagagtcgaggattaattgttaaatctctttttgaagactgagagatgccagggcaaggtggctcatgcctataaccccagttactcgggaggctgaggcaggagaattgcttgaacccagaaggcagaggttgaagtcagccaagattgtgccactgcactcccgcctgggtgacagagcaagaatccaccaaaaaaaaaaaaaaaaaaaggaaaaggacttttagagggccaggcacggtgactcacacctataatcccaatattttgggaggccaaggaaggaggattgcttgagcccaggagttggagaccagcctgggcaacatggcaaaatgccatctctacaaaaaagtacaaaaattagcgtggtggtgcacatctgtagtcctagctactcaggagactgaggtgggaggatcacctgagcccagggaggtcgaggctgcagtgagccgtgatcgtgactctgcactccagcctgggcaacaagaatgagaccttgtctaaaaagaaaaaaaaaaaagactttgcaggataaacattggcttgagtctccctcctgattccctgtggaagtggagttatcctgccttttcagcatggggctctccagagatactcacttgctacccaagtgttgcacaccactcgtcagcatgcgattcactggagactggtttggagaaggttttaagcaattgttccctggcctttggaatcagttgcgtgaataagaagaagtacatgctcattttgcagacatggcctttggtctcagatgggcactttcctccaattttaatgtctgtgagccccaagagcttagtttgagtacttttctccagaaaggaaagtcaccacttaaaaatcaagtgcccagctgaaatcttcctagatatttgttccttcagatggcaacaaagggcagtcctgcttctggtctgagaagtctcaaacctagaccacccccgatatgcccattaacaggggtccttttcttgtcctttttcttcagagtactgggcctgagtggaaactcatacttgtttgtgtagtctgtaagggctgatttgtttaattgacagtgaaattccagtgacttataacagtggcactgagtctattcataaacccttgctagataatgatagtaagagcttattttataactgccttaactgatccagaaaaatcgcaagagctctaatgcagcctcccttttggacttttcagcatgtggaacttaaagaagaaaaaaaactgtgaaatttattaactatcatgacaaaacatcttcttctgattatagccgttcaaatgtttggtccctgaccaggtgcagtggctcagacttgtaatcctaggactttggaaggccaaggtaggaggaatgagtgagttcaggagtttgagaccagcctgatctcatctctatttctaaaaaaaataatttaaagaaataataatgcaatgaaatgttcagtcactactataattcagtagccctaatactttgaaatatttgattatagaaataagaggcaaagatttttatgagccagcttaaagcctgatttttcaagatacagcacatgaggggaaatgtaataagggtcatctttattaggtgtggaagttcactcttttcatggacaaggaaatgctaagaactaaacatttctcaaattcttgttcacaagatgaagggattcaatagttaggtgaccatctttttaaatttctgcgacaccctacatggtcctgaaaatagtatcttggattttcacaggaaaatcctctgctaaaataccactagaaacactttcacggctttcattacaattcttataggcttattctctgcttccatagaatggtagaatgagcacagagcctggagtgaagagtccttgggatttgaattctggtactatcaagctctatcatgcaggcaaactgtgtatttccctacaagcctcaatttcctcatctggaaattggagatattacttattacttcgtttgttattagaggtgtgaaagatactcagttgtgtggctggcatatattcagcactcaatagttgttattttaaggtaaatctgaataatttgattatgagaaaattaatattttcttatgaaataaattctctcatagtatgtctctttctgtgtcctgcttagtgtcccgcctataatttagggtgactcaagtgttttgatgacctgctctgtctgagctaataactgtccctgtagtattattcatttctttaaagaggaaatggaaagaatgaatcatttatttttgtgccccaccggctaatcctcaattcatttaaatataatatttaaatatataatttatataaatataatttaagtatgtaaattctgaaggaaggttttatgctctaagtgggaattctgtccaagcagaattactgagtgagaattctgccagccttctaatgcgggtcatccaataatgattatatagtatatgatgttgttaaggcacttcttatatcctcaccctattcacaatataatacctaatctttctctccagaccagttatgccattacttctgtcatttgaaaaatctgtgatttcaacttagagctattcagaaaaagcaataggtattggcatttacatgacagagctggcaagcttattcattctaaattgttttctttggagcgctaaggaagcaatcatgcatagattctgattccattatctaaaatcagaaacagctccttcatggtcttagcaatacccttgcccagcctcgtgtctctaccctggagctcatgtagcgtgcatctggcagtgctaatttgagacgtggcataggctttcccgctttgtctgtgaagcccctgaggacagggcccagcggcggttcacgctggttccaggcccagcccctcacctgcatagaaccttggctcagcagtgtttaggaatatccctgtaataatcaacacttaagccattcattcatttaacagatatgtatcagacccccactgtgcaccagggattgttctacagccgggtcacacagcatgtcctcatgggacttaatgttcaagtagagagaggtagaccataaatagaatacataggtaacctactgtatagagcatgttagatgagaatagtgttctggagtagtatagagcagggagtgggctggcaaggtggggggttgcaattttaaacagggtgacaggggaggccatactgagaaggtgacagttgaatcaagacggaggagaggtgaaggaacaagttgcacaggtatctggggagcatcctagtttgtgtgagaaacatcaaggagtagaatgagggagggaaagagtaggaggagatgaagtggaggtgaggctgggggcagagcaatagggtggttcaggtccaaggtccaggaaaggggaaatgggtgcctcagctgagcagccaggagtggaacagaatgaaaagacagctgcttgaggttaacctgcagggcttggctggatttggtccaagggagaaggcagtggctatctccagcaaaacagagagtcctggaaggggcaccgacttggaaaagaacatggcatgttccacggtggacgtgttgagtttgaggagccagaagggtgtttgggtaaaggtaggcagcaaacacctggctaagtgagtctggtgctcaggagacaaatgtggagtggagtgtcgacttaagacagcatgtcagggacctggttaaggctttgggaatgaatgaacctatcctgggagaaaagggagaagagaagaccaaagacagagttctggacaaccccaacattggaggtctgggaagagaaggggcccacaggagaaaccggacgtggtgtgatagaaattaagaacaggaacagtgatgggtgagaggctcgggggcaggagtgagagggtctgaggaggaagttcaacagcgttggggatacaaaggacagggatgtgaccttctgggcttttatttggaggcacttaggtgtgaaagaattcagagaaagtggaagtcacgtttaagatccagagagtatttttctttctttttttaagagacagggtctcgttttgttgcccaggctggtcttgaatgcctggcttcaagctgtcctcctgcctcagcctcccaaagtgctaggattacaagtgcaagccactgcactcagccttgttttgttttgtttttgtttgttttttgttttttaaggagacttgagtctgactgaacctgaagagaagtgatcattaaaaataaaaatgcagctgagcatggtgactcatgtctgtaatcccagcactttgggaggtgaaggtgggaggactgcttgaggctaggagttcaagaccagcctgggcaacacagcaggacccctgtctctgcaaaataaaaattaaattagccaggcacgatggtgcgtgcctgtggccccaactactcaagaggctgatgtgggaagatcacatgaggccaggagttccaggctgcagggagcttgatcacatcattgtacactccagctgaggtgacagtgcaagatcctgtctctgaaaaataataataataaatgcagaagagagagaaaataatgaatgctgttgggtggagtgaggcctgggacagtagaagacagtgtgaaatggagggacctagttggggattggccagagaacgggactttatactcctgagatggaagggaggagttaagggtgaagcattgtattcctttcctgtggctgccctaacaaattaccacaaaccgggtggttttaaaaaacagaaatttttttttgagacttaggtgtatccattactctgtgccaagaactgttctgagtgctatataggtattaaatgatttaatctttccatcaagcatattttcaggaaacagaggcacagagaattaagaaacttgcccaaggtcgagggcagagccgggattcaaaccctggaagtctggctctagagcctctgcttctaaccactatcctctcccgctgctgtgtgatattattaccctatattctgatgtttctgcctccctcaccaattcaggaaccctaagggaaggacgtttgtgttgctcttctctgtgcccatagtacctatcacattgcacagtagggtgaatacatttgttgaattgctgagccatttatgacccagagagttagtaaaatgttgtccttgtttgtcaagggaacaaatgagcctaaagcttaaatcaaactctattacctccataaattctcctctgcctgtttcagccccctctgatctatgtcagcaacatagattaacacttgatgaatctatataaatatcaagcatgttgatcttttctttctcaaaactagattacagaccccttgaggtccctcttattacatttcacaggcactaaaaaataaaatgaggccataaagtaatgagactgactcttaactgtttttttaatttttaaaaaagtatatctgatacctatactctctgagtctttgtttcttattaacaagaaagggacttagattagctgggagagcaaagaagattctattcatgcatctattaccacttataggtagtggactatctggtatgatctttattgaaaaagagttgaaaacaaaagtctgaaattgattactgctgtctggcactggcttaggatcaggaactagtggtatgcgtgctgagtaattgttgacttgggttataaaacctctgagagtccttctagctttaagaacctttagctttatgactgtatattcattcctcagttcattgctgggagccagaggaactcttctgtaaggagctaagggggttcaaagggcattacaagatgataaaatgacctagacattgagtcaactgttctgtgtttgaactgctgatcagtgacatagggataatcatgtaaattgtatatggggctattaccatggtaatatgttctatgtcagtattattagatggtttattacaacagtaatagaaggtctaatatatgtatgtttttggactttatatgtctctaatttaaaatatttgcaaagtacacaatactccaaaaacactaaataaaataatagtttcttcaaaatgacaggaatagcctagttcctatatcctcaaaaccagtgatttccacaacaataatcagtttgacatagggaaaacaaaaaaaagcatagttattcatatataatggggacttttgctttcaatgaggaatatagctttatgtttatgtatttctgaaaagtgatgaaaacagacaaggttgctagtttagtcatatatatttaatttgtattaatatatttattccatagcatgccacagacatgacaatattagcaaaataatgagcactactaattagtttccataatattttctagaaatttgggagttgctagtgagttaagttcatctgcaaaaaaatatatatatatgtgtgtgtgtgtgtatatatatgatattgcttatactttctctaaaatactgagagatatgtggtctctgtctctgtatatattacatgtatacatacatatacatatgtatgtattatatacataatatatacatatatattatatatgtatatataatcttatatattatatataagattatatattatatatatataagattacatattatatatgtatatatatatcttttttttttttgagaacaagtctcactctgtcacctaggctggagtgcagtggcacgatcttggctcactgcaacccctgcctcccaggttcaagcgattcttctgccttagcctcccgagtagctgggattacaggtgcccaccaccacacccagcgaatttttgtatttttagtagagacaaagtttcaccatgttggccaggctggtctcgaactcctgacctcaggtgatccacccacgttggcctcccaaagtgctgggattacaggcatgagtcacggggcccagccatatattatgtatctccatctatcttatctccttagttaagtaccttagagaagagatccttctggcctcgccaaagttctacatattaaagaattaggaaaagaaactgggctttgaatgcttatgcctggtgttttcatttttgcaactaaatcagaatcagatttgaagcatcactgaaatgattctgatttttggttgttctatgcaaggtatatatgactcaagtctatcaaaactccaacaaaatgatctaaacacaaaattataaaatgaatctttaaaatgattttacatattagactctgcacatgcaggttggtatatacaatcttaatgcctcctatgaggaagactgaatataaattgctagtggttggcaaatattgaatatcttgttagatgttgcttaatttaagatacggtgttttatttagtacagtaaaactacaaaattgaagttgctcacctgttaaaaatttgagcactgggcataagaaataaagaaagcttcaaatgaaaacacgctgtgtagaaaatttttgtgtgcaaattcaggatgtggtggagctcaggtgggtaaagcctgggttatgtcagacaaggtaggattaggaatcagttgttagagagcatgtatgcatgtgagagcacttgcttataaagagagaaagctttccacattaattgcttgtgagaaattgtgattacctttaacagagccgagactgaaaataactgtcctagggagtccgtgacacactggcctggtgccagggaagctgtgttcgcctgaggtattgcaaatttcccgtgtcgctggagatttggggtcacagatgctgtgacaactcaagcactctcgaagaaaatgaactcattttagatgacattgagtggcccgtttaaactccccatagcagtgtctattaaagtagaaagtgttttaaatggccttttctattttgtttgttttattttgagacagagtctcactctgtcacccaggctggagtgcagtagtgcgatctcggctactgcaacctccacctcccaggttcaaacaattctcctgcctcagcctcccgggtagctggcagtacaggtgcctgccaccacaactggctaatattttctatatgtttagtagagacggggtttcaccatgctggccaagctgctctcgaactgttaactgcaggtagtctgcccgcctcggcctcccaaagtgctgggattacaggtgtgagccactgcactgcgcccaagaaactgatttagaaagagttaatacattatacttgctgaggaacagccccaaactgcaacaaagagtactctgttgtaattagtacagcccacagtaacacctctgttaatagaaaggaagtgtttcagtgactcactctttttcagaaattttactactttactttgaaaattatctgctgactgcctgttccgttaccaaaggtagaatatttcctttccaataaatagtcctatactttctgggatggacagatctcatcccagctcacagatgcttcatgttcctctcccaggcccagcctcggctatgtgagctccgggcagcggttcccactcagccaagacagggagggatacagtgccctgttctctaccactaatccccagacccagccctgagaagataagacgtcccaccagtcctgcactcatgctgaggtcaccactcccgagccctttcttagtctcagagtccctaaccgtgtccaacacaggacaattgtcacagcagatctccgcatgtctaggaaggctcttgatagtagaaagtgttttaaatggccttttctattttgttttgttttgagacagagtctcactccgtcacccaggctggagtgtagtagtgtgatctcggcaactgcaacctccacctcccaggttcaaacaattttcctgctatcatcatgtgactctctgcttggtctgcatgttgaagcaatagcagactttgggactggaacttggcttcggaaacaccctcagagagggtccacatggccacatggtgtgtttattcttataatctctctgagacaactatttgggtataacacttccagatgtagttaaaactacagcactttggccaggtacggtgctcacgcctgtaatcccagaactttgggaggccgaggtgggcagatcacctgaggtcaggagttcaagaccagcctgaccaacatggagaaaccccatctctactaaaaatacaaaattagccaggtatggtggtgcatgcctgtaatcccagctactggggaggctgaggcaggagaattgcttgaaccctggaggcagaggtcgcagtgagccgagatcacgccattgcactccagcctgggcaatgagagctaaactccatctccaaaacaaaacaaaacaaaacaaaacaaagaaaactacagcacttactcaaccaagggggaaatccttataggagagagcttaggtgagaatgtacaattatttttctaccattgttctattgcttaagagttacctcgttactaataattcagtaaggaattaagtcaacataaaaaaatgcaccatcaccagaaatgcctaaactacagagagcctaatctctgagcctctccccattactggaaaataaactgatactgttcaacttctgtgggtatctcaaagacttgttttctgagccacttagcaggtttcatttaagatttccccaaattatgggccaggcacagtggctcacatctgtaattctagcactttgggaggccaaggcatacagatggcttgagcccaggagtccaagaccagcctgggcaacatggtgacacctcatctctacaaataatacaaaaattaaccaggtgtggtgggtcacgcctgtagtcccagctactcagggggctgaggtgagaggatcacttgagcccgggaggttgagtctgcagtgagccaagatcacaccacagcactcctgcccgggtgatagaatgagaccctgtctccagaaaaaaaaaaaaaaaaaaaaaaaaagattccctgaagtatgagacattgagagagaaagtgagagtgacatattttctcccttgaaaagttctctttggctaaccaaccctaatatcaatatttattgagaatttaccacgagttttatgtacatttatctcccatttgaccctcagtacaatgagttagggggttcccattttaccagatgaggaaactgaaatttacaaggcttaggtcatgtagctgagcacacagagctaggattagcacccaggactgtctgattccaaagcttaggttactaattattaatcattaagcaagtcttcttccttcctagtaaaccttgatacacctacacctaattggtagttagaaccatacttggagacaggcttctttcttgcaaagtggccaaataaagcctattctcctccttcttgcttcatcctttctcagtcttgtagctcatctttattgcgtgtggttagtcctttccgctacgcttctcctacataaaccttctgtttgagcttgaattctagtgaaactcatctagttgctttcccagaactgttgtactttcatgccctaatccttttgctcaaatgtttcactcactgttatcctgcctatccttgaagatggatttaattaccacttttatgttgtagacttctctgactgcagttggagataatctcccttctctacattcttaacccttgatttatatgcataaattatcaccattagcaccaccattcccacgtctgttctgtggcagacatcactgattacagtactcttcactactgagctctgtcatggcctcagaatcctcgaaactttgctccaggcaaccactgttaatcaaacagaattggtgcctaagatgaaaagtattgtttgttgctgggaaaagtttattcatttggcaatcaattaggaactgaatttaaattgagcaagtactgatgttactgataagagaagcagagtcaaagtctgtattttgtcctctcagtccattggtggcaatacatccacaatcactaacatgatcctgagtgtggtaaatgctgcaaggaggctgcagcatgctgtgggccttcaaagaaggtgcaactgggaaagttcctggaggaggccataattggaatggccttgagcaggtgtggtaggatttctgggcttgaagactggaacgagcaagtctgtataaaggtgatgatacacataaggagggcttatcatctcttaggttcaatttcagtattacatggaactataatttaatatatgtgttgctgtgctttcgcactttttcttacctgtttcctaaggacaagaatgcaatactacacaggtctgtcacatcatagcatccagcattgtacttacttcacaggaggtgcccccagatatatctgactgattacaaccttcttcactgaagaattaaaacaggtaaatctttgatgaaccaatcccattgatcccctagaagcccactcagttgtatgagtttttgagtgaagaccatgaggaactcttatgctagcctaagtcatcccaaacatacttaactcctggaatggggaccccagaagaagagcaagtctggttgctaacagttttgaagccattttattgtgagcactgcatgaccctgaagctcccagactggagagcatctctgtaccctaaggaagatctgatcttctcaagaaaccagcaccagaacccacctgatctccagataattctctgggctaattagagaaaatggaagatccatctctttttccataattgggctacagcttggcactgaatcaaccctggatggtagagccttttcagctacggtatttagcaactcttacaccattcattgaatttatttctggattttccccctccaagtgtcctttcacatccttatccaaattctgcccacttctctccctgtctggagattatttctatgataagaaattaattagcctgtctgtactacctgttccaggagactttgaacaactgcgtgggtaaacactagatgtggtcaccaaagagtcggaaaataagtttttactttttcattagcaaaagttaattgtcaaccaggagatgtaacaggcttgctccatttctgctgccgcttcttggatttctttcttgcatgtggagaatttcctgaggtttcaccagactgaagagattctgagttcttgaagtgatggagataaagatcttgttgtcataaaacagcaaagagcactgtgattgggtttgaaagatttttgattgtgttatggacagtgctcttactggtttttaaaaagttgatgttttcttctgtgtaaatttaaataatttctttaaaggcagtaagcttttatatttaatatacctttcactgtgcaatcacaacaggaagattttctaaattagacatctttaccttgaagaagaaacttgtctgtttcagtgtctttttgtagcaagattgaccaaaacaagtggtaaataagtctgtaatatttaactgtcatgaaatacctttgctaataaggaaatggcctcggtttggattaggtggagtttcgtgtgtgcgatgtgggggtgtatgtgtacatatatttctttttttttttttttttttgagatacagcctcactatgtcgcccaggctggagtgcagcggcatgatcttggctcactgcaacctccgcctcccaggttcaagcgattctcctgcctcagcctcccaagtagctgggattacagatgtgcaacaccatgcctagctaatttttttgtatttttaataaagatggggtttcaccatgttggccaggctggtcttgaacttctgacctcaggtgatccacctgccttggcctcccaaagagctgggattacaggggtgagccaccgcacccggcccatatttcctttttttatactggatagcaatatagggtcttgtctttcaccttttaagttcacagaacagtttgtcctgaccacacataagttaccagtataatgttttatgaaggtttagaaatgagctcccagaaaaataatattttaatatctacaaataaataatctgaggatgtttctcaattcagcatcaatgctgggttgtgccttgtggatttccattggctctacgtgcaaaagattaagttagttagaatgaggaagacatttttaattactgtgaaattctttgttgttgttgttgttgtttttctttttgttttgggaaggtgtctcacactgttacccaggctggagggcagtggcatgatcttggctcacttcaaccttcacctcctgggttcaagcaattctgctgcctcagcctcccgagtagctgggattataggcatgtgccaccacgcccagctaatttttgtacttttagtttttgggatggagagtctctgtcacccagaatggagtgcagtggcaccaactcagctcactgcaacctccgccttccgagttcaagcgattctcctgcctcagcttcccaagtagctgggattacaggtgcccaccaccacgcctggctaatttttgtatgtttttagtagagagggggtttcaccatgttggccaggctggtcttgaactcctgacctcaagtgatccactcacctctgcctcccaaattgctgggattacaggctcctgccgtctgacttaatttttgtacttttagtagagacggggtttcgccatgttagccaggctggtctagaactcatgaccttaagtgatccacctgcctcagcctcccaaagtgctgggattacaggcatgagccatcatgcccggccaaattactatgaaattctatcctgccagtgctttagaataacttgcattttaaagtacatttgcacattttacatataatgctatatggttgtgtttgggctttgtgtacagatgacttttgttattaagtggaaaaggcctgaaatatgctgttctatgttaagtaaattgatataacctaagaaaagatcttgttgccaattcagaaaccataaccttaaatagcatgcctgggtctcctctgtatctggtttaacatctgcattgaatattggtattttccaataatctccaactagcttatttattttgaaaaaaaaaaatagaaatctacgtctacttttgcttaagtggaaatacttgagtaatgcttggttgcttttttaacctcaagtcagtaactgtgaaagactggacttactgcacctaagatctagaaccctgaagttatctaattggtgctcatcactgagcttgtgtaggcttcctgaagcctattcagggccctgtgtactagggaaaagggttggcagatcacagtgtgtggagtatgcagccagtaattctttcttagattctctctcccctcttagaacctcccctcatttcccagggaacatctgttttccatgagggcagtactaagggggctgaagattcccacagacatataataaaaggttccaagagtaggctggcggcagtggctcacgcctgtaatcccagcacttcgggaggccgaggtgtgtgaatcactaggtcaggaaatggagaccatcctggataacatggtgaaaccccctctctattaaaaatacaaaaaaaaattagctgagcgtggtggtgggcacctgtagtcccagccacttgggaggttgaggcaggagaatggcgtgaacccgggaggtggaccttgcaagtgagccaaagtggcgccactgcactccagcctgggtgacacagcaagactctgtctcaaaaaagaaaaaaaaaaatagattccaagagtaaacaaaatcctcaagtgttactgtgcaaagattatactcaccatgtttgatttttttggtctctggtggtcatcccagatgcattcacagtcatttctggacctttaatgtaatccactgttgttattaaatgagctgatccacatggagttactttttgaaatcatgaagttccttatgaatgtttgttattgtgtcttaaattctttaaattcttaaaatatgtcttaactcacttaaagataaaagtaaatgtttctgtggtccttctgggagtggggaaagttacaactccacaaatgttaagagagaagggtgaacagttagcagtcaggcagcatggttgggagtcatgaggaagagcattcaagatgacacaagttttgtaagcagacctaaggaacgggctgaagaatgttgtggagacccaggtacttcgacttagcattctgagttcagagttcgcccaggagttccaggcttgtggcaggtttagaaaatccaggatgatcggccaccttctttctcccagaggtcgatctgatcttaagttgtacctgactaaaacctgctgcaggagagatggtcagattttatttacacacagggagatggcttcctaagattgtgtagtgaaccaagaaggtgtttacaggcatgtgaaactggctattgtaaagaggcagtgatctgggacacgtgatgttagttaaagtggaggaaaaggtgtacccttcaagcagaggattccagggcctctccaaaccgtacaagtctgagccaagggacagaaattccatcagtggcttggaagccaaatatttgccctgatactgaggaagggaaagagtggaacgtgaccgtgggatagataaagggtcttcacaggaatgcaaacaagatgataggtagaatcacccatgagattagcaaacaaatcactttaagaggaaaaaagtagaataaagagagtcaaccacaggtagaaaatgcaagactttggaatccacaagtcatagatatgtatctcgggaaataatccaagcacacatgcatggtactgatacacctgtgggagagtgagagtctggttgtcccgagactgatagattcacccacctgctgggctctaagccagttggatatttgctcgagagactagattcctgtgggctggtcctaactttcccaactaagctcaccctcacttgagcccaaaggactcctaagactccatccccaggaggcatccccaggtgaggagctgggcacttgaattgtcatgtgtacagcaccatagccattgtaaaaggagaacatctcacaagtcaggagttactggagagactgtttatgacacacttctgggttcgatggccctgagacaataaattcatccacattcctgtggcccagttttcatgctttgctcatgacatcctccctcagtgattttctcctgcctttcataatcaggtttgatgagcaaaggttagaaagtgcagtggcttcctgggcatgtgcattaaatagcaattaaaatgcagtcctggttcggctcaatgcagcaggtgtcaatcaaacacctacagtgtgtcaagcttgatgccggggcggtggggtacaggaatgagcagacaaatgcttctgccttgggagcttgagatgaaagggaaggagagcacgaattagacctgtttgagggggtaatagaaattcagataaaactgagtagggtccagaggagagattctttccacctgagaagacagcctaggaaaggctttctggaggaggtggctttttaactaggctttaaggggtgggtaggagtttattaggcagagatagtggcaaagggctttcaagggagggcgatctgtgtgaacaagagtgtgaaagcaaaaaagcatgtaaacaaaaaagcatggagcatctttaagaaatagcaaggagtttgctgtgactggatctgctgggattggggggtgagaaggacatgcaggcctgtattggttagggacctggcaggaagcagactcaaaagagtttcactgagcagaattgaatcaagggactatttatagagttcagcagggtaaaaggaatcagcaagggatggtgaggcacccagggatgaataactgggaagctattagctcatctaggcctgaacagacaagagagggtgatggggtttccacagtacagtgagggctgagttgtggcagggaaccaaaaggcagggcctatgtggctgcagaagaacaggggaagggagggcgggagaaaataaaaaaaaaaacccaacctctgtctctttctaccattaagatctacagctactgcctctcatttgctaaacccagccaaaaccagaggcaaggaaccctggatcagccctcccagtgcacagagcaggacaaagaaagacagagggtgaatcggagggcaaatggagagtgactagcacagagccatatggcatgaggtgccatgctgaaaggttttctcgggacatcaagaagtgttgaaaagatacaaagtctaggaatgatggcagggaaattattatttatttactgagatggaatcttgctctgtcccccaggctggagtgcagtggtatgatctcagctcactgcaacctctgcctcccaggttcaagcaattctcttgcctcggccttccaagtagctgggattacaggcatgtgccaccatgcctggctaattttttcatttttagtagaaatggggttttgctgtgttggccaggctggtttcaaactcctgacctcaagtgatccgcccaccttggcctcccaaagtgctgggattacaggcatgagccactacgcccagtctattttgataacatctggtgatactggtggctgttgcttaagggcattatgggaaatgagaggtaagaatggcttccacagcctctagctatataccagcaggaccatctcctgctgttcacacaagcctagccctaggcctctacatctagaaagcattgcccgtgcatctaccagcctttcttccatgcaaggagggcaaatgtggctggcggagaaggcacctagaataccagtggcagcttctctgtctccccactataatttaggactcttctaattgtaagcaacagaaaatccagttcaaacaggcttaatccagaaaggtgtaaggaggcgggggtgacatataaaatttatggctcagataccataagagtctagaaacagtacctggcttccagtacaggggtttaatatcatctggacctgttgtctccttacatacagtctctttacacctgtgtcattttcactcccaagcaagactcttccctggtgttgatacagctgccagcacaggtcaaggtttctttttcccagttccacacccagcaggagagataaagtttctgatccctattagttcaaacaagactccatggccttagccttaggctaactcagccctgagtcagagctccattcctcaatatagtcttgggaccaaaggaacatggtgatctgattggctagaccagggtccctccctcatcctaccatgttcccccaagcttctggactacttagggcttcagctccaccgtaaacaaattgagagttagaaggtatgctgttcactgcagggacaagggatactgtcccttagcaagagcaacagacctgccttttatctgttatgttcttgagctatttcctgaaagcaatcaatacaacactcataagttaaattttattgaattcatagttacaaaagccaggaagtcgtttagttattaaccacatggtttgaaattgatggaattgagacagaaatcactttaaaaactgagagagggtgtcatagtctgttctggctgctgtaacaacatcccacagactacgtagcttataaacaacagacatttatttcttatagttctggaggccaggatgtccaagatcaaggtgccattagattccgtgtctgctgagggcccacctcctggctcatgaatgatgccttctagctgtttcctcacacagtggaagtggcaaggcagctctctgggactctttcaaaaaggcactaatcccattcaggagggctctcccctcacgacctaatcacctctcaagggccccaccttctaacaccatcacattgatgattaggtttcaaaatatgaatttgaaggaggacatacacattcataccatagcagaggagaagaaaaattaagcatgttttgccttaaactcttaagaattctacacacacacacacacacacacacacacacacactacactacactacagcttatatttaatgctgaaagtctgaatgctttccccctaagagcaggaataaggcaaaggtgtccattctcaccatttcttttgaatatctcactggaaacctgggccagtgcaacagggcaagaaaaagaaataaaaggcattttgaaaagaaagaaacaaaactgtccctattcacagatggcatgattttctacacaggaaatcccaagaaattacaaaataaattttaagactaataagtgattttagcagggctgcaagatacaaggttaacacacaaaaatcacttgttatttctatatgttaacaatgtacaactgaaaatggaaatttaaatacattgtgtgacatagctccaaaaggtaaggattaggtatgtaacaaaatatatataggatctatactctgacaattataaaacactgatgaaagaaatcaatgaatgccaaagtaaatggagagacataagttgttcatggattggatgactcaacatagtaatgatgtcagttctcccataattgatgtatagatttaatgcaattctgatctaaatcccagcagggatttttgtagatataccagacaagctgattctaaaattcatatggaggcagggtgcggtggctcacacctgtaatcccagcactttgggaggctgaggtgggcagattgcttgagctcaggaattgaacaccatcttgggcaacgtggcaaaactctacaaaaaaatacaaaacttagccaggcatggtggcatgcgcctgtagtcccagctacttggtaggctgaggtgggaggattgcttgagcccgggagattgaagctgcagcgagccatgatcacgccactgcactcaagcctgggtgacagagtgagatcctgtctccaaaaaaaacaaacaacaaataaaactcatatggaaagataaaggcattagaagagctaaaataattatgaaaaagaagaaagttggaggaatcatcctatcttatttcaatatggttttcaagatatcaagtgtaatattggtgaaaaggtagacatggcaaaaactgcaattacttttgcaccaacctaatagatgaatgaagcagaacagagattccagaaatagacccatagaaatatgcccagttggtcttttttatttttttttaaattgagacagggtctcactctgtctcccaggttggagtgcagcagcatgattgtagctcattgcagccttgaactcctgggctcaagaagtcctcctgcttcagactctcaaagtgctgagattgcaggtgtgagccactgtacctggccctccaattgatttttgacaaaggtgcaaaagctattcaaagagcaaaggatagtctttccaacaaatggtattggaacaactagacatcatatgcagaaaaaaaaatgaacctcaacctaaaatcacattacattcaaaaattaactccaaaaggaaaagagtaagatataagacttttagaagaaaacataggggtaaaatctacatgagctggagttaggcaaagagatctagatgccaaagcacaattcataaaagaaaaaaattggtaagttggactttaacaaataaatctctttctctccaaaaggcacttaagagaatgaacaaacaagctacagactgggagaaaagaattgcagatcatatatccaacttgtctaaatttgtatccagaatatatagagaaactctcaaaactaagtaataagaaaacaaatgatcaaactttaaaaataggcaaaacctgaacagacacttcaccgaagagggtatactgatggcaaataaacacatgaaaaaatattcagcatcgttggccgttagggaaaagtgaattaaaaccacaataagatgccagtaaatacctattagagtggctaaaaaaaaatacaacaccaagtgctgatgaggatgtggagcaactggtactattaaacactgctgatatgggaatataaaatggtacagccactctaaaaaacaatttggcactttcttatcaccttaaatacagctttatgatatggcacagcagtcccactcctgtgtataggtcctagagaaaggaaaacatgttcacacaaaaatctgtatgtgagtgtttatagcagcactctgcataatcaatcaaaatgggagacgagtcaaatattcttcaataagtaaataaactactgtctatccataaaacgtgatctattcagcaagagaaaggaacataccattgatacgtacaaaactcagatgaatcttagaggcattatagtcagtgaaaaaaccagtctcacaacttacatagaatatgattccatctgcatgatagcctcaaaaagacaaaaccatagtggtggaaaacagactagtggttgctagaggttaggaatggagaaaggtgtgactagaaagatacagcatgagagagctctttggcgtgatggagctgttctatattctaattttgatggtggctataagaattttaacatgttaaccatagaactgtacactaaaatagtcaattttattgtatgatcaacacatgtacacacacatacaaacatgcccttaagagtcagttggtgcatacatgtccagcatttgcaagagagggtctgtgtttactggtggggaattcctgttttctactgagttctcatccctgaaaagagcaaaaccttgagtggcctgatgctgccgtaattcccattgaggatatctgacctaattgttttgggtattgttgggcatggaaggttcactaacatcttaagataacattcacacggccagccagagcctccctggttatctggcttggggacgcacatgtcacatggatcttggaggaggttgggaaggctttccaaatacacttgggctgagttttgaagtcactgaaatggtaatcagataaatgagagagcagagggagcaataaataaaggctcaaagacatgagcgcagggcagaactgacacagtgggcatggttggggttggggctggggctagggtgggtcagagagcttgcatgccaccctatgttaggggaccactgaaggggctttaagctggagagtgactccgccagatttgcatcctggaaagatagctctgacttagtttgcagaatgaactggcagagacaagattgtatgcagaaagagttttaggaagttgatgaagtagccttggtgagaaatgcagcggacctgaaccaagacagtgtcagaggccatcactcactttacattacattacattactttacattacagtgtaaaggccatcactcacttgtcttctgactgggctggcaggattcaagcagccggggctcctgtatcccttttctcgctgactctctctctcctcttctctttctctctctctctcccccaacccccacccccactatactccctcttgctctggttttcccatgttgcctctccagcatggcagcttcaaggcagctggacttcttacatgatgcttcagggcttcaaagtgagtgtcccaagaagaaaactaatcagatgctggcctcttctaacctatctcagatttcacatagcctcactactgctgcattttgtctatcaaggtgatcacgaaggccaacccagcttcaagagacagggacagagcctccattttctgatgggaagagtatcagatattctataggcctatttttaaagtaccaggggacccagaatgaaaagtctgaggttttctgaagggaggatagatacgtttatttttcctttgttgggtctcatgtgcaggtatccaggtagagtcccagcaggtaattgtatattgagtttgtcactggggaaacagcatgaggcaacagatagagatggaaatggaagctataaaaacagatgggatccctgtgggagagtgtgctgcccaagaagagggtggaagacaaacccttgatgaacatcaacaatgtcaaaggtggagagatgagaacttatccagctggctgagttcctctagacatccaactggttttcactcctagagtactgcagtctgagacttctctgggattcagtattctcttggtaaaagagtcatctttccagcaggactgaacccttgcttgcccagatcaagggtcctcttccacctctcacagctggctgctgagtcagaacctcctaccttcctcccaaggccaggctgtgttgtggagccttctgtcctgtgtgtttccagtatgggacaaggcactagatcctccaccctcttcccagttagctatgttccctggagtaaaagagtctttgaacaagttgttaggaaagtttctcctcttcaaccacttcaaaatgtccttttgagtgtaagccacatccaaataattagtcttcagttccagatcctgttagagagccacactggtacaggagctttcctgattcctcttttgtgagttgccataaagaaagaggaaatgacctataatctatgaaagagccaggttctaaaacagatcattctgacttcagagctcagcccttcaccctaggcatccctccaagagacaccagcatgaacttacccagaacgggcctgaacatttgaacaactgaacacaatacaccccagctggctcctggcagattgcactccagtgtggtgagtttaatttgagcaagcagttgaaataaaacagggctggctgtggggatgtggcagagccagaatggcttctcttgatcttttttttctctctgggaaacaagatgaattaatgaactgattcatactcccttttacccaaagtctgaaataaaccacccttatcatctcatcaaacctttacccgacccaaactatggatctgggattcttactcttctcttgccttcaatctatcccactcctgatgaagttccttcccaacttccaatcccatgggcttcactttcctgcctataaacagctgtcaactgcctgatttccctatgctaatccattctacacattttaaccaggcttttctccaatctaggctggcttttacacaaacatgttcaatggctattcattatccttaaaaactaatctttgtatattatagtttaacacacggtttatctcattttatcctcacaatgaacccattatatggaagggaacttagggtcagagaagtataaattctcctccctggcattcaagggctttcatggtgtgccccaagtgatttcctagtcttggttttctaaaccacccctcaagcaccagccaaactactgactgaacacactcttatcacctctttatggaagaaacagaactttggtgtccaacagaactggatatcgaagctggccatgtgactttggacaagtttcctaacctgtgttacattattatctttatctgtaaataacaggctttttagatcagatgattaaataaaataacgtattataaaagtgtttgggccttaggcacctgacacgttaatttcttcttcccctgcccctctgtctttaggtgttctctccactctccaccgtcctcaatagtccccgcctagtgaattccttctcactctcacatccaaggttcatctaaaattctttcttaatctcacctagtgtgaatttcaagggtagctctgaactcctacaactttggggtggccgttcctatagactagcttgttctcttgtcttctgtcttgtcctgcctactagaatacaatttctcagtggcaggagcagcgtcctctctttgacctcacaacatagcacctctgtggtgctggcacgaagaagtcatccagaaaacatttgtaagattgactcaagaccacgggaggcttcttgtgttccacgtgctgatttcctgattgctgtgatatttgctttcggctgaacactggtcaccttccctcttctgttattgtgtaccagaatgaaagatgacagccaggaggaagtttgcttgcagaggtatgtgggctgagctcacaaaatttaacaattgtttttagcttttgttcacattttaaaaattgggtggtctcacacaaagacctagatttttagtttctctttaaaaattcaggagaaaaggccaccatggaccctcactttcatgtgatggggcttgggcagagacatcaagaccaccacagacccatgggcctgcttccctcacttctgccctgatccctgtagccttgtacgtttgcagtctttgatgtcaactgaaaattgttgaaatgtatttcaaccctatctttaagaatgaagttgtagccgagcacggtggctcacgcctgtaatcccagcactttgggaggctgagacaggtggatcacttgaggtcaggagttcaagaccagcctggccaacatggggaaactccatctctactaaaaataaataataaaaaaacttagccaagcatggtggtgggtgcctgtaatcccagctactcaggaggctgaggcaggagaattgctgaacctgggaggcagaggttgcagtgagccgagatctcaccattgcactccagcctaggtgaaagagcgatattccacctcaaaaaaaaaaaaaaaaaaaaaaaaagaatgaagtccttactttttttttgattttaggacagatgaccaaggaggtgttacttccttgagtggtgaaaaggttcttctactgcatggggttttttgtggttttgttttttttttgtttttgagataaggtctcactctgtcacccaggctggagtgcagtggcatgatctcagctcactgaagcctcagcagcctgagctcaagcgatcatcccactttagcttccctaatagctgggattacacacgtgggccactgcgcctggcctacagtatggtttttaaatatctttgtgctctccctctgtagacatctttcatttgcttagaatctgtggtgatggaggcctcatgccctattccaactccagctgcctgtcaatgtagtgtctgtagcttctttcacatggagaagctatcagtcccattctgtccatcaaggtagagtgaaaaatatcaggtcactctgctgcctctaccacctttcagcactgatggctccactccctgaggggagaggcacaagtgacagggaaggaagaaagaagaagaattttctcactttgtgatttattgcatttaattctcaccctgagtctgagttgggtatcattccttcttgacttatagcaaaatcaaggcacatagaggctgtcctttatgctccatcccaaagctagaaaataaatgatgagtggtttgggcccggttgtgtctaattgtgtcatgttttttcactattctgtctgccttagggtctccaacccctttcagctgtatttataagactgatgtttgcagaactgtttattagtttgcaggactgtttattagacaactacaaacggagctgaaataaaactttggtttctgtttgctctaaagagaagtttctgttcaatcctccactgggagtgtgtctttaggcctctaaattttataccataactatttgtataatttgaatggtctccaatgaaatggatacaaataataataaatacattctaaaatagcaataatgcatgacattggtttagatcacagtgtttcctatgtacattttctctttgggttcacccaacattctcgagataccctcactcaagtttttagataaagcaatcaaaaagcaagaggatttaaatgacataggtaagtatgcatgtggtagaaatggaattagaatccagattcttagctcctcttttcattatctgatcctgcttggtttttactcacaccaggcaataattttgaaagctctgctctctctacttgtgatattattatctgttgttattattcaatcataaatatttattgagccttcctgcaggccaagggcagggctaagtcctgtgcattcattatttcacttaatgctcaggacagccatatgacataggtactcttctcatttctctttaactgatgaggatacagaggcttagagggattcagtaacttatgtaaggtcacactgctagtaactggtaggacatactcaactccagataggtgactcatggaaatttctgctgtgtcttacatcttcacctagattgtaaaccacatggggacccggaccacatgtcctccacagagcttagcaaagtggttgtatgcacaggtatgcaagtcattaattaatgacagttgattttttctcggccattagcttttattttactttatctatagggattttcagatcacactgttctcaaaataatcctggttttctgttggctgttttgatttatctttagacactgtaattgaaaattaagctcttaagcatctcctttacaggctatgttccacaatctgtaatcacaacttttctttaaattgatcatcatcttttgagctgttaataaacatgtctggcttcatttgggttttcaaattgttatttccagacggtgagactttcagatctgataggctcacacacatcctgccaagtggaagtttgagcaaaatgtcacatctttggcaatatttgtgctattagtatgatgattaaaggaaaaagaaaagtttcactgtgatgtcagcagctttcccacctcatgaaaaagccatcaaattatcaaccaatcaaaattaaatgaatcccatttaattttattattatctatttttcttttttccccgttttaaaaatgaatttggttcatttgctttctgcttctggatttgcctgttctggacatttcatataaatggaatcatataatacatggacttttgtgactggcttctttggcttgtttcacttagtgtaatgttttcaaggctcatccataccacagcatgcagcagtgctttattcctttttatggctgaatattattccattggatagagatacaatattttgtttatccaataataaattgggcacttagattgttttcacatttggctattaggaataatgttgttgtgaacatttcttgtacagtttttgtgtaaggacatgttttcaattccagaggctatatatctaggcatgcaattgctgggtcacatggtaactctatgtttaatttttgaggaactgccaaacagtcttccacagaggctgcaacattttacattctcaccaaaaaggcaaaaagattccagtttctccacatcctcaccaacatatatcattttctcttttttgtgttttttaaaaatagccattctaatgagtacaaagtaacatcttattgtggttttgatttatatttccctaatgactaataatattcgacatctttttatatgcttactgtccatttgtatatcttcattggagaaatgtctattcaaatattttgtctatttttaacaatttggttgtcttttcattgttgagttgtaagaattctttatgtattctagacccttaccagatacataatttgcacacttctcttttttgaataaattgcaaagcaacatttttcaaaaaaatttttaatttttttctgccatattgtgaagcttggttgtctctaccaggtactacctcctatttacccataagtatttggaaggtcatcaggatttatgctcaaaaatggagtttgggggtgagaaggaagcactttgtttggagagggttttactgttgaggccctgcattaatcccctctgccacctccaggaaagctgtggtcacatctggtatagtagaaagtgccatggtggctgaggaagcttgtgggtttatcacatttttatccatggtggcatggacaccttgtttttgcttccgaattgctcttaaagaaaaattctggggcggatgaaccccatcatcatccaggaagaatatttgcagcacattttttcttgtcatgatgagtttgctgtttgagacggtatggtaagaagctttataatggctggctagtgtcattttccctcatttaggctcaaccgtgactttatatctgtatactttatggaaggcctggagcctcacactgaggcagaagagggaaggggcaagtgcagttgatggtggcagctaagtgggagagaaagtcagcgaagacaattatttattcaagacctttacaaagggagcagccccacttgtttgcatgttgattgaaccataccttagtgtccagttgcttgaggcttgcagcagcatctttatgctcttcaaagtgagtgctgccattggtagcaaggtcttatggatgcccttgctaggcccatttccttctttgttattccaagtatacttctaatgaatcagaacctgcctctttttttttttctttttttttttttttgagatggagtcttactctgtcgcccaggctggagtgcagtggcacaatctcagctcactgcaagctctgcctcctgggttcgtgccattctcctgcctaagcctcccgagtagctgggactacaggcgcccaccaccacgcccggctaattttttgtattttctgtagagatggggtttcactgagttagccaggatggtctcgatctcctgaccttgtgatctgcccgcctcagcctcccaaagtgctgggattacaggtgtgagccaccacgcctggcctgaacctgccttttaacaagaccccaaggtgattcaaggcacatcaaagtttaagaagcatagatttacattatattctgtctatccctgcacatctcacatggttattcagcctaatgtccgtgtgagtcagtcttcctctttcttttcatgccttccatggatttcacctggtgtactcttgataccatctgtattagcctgttctgacaaggctataaagaaataccggagactgggtaatttataaagggaagaggtttaaataactcaaagttctgcgtggctggggaggcctcaggaaacttacaatcatggcaaaaggggaagcaggcaccttcttcacaaggcagcaggagagagagtgtgagcgtgtgaaggaggaactgtcaaacacttataaaaccatcagatctcatgagaactcattcactatcatgagaacaacatgtgggagacccccacctccatgatccaatcaccttccaccaggtcacctcccttgacacatggagattatggggattacaattcaagatgagatttgggtggggacactgccaaaccatatcaccatcctagtactggctgcagcttcctttaattactggatgaagaaacacaatcttttgatcaactagcatttccctgaagcacttgtaaacaattccataaaaatcctgagataggtacctatttgtgtttactcttgaactttccccagcctcctcctccccatccctgtcttcccacagctcaatacttccaccttccattgttcagtaccccgctgtgactcctgcctgtgctgagttgcatctatgattgactctcattagatgtgagctccttgagggaagggtcttacatcatccatttttataccttgattcccacccctggacctaacacaggtccttggacatagtaaatatttgcagaatttaattaagttattgagtcacattggaaataatttcagaagataccaaatgccttttctttttttttttccacatgccatttgttctcgtaccactaagaccctaagacttttattttgttgatatcaagtggtataaatattaacaaacattgtattatatatcataattttaactctgaagtttttaatttatagaacaaaagttaatatttctctaccaaaataaatgtcatagactgaggaaagaattttgttaatttggtcataccaaaaatatttaacattaatttctctcctcaacttctgactctgctgctccttaactctgtaaccatgacttacctgtcaaagccaaaactcttttgagcatttcatgagaaaatctataaagagtatatagcctacaataatagctaacatgtattagctgtacttacagtgtgagccaggtactttttattctaagtactttacatatagtctcattttaaaatctcctaatgactccatgaggttgatattttgttcttcccattgttataggtgaggaaacagaggcacaggctacagggtattttgtccaagataacacagctaataaagtggtgaggccaagatttgaacagtctcttcttaaagagcctgcctcctgaagggttactgatgaattcctttcttccttcaaaatgcttcatgtgatttaacatgccttatttcattgtgtatattaaaggccctttgtttatacattactctcatctatatttccccatttggccaatgcattgtataaattaggtgatctgtaaatgattgttggctaattgatcctatgtgcatacatgggaatacttggaaaagcaatgattgttttaatataacaagttcttgatgtagcaagattgttcctatacattgtggaactctcaattttaatatttactgactccattatccatcttaaaatgggcatatcggaaagggtaaggaataaataattgatggtggtgtcacacatctagtaatatgatagttgagctaatatgaattggttctcccaccatctcaaacacaaagaaatataaaagtcccctccagaccaatgcagagccaaacccaaactcaaaagcaataaaggaaatgcccttgtgccagaaataaaaagggaactcaaagccagaagtataaacaagatctggtgctaaggtctagacctgtcttaatctgttttgtgtggctgtaatagaagacctgagactgggtaacttataaagaaaagatgtttatttaggtcacagctctgtaagttgggaagttcaagggcatggccctggcttctggtgaagactttcgagctgcatcaaaatatgatagagaaagtcatctcatcttgggccatgtgtatataatttaattttaataactaatataaaattattgttaaaatatggtagagaagatcaaaggggaagcagatctgtacaaagaggaaaaacccgaggggtatcctggctttataacaacccactcttgagtatactaatccattcccatgagaactaatccagtcctgccagagtgagaactcgctactgcaagaatagcaccaaactattcatgagggatccagctcatgaccccaagggctcccactgggccctgccttccaatactgccacagtggggatgaaatttcagcatgagttttgctgaggacaaaccaaccatagcaagacccacttacaggctttaataatgggagataggggtcttaatatccacatggggaaaagtgatatgatcttggcccacgtgagtgaaggagtctaaacgaaaccttgacataaagtctggaaccacaaaatttggccctgcccttggaaacaagagcagagaaattctacctagtgactaaggaaaaccttaagaaagtttgccatttgtccatggctaaaataagaggttaagagggtacccatgagaagattaaaatccagatttatacttccctcagtgcatcatctaaatttacaccactgtgtaatgccgatttatcaagctgaaaaattaatatgaaaactgtcctggaggacttgaaactcctaagtccccagaaaaaataagtagcctgtaggtagactttcacaactcagaaaaaagccaaccccctcctcaaaagacaagcctatgatcaaaaattacaaattacacaggaaaagacccagtaggagaataggtatcccccaaactggagatgatagaacagtctgaaataatatatactaaatatgtttagaataactaaagaaaaacaggtggaatagaaactagataatagaaaaatgatagtgtgaaaaggatactgtaagttctagaaatgaaacttagagtggaattaaaaattcagtgaatgaattaaacatccagtaaatgcaactgatgtaaggactggaaactgcaaaataggtgtgagaaaaatcagtcaatgcatcacagagagataaaaaatggggaatatataaaaaccctccaaggacccatagatttggaaactgaaactcatattttttcaaagaatttacagttcaaagaaaaaaatcacaacatagatttataagatatttagaactaaacaaaagtaaaaataccatataataattcacaggacatcaacacagaatttagaaggaaatgtcttatatgcatatactgaaaaacaaaaacaaagctataattccagcactttgggaggccgaagcaggagggtcagttgaggccaagagtttgagaccagcctaggcaacacagtgagaccctgtctctacaacaaaacaaaacaacaacaaaaaaactcacaaagataatgataatgagctaagcgatcaactccaaaagggagaaaaataacatagtaaacctttaaaaattagatggaaagaatttattagataagagcagaatttagacatatagaaaacaaaatagggaatgtgatatggaatactgaacagcactttgaatgaactggatctacttgtattaatattaataaatctcaaaaacacaaaagaatttcaaaaacacaaggcaagagaatacatccagactgataccatgtgagttagatttttcaagcacaaactgacgtgagtagtagatgtataaaggcatggacaaaaagtaggctcaaattaagtgattatctaatctatctaagagaagatggaattggggaggatgcaatggaccctcaaccataatgttttatttggaaaaaaagatctgtggaggatttgttcagtctgcgtggtggatgtatacatgtttatgtatttttacttttcattgaaacatttcagaatactctttcaaagaatcaataattcagattctgtatactgaatagaattctaacaaaattacaattaagaaataaagttaatgccagtgttgcatgaggtttttactcatgtggtttggttgtagtaagggatctacaatagttgtagtaggcagttctgagacggcacccaagattgctacttcttggcaaacataccctgcataatccccttactttaagtgtggatatgatgggatttcacattcataattagattacattctttggcaaaggtaaagagacttttgcaaatgtaattaaagtccctaatcagttgattttgagttaatcaaaacagatgatcctgggtaggcctgacttaataaagtggaagcccttaaagagactgggcccatcctgctgactctgaagagggaagccactgtgttgtcagagggccacatggcaaggaacagtaggacttgcaggagccgagaggagcccctgttgacagccagtaagaaatcctacaactaccaggaagtgaatcctgagaacagcatcatgagcctggaagagaaccctaagctccaggaaggaatacagcctaattgacaccttactgaagccttgtgagaccctgagcagaggactcagtgtagctgtgctcagactcctgatccatggaaattttgaaatattacccgtgtgttgttttaagctactaaatttgtggtgatttgttacacagcaatagaaaactaatgcagtagctctatctaccctgttgtatgaaagcagtttgtaaattgacatgctatataaacagtgctggttttgttatggcattgattattcacattttatctgagtactatgatcaatacactagactgttatggtatactacatttgccattctgctataccttctcttagagcacaattttgatggagataatcaaaccaggttctcattttagataaaatttccacaaaagatctacagaaattgtttctaagcttatattacaaaaatggcagcacctatccaatgctaatgtctatgcgaacatctctattatatggagtttgagttttgagaccattttcttaccgttttgaagccatactatggggctcacttcactgatctagtagatgttctgggtatctgtcatggcaaagtggtaagtcttctgaaaagaagtggcatctcaacttgaactttagaaaatgcaagaaataaaaccctcctgaagtaagaccaggagcacatcagaagactcccttattggggtcacaaactaagaacgaaagaatacccacctcttgttactcagcttattctgtgcatgttatcctctgtgtttatttccctctcgtcaccccctagtttttagtaaagtctcatttaaaccttctagtgtagcttctgttatgccagggatattaggagcatggacactttgatgcataccacgatgcggtgatgacagtgctaattgatcagagtctccccaagggaaagacatctgcaggaacaagacacaaaactgtacagcccacctccccttctcacaagaagatacttcctgcatggaaaatcttggaggactggagtttgattttattaaaaatgcaagttaggaggtgggcacagtggctcatgcctgtaatcccagcactttgggaggccgaggcaggcagatcacggggtcaggagatcaggaccatcctggctaacatggtgaaaccccgtctctactaaaaatacaaaaacaaaattagctgggcatggtggccggtgcctgtagtcccagctactcgggagactgaggcaggagaatggcgtgaacccgggaggcggaggttgcagtgagccaagatcacgccactgcactccagcctgggagacagagcaggactccgtctcaaaaaacaaacaaacaaaaaaatgcaagttagattttcttatagtttgagagtattctggtttaagaaggtgggaagaagtaaaattggttgaggatctaaggtataaagagatgataccagaggtttgataaattgagccctaaccttaacagtacatgcttctcagtctacattccgagttggctgtaatatatgcggcctcatccactcttacctttctttgtgacactgatacccttatcaacacacttcatccacgtctctttcttgtgctctatacacacatatccgtgtcttcattaagcatcttcccctcagtgtcccatccaaaactgaactcatcatctttagaactatccatattacccactttggtaggtatcaccatccaccctgttacccaagctagaaaacaagaaccccagaacttcactttcttcctcatctctactgccttccaccttcagacatataatttatcaccaaatactaactcgtccacctcctaaatttgttccccttctccactctttaacaccgctcaccttggatcacagcagccacttacaggattcgcacactgctttctaatgcaaaactccttccaatgaaggagtaaatcctccagaggcttcccactgccttcaggatcagcttcaaatccttagcttggcgtatgggatccttcaccacctgcttcttcttacttgtgcagttacgtacatctacctaattatgggccacactgaattgcttgaagctgtttaaatgtgccaagatatcccagatttctgacctttaagcctttgcagtagtcttacgaattcatactcgtcctttcccagacaaatgtctctactcttttgatgaaactgtactgtcttccatccttaagggcaggggacatgcatccagctgtctttgtagtcacacagtgtgccatgatgcctatttctgtaggtgctcaataagtgtttgatgtgtatttattaggataatatacctatgtatgagtgaacaaatgaatatgcagatgaatgaataagtgtaaggaggaatgaaggatgaattagataattaaaagcctctgccatcagtcaaaatgaaactttttttgtgtgtgtgtgtgtgttgtagagatggtgtctcattatgttgcccaggctgatctcaaattcctgggctcccaccttggcttcacaaagtactggaattacaggtgtgagccaccatacctggactcatttttaaaatatatatatacttgattacttcaccacaatagtgtccttttgctcatggcccatgggcctagtcccttttagagttctcagtcacctgtaagatacatgccttgaatgctaccaggtgataaatttgagttggacaatgaagaaaatattgtacatgtattttcttatttatttagaccaaataggctgagagagtaacttgaatatttaagagcttccttaaaatgcaccataaataatggaaagtgaatgacttgattacttcccttatttttctcttatttttatttgggttgataggaaggaggaggtttgtggagggggagaaaatataaaacagtggaacatgcaaaaagagggcccaattcttccctttctctcaatttccatgatataactaactctgatctctcatggtgggcaatggaatattgtggataaagtctggataactgaattgtcaaaaccctccaatatggaccactaattaaagcactgaaagcacaactaagtgtactcagtatgttaatgatgcagaatacaatgtaacctttgattcaggagcggcttcaagatccaagcgtcctgggagaagcagcaatccctcttcctgggcgcagagatgctggtttaacacagtcatgtgtcagagaaaactagtttttcctgcaggcccaaatcctaccctagagaaacccattagacctttaccaaaatcaacttttcttctgagtcagaccgaattcttaattgtaggtgatagaccaaaagggaaagatgactcaatgtaaataatcgttgctattgacaaaacagtgcaaaccacatttcctgttgatggtggagtcacccatgacggaaaacatttttattgctttaataacacaattatattattttttaactcttccccttcaaatcctctagcacttaatatagtgcttgggatatatttggatattaataaatgcaaaagtgttattgcctctttttgaattaacatactacaaagaatgtgtttactgtactttcttaccttaaaacttaaacctaaaaatgtatgctaatatgaacctttgcttgacatttcatgcttgcctctttggtcgctaggaaaagtcagcaacattcagcaaaactgtcaaggattggagcatttaatagttggctgatggtccacaggcaagtccatccaaacagccaaagttgtattactcagtgtttttaaaagatgaagatttggggtggagccaagatggccaaataggaagagctccagtctacagctcccagcgtgagtgactcagaagatgggtgatttctgcatttccaactgagataccaggttcatctcactggggagtgtcggaaagtgggtgcaggacagtgggtgcagtgcaccgtgcgtgagccgaagcagggcgaggcatcgcctcacccgggaagcacaaggggtcagggaattccctttcctagtcaaagaaaggggtgacagatggcacctggaaaatcgggtcactcccaccctaatattgcacttttccaacggtcttagcaaatggtacactgggagattatatcctgcgcctggctcagagggtcctacgcccgcagagactcactcattgctagcacagcagtctgagatcaaactgcaaggcagcagcgagactgggggaggggcgcccatcactgtccaggcttgagtaggtaaacaaagcagccgggaagctcgaactgggtggagcccactgcccctcaaggaggcctgcctgcctctgtacactccacctctaggggcagggcagtgccaaacaaaaggcagcagaatcctctgcagacttaaatgtctctgtctgacagccttggagagaatagtggttctcccagcacacagctggacatctgagaacaggcagacagcctcctcaagtgggtccctgacccccgagtagcctaactgggaggcaccccccagtaggggcagactgacacctcacatggcagggtaaccctctgagacaaaatttccagagaaatgatcaggaagcaacatctgctgttcaccaatatccactgttctgcagtctccgctgctgatacacaggcaaagagggtctggagtggacctcaagcaaactccaacagacctgcagctgagggtcctgaccgttagaaggaaaactaacaaacagaaaggacatccacaccaaaaccccatctgtacatcaccatcatcaaagaccaaaggtagataaaaccacaaagatggggaaaaaacagagcagaaaaactggaaactctaaaaatcagagcgcctctcctcctccaaaggaacgcagctccttaccagcaatggaacaaagctggagggagaatgagaatgacgttgacgagttgagagaagaaggcttcagatgatcaaactactctgagctaaaggaggaagttcgaacccaaggctaagaagttaaaaaccttgaaaaaaaaattagacgaatggctaactagaataaccaatgcagagaagtccttaaaggacctgatgaagctgaaaaccaaggcacgagaactacgtgacaaatgcacaagcctcagtagccgattcaatcaactggaataaagggtatcagtgatggaagatgaaatgaatgaaatgaagtgagaagagaagtttagagaaaaaagaataaaaagaaatgaacaaagcctccaagaaatatgggactatgtgaaaagaccaaatctacatctgattgttgtacctgaaagtgatggggagaaaggaaccaagttggaaaacactctgcagaatattatccaggagaacttccccaacccagcaagtcaggccaacattcaaattcaggaaatacagagaacgccacaaagatactcctcgagaagagcaactccaacacacataattgtcagattcaccaaagttgcaatgaaggaaaaaatgttaagggcagccagagagaaaggtcgggttacccacaaagggaagcccatcagactaacagctgatctctcggcagaaactctacaagccagaagagagtgggggccaatatgcaacattcttatagaaaagaattttcaacccagaatttcatatccagccaaactaagcttcataagtgaaggagaaataaaatactttacagacaagcaaatgctgagagattttgtcaccactaggcctgccttacaagagctcctgaaagaagcactaaacatggaaaggaaaaaccggtgccagccactgcaaaaacacaccaaattgtaaagaccagagaggctaggaagaaactgcatcaactaacgagcaaaataaccagctaagatcataatggcaggatcaaattcacacatagcaatattaaccttaaatgtaaatgggctaaatgctccaattaaaagacacagactggcaaattggataaagagtcaagacccatcagtgtgctgtattcaggaaacccatctcatgggcagagacacaaataggctcaaaataaagggatggaggaagatctaccaagcaaatggaaaacaaaaaaaggcaggggttgcaatcctagtctcggataaaacagactttaaaccaacaaagatcaaaagagacaaagaaggccattacataatggtaaagggatcaattcaacaagaagagctaactatcctaaatatatatgcacccaatacaggagcacccagattcataaagcaaatccttagagacctagaaagagacttagactcctacacaataataatgggagactttaacaccccactgtcaacattagacagatcaacgagacagaaagttaacaaggatatccaggaattgaactcagctctgcaccaagcagacctaacagacatctacagaactctcctccccaaatcaacagaatatacattcttctcagcaccacacctattccaaaattgaccacttagttggaagtaaagcactcctcagcaaatgtaaaagaacagaaattataacaaactgtctctcagaccacagtgcaatcaaactagaactcaggattgagaaactcactcaaaaccactcaactacatggaaactgaacaacctgctcctgaatgactactgggtacataacgaaatgaaggcagaaataaagatgttctttgaaaccaatgagaacaaagacacaacacaccagaatctctgggacacgttcaaagcagtgtgtagagggaaatttataccactaaatgcccacaacagaaagcaggaaagatctaaaactgacaccctaacatcacaattaaaagaactagagaggcaagagcaaacacattcaaaagctagcagaaggcaagaaataactaagatcagagcagaactgaaggaaatagagacacaaaaaaacccttcaaaaaatcaatgaatccaggagctggttttttgaaaagatcaacaaaattgatagactgctagcaagagtaataaagaagaaaagagagaagaatcaaacagatgcaattaaaaaatgataaaggggatatcaccactgatcccacagaaatacagactaccatcagagaatactataaacacctctacacaaataaaccagaaaatctagaagaaatggataaattcctggacacatacaccctcccaagactaaaccagcaagaagttgaatctctgaatagaccaataacaggctctgaaattgaggcaataattaatagcttaccaaccaaaaaaagtccaggaccagatggattcacagccgaattctaccagaggtacaaggaggtgctggtaccattccttctgaaactattccaatcaatagaaaaagagggaatcctccctaactcatgaggccagcatcatcctgctaccaaagcctggcagagacacaacaaagaaagagaattttagaccaatatccctgatgaacatcgatgcaaaaatcctcagtaaaatactggcaaaccaaatccagcagcacatcaagaagcttatccaccatgatctagtgggattcatccctgggatgcaaggctggttcaacatatgcaaatcaataaacataatccagcatataaacagaaccaacaacaaaaaccatatgattatcttaatagatgcagaaaaggcctttgacaaaattcaacaacccttcattctaaaaactctcaataaattaggtattgatgggacgtatctcaaaataataagagctatctatgacaaacccacagccaatatcatactgaatgggcaaaaattggaagcattccctttgaaaattggcacaagacagagatgacctctctcaccactcctattcaacatagtgttggaagttctggccagggcaatcaggctggagaaggaaataaaggggattcaattaggaaaagagaagtcaaattgtccctgtttgcagaagacatgattgtgtatctagaaaaccccattgtctcagcccaaaatctccttaggctgataggcaacttcagcaaagtctcaggatacaaaatcaatgtgcaaaaaatcacaagcattcttatacaccaataacagacaaacagagagccaaatcatgagtgaactcccattcacaattgcttcaaagagaataaaatacctagaaatccaacttataagggatgtgaaggacctcttcaaggagaactacaaaccactgctcaatgaaataaaagaggatacaaacaaatggaagaacattccatgctcatgggtaggaagaatcaatattgtgaaaacggccatactgcccaaggtaatttatagattcaatgccatccccatcaagctaccaatgactttcttcacagaattggaaaaaactactttaaagttcatatggaaccaaaaaagagcccacattgccaagtcaatcctaagccaaaagaacaaagctggaggcatcacactacctgacttcaaactatactacaaggctacagtaaccaaaacagcatggtactggtgccaaaacagagatatagaccaatggaaagaaataatgctacctatctacaaccatctgatctttgacaaacctgacaaaaacaagaaatggggaaaggattccctatttaataaatggtgctgggaaaactggctagccatatgtagaaagctgaaactggatcccttccttacaccttatacaaaaattaatacaagatggatgaaagacttaaatgttagacctaaaaccataaaaaccctagaagaaaacctaggcaataccattcaggacatcggcatgggcaaggacttcatgtctaaaacaccaaaagcaatggcaacaaaagccaaaactgacaaatgggatctcattaaaccaaagagcttctgcacagcaaaagaaactgccatcagagtgaataggcaacctacagaatgggagaaaacttttgcaatctactcatctcacaaagggctaatacccagaatatacaatgaactcaaacaaatctacaagaaaaaaaaacagccccatcaaaaagtgggcgaaggatatgaacagacacttctcaaaagaagacatttatgcagccaacagacacatgaaaaaatgctgatcatcactggtcatcagagaaatgcaaatcaaaaccacattgagataccatctcacaccagttagaatggcaatcattaaaaagtcaggaaacaacaggtgctggagaggatgtggagaaacaggaacacttttacactgttggtgggactgtaaaccagttcaaccattgtggaagtcagtgtggcgattcctcagggatcttgaactagaaataccatttgacctggcaatcccattactgggtatatacccaaaggattataaatcatgctgccataaagacacatgcacatgtatgtttattgcagcattattcacaatagcaaagacttgcaaccaagccaaatgtccaacaatgatagactggattaagaaaatgtggcacatatacaccatggaatactatgcagccataaaaaatgatgagttcatgtcctttgtagggacatgtatgaagctggaaaccatcattctcagcaaactattgcaaggacaaaaaaccaaacactgcatgttctcactcacaggtgggaattgaacaatgagaacacttggacacaggaaggggaatatcacacaccagggcctgttgtggagtggggggaggagggagggatagcattaggagatatacctaatgttaaatgacgagttgatgggtgcagcacacaaacatggcacatgtatacacatgtaactaacctgcacattgtgcacatgtaccctaaaacttaaataataaaaaaaaaagatgaagatgtttaatgtgggggaaatgcttatgacttaacattaaatgaaaattgctttttaaaaaaatcacatgcggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccacagtccggcctgggcgacagagcgagactccgtctcaaaaaaataaaataaaataaaataaaataaaataaaaaaaaaaaaaatcacatgctacaacatggatgtaccttgaaaacatgctacgtgaaataagccagatacaaaaggctgcatcttgtatgattacatttataggaaatgccagattaggcaaatccatagagacagaaaagtagattagtggttaccaggagcccttgggggtagggagaagtggggagtgactaacaggtgtggaattttgggggggtaatggaaatactggaactagacattggtgacagttgtacaacattgtatgttaaaaaccatggaattatatactttaaaatggtaaattttatgttatatgaatttgatctcaaaaaaaatttacaaaaaactacatatatagccattaaaaattatgagatatttcagcagaatacagattgtaaataattttttaaattataagagataatacaaaagacaattcatttgaaatgtttagttcaaggcctgacatatagtatgtgtttagtatatctgagacaggtctcagttaattaagaaagcttattttgccaaagttaaggactcacctgtgacagcctcaggaggtcctgaggacatgtgcccaaggtggtcagggcacagcttggttttgtacattttagggagatatgagatatcaatcagtacatgtaagatttacattggttcagtccagaaaaggcgtgacaacttgaagcaggcaggcagcttccaggtgacagttaggtaagagacaaaggttgcattcttttgagtttctgattagcctttccaaaggaggcaatgagatataaaattatctttgagcggagggataactttgaatagaatgggaggaagatttgccctaagcagttgccagcttgacttttccctttagcttagggattttggggctccaagatttattttcctttcacagctgcaatatataaggaaaaatagaaacaatacaaccttggatgtatttgagttgattagtttgtggatgaatttttgcatttatttttattgcaggcagagctgctataatatattgccagtatagtaaatactttatttaaaggatttgaaaataaaaaataaaagctttatggactccagcatctgtgctttgagccggaattcccgtgaagagcctgtattggtggagctactcagctctttagggaggcaggaagagatgagaaagggatacagattattacagcctaagggcaggatggagaaactatccgtctatttatccactgaatgcatgtagtcatttgtcagtaagtgttcttctaaacttatttactcatcatcaacgttcatcttagattagctcccaaagggcaaaaagacacataattaatttgcttaatgtagtgcctagcatgatgacatggtgagatatgttttagcaataattaaaaatactttttcctttgccagtaattcttatttaatcaagccaaaattaatttacatagagaactactctatggctttcatttaaaaaaacaacagatgatttcaatctcttttctgcaaataccccaaaagaagaacaatgctgttttcataaatcttagtcaaatgaaactcagctactatccccaggttaattttataactgtaaaaagtgtgtgtgcataagaacaaaggctggttaggacctggaaaaaacgagagagggagagatagactgatgtaatgatatgtgacttttttgttcttttctgattcccagtattgtttcctgaacaatattttttttataaacttagcaacaaaaaacaaatcacttcagaacctctgagacaaggctgtggactggcagttgttttttgagacaacatggaagaaatgatattctgtgcatcttctcttttaaactttcatctttgaacttaaagatgatccctagctgagatcatgggtgttttcctcccatgtttctttctttgtgttttaccaacttatttatttatttattttttgagatggaatctcactctgtcatctaggctggagtacagtggcatgatctcggctcactgcaacctctgcctcccaggttcaagcgattctcctgcctcagcctcctgagtagctgggactacaggtacacaccaccaagcctggctaatttttgtatttttagtagagatggggtttcaccagcttggccaggatggtctcaaactcctgacctcgtgatccatctgccttggcctcccaaagtgctgggattacagccatgagccactgtacccgaccttaccaacttacttatatttagcataaaagctggagaaagcgatagggacaggaggcagagaaattctgggcagaagagggcagtccccagcaagggcctcactctgaagcctggacccatggcccaaagtgagaacatacattcttgttttcctgctcaaatgttgccttttccaaaaccacccatggccctcctgccacccatcatgtgcccataaaaaccccagtctccaacagcagagaaaggagaagaggagaagcagctagacattggagagaagcagcttgacttcaaagggatggcttgacagtgttacctcagggaggagtctggccagggatggccagactctgggggaagattatcccgctccatccccttttcagctcccctccattgaaagccatgttcatcagcaataaaatcctccacattcaccacccttcaattcattcatgtgacctgattattcctggacaccaaacaagagctcgggtgccatgggtgaggatgctaaaggctgtcacactgaccctgtgctctcggtagagagcaactgtctcatgcaaaaaggcagagggcccactgaactgttgacacttaagccgtccgtggatggcaaaagctaaaagagcgctgactaaaacacatgccctctgggccttcaggggtaatgggcacccactagacactgcctcaggactctgcacggagttcactccagctgatgcccagaagcactcaccctggctcctgtacctgctcacctgtggactcccttctgcaaggggtgaagtgcaacgggtccaagtgagtggagtttgcccctgccagtgacaaagcggccagctagatccagcacccgtgcactgcagttcccacctgcaacggtgtcagggaaatttcctgcttcaaaagcacaggcagctttcttggaaatgagataatgtgatctcattttaaagttgaggacatcaaggctcagaggtgattagaggcattagaagggacttctgaagacagctaatctaacccttgaaaataggagaagttaaagttatggcccaggttccacacctcacaattggtggaaccaggcttgagcctgcttgcctaataccagtgtccttcccaagcttcccaagcatctgcttgaaattacctgtgtctgtggtgggaaggaagcgcaagaatggtgtcctgtgtccattgctggggctttgggggtccaggtacttagtttacttttgagaattccttgttggctctgctgaagtccttcctgctacaccgttcagggaaattgttgatcttgtcaacctgaaataatcaaaaggatcagaatccagttttaaagagtttattcaagcaaaaagctgggaatagccatccaagaatcatggactctagagaaatggggtcagtgcttcgaagttaaaagttaagtacttgcttctatacagcaaacaaagaagtttagtaggattataatattttctatacaagcctggtttatgagtgacaatttagttcgtttgttttcttttccatacagcttgttttcgtttcctttccaatttaaaagcaagtatttaacattccatcctagttagtgtgataaccatgaagcctttgtgtgaaagaggaaagagggaggctagtctataatgaagatccatacttagagagaaagggtcttccctggcaccctttagtaatttataacactttaccaaacaatgtaggtaaggaaaaggctaatctataatcagagaaacaaaggttacagctgcctatttatgtgactcaggttccataatcacattcccttaaggctcaaaataaagtttcaacggctgagattttcaattatttattttcacaatctttacctttcttagttctgggagtggccttaccaggtgggcctggcctgcgtactcccagaagggcagttattcctagcagcctttggctttgggaacctctccataattcttaatccagcccaaggttctgactctgttaatgggtaaagaaaggttatgccctatgagactctgacctcttcttgggacctggaaaatcttctggtgattttcctcatcccgaatctgctgtttctaaactgcttgagaccaagataaagcacaccaatttacaaggcataactcctaggtgaggtcattcactagccatttcttgtatttgagggtctcagtgtgacatcccaacttcatttccagcactagattggtatttctattcttctttttagaaaggaaaggagaggggaggggaaaaggaaagggagagacacggagggagggaggaaggaaggaaggaatattggagtacaatttgtggcactcaatttcaagaacaagcttgatagaaagttgtaattgccaaatacagtaacctacttggggtacatgtcaccttttattgctttcaagctactgtacctggcaactcttatttctccctttaaaaaaatcctgtatctggctaaaggctgaaaaatagcaagtacatatctttctaatgaccctacattaatttagcatagagataattagaggcacagttaatcattagtaatataagccctgagattggggcacatgggtttctcttgctattcaacagagtccttgtgtggctagtgtttgagtacagacacatctttattttttacatactgagctttctttgacatacaagccaaaaatttacttgaagcaacctgaatagtatgagagagaatatttgttttttaaagtcctgggaattacagcgtatccttagggcataatataggtatgttcatatagaacagctgaacacaggcagtttataaagcaggaagtgagcacatcgtactttttaaatttatttaaaatactttgaattcttggtgttcttatccattcaagagtctctaacactagggttgtaaaatagaaaccaaatagcattgataatagagttttgtttcatctttgtcttagctacaatttgggaaatgtttatatgtttgttccaaaaatgatttaaaattgtgtattcacaatgcagtagtgtgtaaacactactgaatcaccagaaatgcatccagtagtgcatgcacaaaatagagatcaaggcaaaggtagaatagggaaataaaattaagctaaggataaggttagtatacaaaatgcatcttgtgaggttcatctatttggtctactagtgggcatgggaaggatgcctgaatttaaatgaaaattctagtactgattataattcacatattctttcattgccctagagtttttaattgtgcccaaataagtcttggtattcacaaactaattacttgagtttttaggttcacataccagtgatatcctccttgaatctttctgccacttagtcattttacttccaaatatcatgacatccaacagaggccgatgaaggaaaaaagatgcaaaagtcatcccatttatttttctgccttaaaataagagtgtgtatattgggagaaggaaagggtaaagcagttagatgttattagaaatacttggaagagaatagaaataaaaatttgtgatttttagttattaaagtcatcattaaattgtgttatccatacaactgaaggatttcaatatgggcatcttgttaaggaaaagctttcagagaatggtaacatttcttaatagtgaacatgtccctacactcacataattataagacttcatgtacaaggtactcaaaatcagaaactttgtaaaaagccttttaatcagataaacctgaatatatcattatctagaaataactgaaaagagtgcaaaacattagagaacagtcatttgataatatggtaaataaatcaataggctattatattcctattaaaattataaaagttgcataaacaggaaagattatacaaatataccataaaaagtacttataataaaaatatgagaaaaatacaaactgatatgtaaactataaaatatgtaaaatagccaagcatggtggttcacacctgtaatcccagcactttcggaagtcgaggtgggcagatcacttgaggccaggagttcgagaccagcctgggcaaccgaatgaaaccctctcaagaaaaaaatacaaaaattagctggacatggtggtgcgcatatagtcctagctactcgggaggctgaggtgggaggatcgactgagcctggaaggttgaggctgcagtgagccgagatggtaccactgtactctaggctgggtgacagagtgagaccctgtctcaataaaaataataaaatatgtaaaatatctctgcaggtagaaaaaggtggtgtgtgaatgcaaaagagttatactggattgactaagatgattttttttctcacagtattctttgatattttgtcataataagtgtaattgatagcgaagaaatgacaacaaagctttcatgtatagaatactttttacagatttactgaataatgtgtactttctgttcactgtcttttaaaatataatttcagtctagattttacagactcatgggaaatgatctaaactatttttcttgccattaaaatgtgcatttgggagtatttttccatagacatagatacaggagaactcaataatgttcctcttccttctttccaactcttgttttccttaggcattaccacaggagtcttggttcgagaacacagcaacctctcaactctagagaaattctactttgcttttcctggagaaattctaatgcggatgctgaaactcatcattttgccattaattatatccagcatgattacaggtaccttgagaaaacagatgttctctatattagtccattttcatactgctgtaaagaacttcctgagactaggtaatttataaaggaaagaggtttaattgactcacagttcatcctggctcagaaggtctcaggaaactcacaatcatggcggaaggcaaaggggaagcaagacaacctccttcacaaggtggcaggaaggagaaaggctgggcgaagcaggaagagcccgttataaaaccataagatctcgtgagaactcactcactatcacgagaacagcatgggagaaactgccactatgattcaattacctccacctggtctctcccttgacacctggggattatggggattacaattcaagatgagatttgggtgggaacacaaagcctaaccatgtcattctctatgattatttaaaaagctttcacctaagttgttcttttctaattacgggaaaaattgaaatacattagatgtctctctctctctctctctctctctctctccacctctctccacttggaatgtctatatttgcttctgtggaaacattttactgttctcaacatggcattgctttgtcatatgctgtgcctacagctctgtccaccactgctcaaatcttcatttgaccagcatgtgatgtcttgggaggaaaatgtcattttcaaacatataaacaaaacgttatctggggcatgggaaaaaaaagcatatttggtcactgaaatgtcagctagtgtcctcaggaaaaatatagttgtcaattttgatcatgttttcagccattcactcatttatttcccaactgcagctgtgctgcccccagcctctcagcagctgccttcagggtctctgcactccttacccactttctactcaaagccagaacttgctatgtgtctgccctgcatatttgctgtggggaccagcagtcaagttctgtgagaagggtttaaatatggaagtgcaccatattcgaaaagcctagtatttttaaaacttgtgacacagttgcatttggaaatgacttttcccttattgatcattacattgcagggctcctttgaagaggaagcttccttaggtagatagagatgaatttggtttacaaaaatgtcatttgtctggctgtgataagtttctctgcattgcagtttcttgtacttaactctggcaattagtaaaatgtggcatgacagtagctggtggtgttagattgaaaatcaaggttttatgtaaacatgcaattagaagtcgtgacatgtccccttctagaacatttttctccactgccactgtaaaggtctgggactggccctggtagagtactggacgttggtgggggcacgggagggtgggggtcaggatctgctgcattcagggactgcattgcttgaagagctgtcacatttggcctttgaatttcccaaatgccaaactcgaattagactagagtcccttgggagctttgtccttaaatggtcttgatgttctcggcttatgagaaacctaaagagaacatttaattatttttatgaatgtatttaattacgtttggaaatgcctggttccttttaaccctagcaacctgattgacacagccgcagaccaattatttgtcccatgtaatatttgtttatttgtttaaattgtcataagcatttaaaattggaaagatttcatgtaaatatccaaattgctggctttctctgaaaaaaaaaaatgaagatctgggaacactggcccagtatttccacctatcaacggtggtctgaaaccaagagacaactactccatttagctggagcaaatgcatttgagaatgccatagtctccactactcccgattgcccagtactttgtccacttcactcttacgttacctgcctggccgccgtaaggatggcagttataatcccttagaatcttctccatatcaaagattctttaaaaaaatgtttttaaacatggggtcttgatatgttgcccaggctggtcttgaatttctaggctcaagcaatccacccacctcaacctcccaaagtgctgggattatgggcatgagccactgcatccagcccaagattcctaattttttcttgggctcctttgagaatacaatgcaaactttggacttcctttcgagaaaaatcttcacaattgtacatatatactatattttgcacgcaattgcacaaggtgcataaaccacctgatgagcaatactattgaactcatgtgtctatgaggggaagtatagaagattgatccaaattatgcagcaaacccaaaactcgaggtaaaacaggttttagaagaaaaggtaaaaatacatgtatgaatgtctaattctgtaatatcagatgtttgaaaatacatgccactcttgacagtcaataacaagtgagttttgttttggtttggttttttttctgggaagtatagcctttggccagaagccagaaacagatacttcctctagtgagatttttgcagtctggatgttttgtgtgttagctcagccttgcaaataatctaggaaaataatttacaactcagcattccactgacatagcccagctacttttgaagctatagcatggatcaagtagtttctccacttttcctccaccaaacccccagcagccagtcaagaactagaggcagcgagcaaaaccaccaccccatcttttgatttggagcaatgaaatagtcaaagattcaagggatatgaacaaagcagggtggggacaatgatggcatatccatgttttaaattgtcagattagagggaaaagcaacaagactagtgttggcacagttataggaaaataagttcattcatacactttcagttacctaataaattggaacaaactttctggagaacagtttggagcatgttctgatctcttcacccagtaattctgtttctcagaattgatcataaagaaataatcagagatatgttcaaactcctaagtacaaggatattcatggtagcatttttttgtaatggtgataaattataagcaacctaaatgtatacaaatttatattgtatacatatgtatacaaatttatcttttatactatgtatacatagtatacaaattttcatactaagcaactattaaaaacttgtcttagaatcatatttaattacatgtgggaacattcccaatacagtataaagtgggaaaataaaattacacaacaggatagtgtatacaatccaaattttattaaaatgtatatacatttttaaaagttgtgatcaaaaccaaaaggttaacatccagaaagtaagaaaacatgatctgttctgctttctttacattttcaactgaacctgtgtttttgtttggtttgtatttttaatgaaagagatggggatggagtctggcctgagatcctccaattttgcctctggtcgcttctctgcctcatctctgctcccttcccctgccggctcagtgccacctttacctggtacacagctccttcctccagaccctgaagtagtcttcagcctccctacccagaagatggccgtggaaaacacacaggaagggccatttcacattgcaaatgccctcatgaatccagcaggctggtagcttaacgtatacagttattaggccgaaggaggatgcaggtgggaagctgaggagggttgaatgagtcccctaaggatacgtaaattagaagcagaaacacagctagaattcagacccaagattaataatctgtgctcctgcataaaggaaactctcttgccaaattaacaggtagaaaaaaaaattctgccatcaaagcctctggtgagattaaaaaaatactttatagcttttttaaaaaacaggaagaacccctttttatgtgatgataaggttaagaagccaaatttaccagggaaatttgaacatagactggctgttagatggtatcaataatttgttaatgattttgttagagatgatgatggcatatagttgtataagaaaatgtccttactttttaaatgcatatggagttatgaaatgacataatgtctcaaatttactttaaaacagaaaaaaaaaatggcacagttgatataaactcaagacattttcagagacaatcattgtgggtaccaatagaatcctaccgataaattacattgtgaagaacatgctcccgccctgctgaggaatatctgtgtttgggatctgctaacatttaggcttgtaagccgtatttatgtcaaagcaccagagaaataacaggaaatagcttatgaatatgcctgagaattgtggctctggaaaaatcctggtccagccagtgagtttaaattcaggtcacattttctttactacttcccaaaattaaactatgatgattggagcctcctatgaccaacacagggacagaacagcacctccagtcccgctcccagaggtcccctgagcatccttcccggatgctcataactttgctcaggaagaggttgcagctcttccactttagcctctgccacccccgcctgggccagaagcactccagtgggcacagctgcgcctcctggtgtctgctgtggctgccactaccccggtgacctaaggagttccgctctttgctcctccatcctaagacaggagcagaagcttaattctccaaagtgcagctgagaccacacttctactcaggacataatctttgctaaaggtaaccaaaagcagatgaaacaccaatggtgacatccaactgctccctgaaggggctcccagggcctcttaacagggatgcccctctgcttagctgcttgcctccaggaggctagagttcatctctaaaggtgttccaagctttcctgcaccccagatcccagaacctgacaccaagttctaagaaggaaaaattccgctatcacacaggccatcctgtcctgacctggagtgacctcttcctgggatgcttgccattgtggaatatccacttcagagaaaacccccctcacggccacagggggatagcctttcctcgtggaccccatcaggagccttccatagactccataccatagtacctgctgggttattgcaaccaccctgcttgtagaacctgggagtctgtccaggtcaggctgggccaagtccatgccagttcctgtgcacatttcttcctccagagcaaggagttgctcattcctaacccttcctgtgatgtcgcagctctggatttcctaaaaacgcctgctcaaacaagggcacacacagctcctcaagaaacagcaccagtttgcagctcagtggatgtcaagccaagcagatatcaagccaagaaaactccctcctttccctcctctctcccccaggccactgagtgtgagtcctagtactgattctgcttcctggacaagtcacattattaaacactagacgtcaggagaaaatatttgcgttttgtttatcaatgactttcagtttccaccagacactggttgggtgactggatttacaattgaggatcttctccaaagataaatttaacactctacccttggaagatttaaaaaacaaaaaatgctccagacttttagatgattgttactccagctttcatgttaggatttcaaaatttttagggcttgacctcaaccataggatcagaggttttctactactttttgttgggaaagggtgggaagacagggtctcattctatggcccaagctggaatgcagtggtaccagtatagctcactgtagtcttgaactcctggactcaagccatccttccacctaagccttcctagtggctgggactacgggtggcccacaccaccatgcctggctaattcttacttttgtcgcgatagggtcttgatatattgccagggctggtctcaaactcctggcctcaagtgagcctcccaccttggcttcccaaactgctgtgattacaggaatgagccaccacacctgccctactttttaaccaagtaaaaaagtttaaagccttataaaaccttaggtatattcagtatttattaaacaacagccagatgtagaatgcatatgtgagttggttgcctttcaagcaaggatttttctatgaagggcccaatagtaaatattctaggttttacaggtcctgtgtattttgcccaactacccaactctgtttgtcatgggaaagcagccacagaccgtatgtaaatgattgagggtgactgtgtgccaatgaaacattcatttacaaaaacaggaggccagccaggagctgacccctgcccagctagactctgacactccagatgcaatctagttgaggttgaatccaggtaacaaaataaactaccacatcaggcaaggagtatgaatgcactgaagagactgaagaatagagggtgagcagaataaagtgcagttggtgatagttttagagcaccttatttgtaaactcaggctttacagcagatgacacacttaaatctttggggctgaggaaggcttttttttaaaggctatgtattcatttactcagaggcagctgtgtatctggaaacaatcccacatcctcctatgaaaagaaccatgccacgtgcctccccgagacaaggttcagttttattcagctaacatttgttaactccagctgcatgaaaacagactaacagaaaaccaggtataagagggtgaggccctaccactcacatggtcatggagctgaggtcatctgatagtcaggtccaggagtccctcgttagcaagaattgcaagacttgaagacgcatatcactttgttgtacaacttgctattaaatgtaagctactgttcataaacataggtggctaagagcatttaatgtcaattttagctacgagggaggagtatgcattcttttcttgaaacattggtggtccattatacagtttagtttctatgaaaattgccattcaaggtggtttataaacttaaaactccaggcaggaagacaagtttgttgcctaagactgtacagtctgagagtgaacttcttgcctcatttgcaacatctggaaccagtgggctcttcatgcactttaagtgctcctttccctaagattatcaagaaatttgtgttgagttagaatacagctgttgaagccaaaggacttattgtatcaatttgatttctgaaatgcctggcctccaaagacaaaacgaccacatagtgtataaggaagagctcccataatgaacatgccatttgcaagtaataaaatgaatagtggcaagagataaatatgccctgctttagtctttcctgagacagtgaagcccagagaatcaaccatgcatgagccttctttctgactaaacaggtattagacttgttcatagctctgttcagctgtaagataacctgatttgattacttaaaaagggattctaaggaccttctatatattggaggcatggacctggaagaccattcgttcatttatttatttattcattctatctttaatgagccaggctctgctagacacacaaggtgtaaaattaagtcttatctcagcaagaaagagtacattacaatgctgtgtgataagcactttctgggaatgaggtcagtgcaggggacattggaaggagccattttgaaggaagcatagaaatcaagtgaaaggaagagggtgggtattccaggcaagagaaaatagcatctttgtcctcccaaaatagcatcttgggaggacagtgagacttgaagtgcgatgctggaaacgtgggcaagaggaatgggatggaaagggggagcacaagggtttactggcctcgtgtgccttgccaaggggactggacttgagcctgcaggcgagggaagcaattctagcagtgactcccacctgtgccattctctacagagggacacctgaataagtatccatcctagaggggcaagagagtccagtggttaagagtacagacaggagccacactgcctgggtttgaatcctggttctgccatggattagctgtgaaaccttggattttacttaacttgtcctcagctttaaaatatggataataataatgtttcatagaacatctagaatgccatacaatttttttacttactcttttttgtctgagaccttcagaagttcctataaagtacctgaactggcagcagaatctacagggccaatatcagaattgagctacgcagatatgaacacactgaatgcattcattctggaaatgagaacaatataaaaagacttgctctgccatcagtttgtaaagttcaccagcatgtaagaagcttttgcctagaagtccgagataccaattttatggataaagagaagcaaagagacagctcagtcatatttaggttgtggcaaaaacccagaaaagtctcactgagccattagctagctgctgctgtcagagcattcatatggactttggaaaagaacagttgagttcctcagattctttggggtatatttaatgcttttactggacaataagttcagggagtcaaaaagttcatggagtcttctgaaaaactggtcctaactacaaataccaccgtgttccatagtaatgaaaaaaatgttaaaacagctcctggactgctgaaaccaggacacagcccaccgcttctttttttttttttttttttttgacagagtctcactgtgttgcccaggctggagtgcagtggtgcgatctcagctcacttgcaacctccacctcctgggttcaagcgattctcctgcctcagcctcccaagtagctgggactataggtgtgtgccaccaccaccggctaatttttgtatttttagtagagatgaggttacaccatgttggccaggctggtcttgaactcctgacctcaagtgatccacttgcctcagcctcccaaagtgctgggattacaggcatgaaccactgcacctggagagcccactgcttcttgatgcatgttttgaacttcaaatgtggaccagctgacagaggcttcaaggggacctttagctgattctgctcaaggaccagtttattttgttaacatcaccaaatagcctagagtggtgatattacctattttaagagagttcttcatgtctctaagaaaagtagatgtcataggtgatgcatgcacagaaagattttgcatgctcctctttgcctcttcctttccctttgaacatccagggagtactaatcaaggctgcagagatttccctatgccctggattaacaaagtaagatcatatcctgccttgttttctctggggaataaaagaaacattttggaatttaaaaatcatgaacctgtttatttaatcctcatagcagccctatgaagtcatcaagtaggtgggaccttaactccatctttagagataaggaaacaggaggttgaagacagattaagccactttttcaagatcacacagatcataagggcagcagctggaactggcaagttttgttctggcaacactctgctgccaaggggccagagcctgggagagggatccagggcagtcagccatacttaaatacctgttagtcattcaatcagcatgtttactgagcatctcctatgtgctgggcactgagtatacattcgtgaacaagcagatagctaggtctcctgccttcatggagcttaaaacctagcaagaaagagatataaaataatgaaccaatgataaaaattgttgagatatgatatgcacaggatgccaagcaaggaaatcaggacaccctggtttagggtggataatcagggaaggattctgaggaaaggacttaaaagccaaatgaagagtgaggaagagcactccaggcagagggaagagcctgtgcaaaggccttggggtgggaaggagcttggtctgttccagaagaggctggaggaggggatgagacaggaagatggcacaaagaggggctggagaggcaggcaggtgcctcccctgcaaggcctgttggccaaggtaaggattttttctttttatcttcagtgccattgaagggttatcctgatgtataaaatcacctgatttatgtttttaaaggatctctttagtgaccgtgtaatgaaggaatgaatgagggagggaatgaatgaatcagttaatgcttgttgaataccttccatctgctcagtgatgcacatcatctttatcatttattcagtaatcatgcaggctatttactaagaacacactgtgttctgggcactgtactaggcctgttatagacattatttctaatcctcacaacagctacgcaagctgaggttgttcactttgttcctcacaattaacctaaaggcgatagaggcatttcagatcctccaatttatagatggagaagctgagtctgggaggaggctgggatttgagcccagtctgtcccaccaaagcccatgccttctctctgcacaggtggcctctctgccggtgacagagacaggagtcatccacatggcgagttttaactcctatgcaacaatgagtttcttggatgtggtgtccacttataatggcataacaccaccaaatgtcagacctaaaagaacttccaataaggggttgaattttgataccttaacagcaatgtggagagattgtcacgaaagctttgttctcagtgggtggttgcttaatcagagagctctaggaggagtcttttgccctcagatgtttatttttaaaacatgctattgtttagccaggcaactgcttcctttggagtgtttttgtaaaaagttcagatgattactgctttggctgggagccaacacccttgctcatcagagccttctcctgaggtgaaaaaagcaaataaatgcctttacctaaaataaagagctagcaggtgcccctgacttccaaggacaaccggggattttatccctgtttctaggccacagccgagcctcaaaactgtcccaggttctaatggataaccctgggttcacagggaactggaatcgtgctcttctttttctgcccaattcaggtgccacctgttccatcaagcctctcctgctcatctcaatctggtgacagttcaggctcctctgaaagcccacagtaactggtctccgcaccagggcttcacaaaacatctagtttttaaactggatggagcaaatccagttgttaaaatttctgatctgttacagatcaataaccttcgtaaactatagttagagcaaattactagaaaagttatattaaaaatagacatacaaaatactagccctatttttttttttttttgagatggagtttcactcctgttgcccaggctgaagtgcagtggcatgatatcggctcactgcaacctccacctcccaggttcaagagattctcctgcctcagcctcctgagtagctgggattgcaggtgcacaccatcacacccagcaaatttgtgtgtgtgtgtggttttgtttttgtttttttgtttttttaagtagagatggggtttcaccatgttggccaggctggtctcaaactcctgacctcaggtgatccacctgcctgggcctcccaaagtgctgggattaccggcgtgagccactacgccccgcccctatcttttattattacattcaacagaaataaagttactgtccaattactataaacattttaaatactcactgttgatttctgtgcagatgccatcacacctgcttagttcattctcatttatcaccccctataggacagctttcaactcccaggagaaacgagttctgatagtgaactgtaaagagagggggtccttcagacctcgccagccaccaaagatggcctgagagcaagaaacccgggggtccattgagaataaaaactcagaactaaagggcaaatgaggttttacttgtttgggactaagttgggcctgatcttcgacgtcaacgccagttaagagtctaatgcctggattctcattctcacagtcaacattcattgcgctagaccacaagttctcaccaagacaatatcgtccccaaggcagcaaaagctgtttttatttggtggtggtgagttgggggagaaaatcttactctttttatgtaaaaaaacacatgtatcatttactatataaccagatatacagtttgcggttttagaatttcagaggggtggtgattaggaaaacggctttggggggtggttttgcacaacaacaacaacaataaaacaaggttgaaaaagactgagatgttacatgtgttcccctgtggagtcttttatggctgaaaagtgttctcgttggctgccctgggaaccaaactaaaccaccatgtataagcggtttctaaggggactacctgctgaggtccaagtttcggacccagaaatggatctttgaaatggggtcatttgtaagcagacgattacttgcaaaaatgcagctctttctgtcatgtggaaagcttcaagtacaaacattcgtagagcaccttatttaaggcactgggggcccagtgaagaataagcttcaggccttacagccatatgatcagtgcagtgatggaactacgtgccaggagatttgcgcgtagcatcttcctttcccctgcccatgcttgcaaggcaaagagcttttcctgaatttgataatggagttaagctatagtttgttcattcgacattgtcgagcacccactaaatgctaaacactggtagggtctagagagattgggctgtccaatatgatagccattagccacgtgtggctacttaaattgagattaattaaaactggccaggtgtggtggctcacaccaataatcctagcaatttgggaggccgaggtgggaggatcgctggagctcaggagttcaagaccagcctgggcaacatagtgagacctcatctctacaattaaaaaaaaaaattaaaatagattaattaaaatgaaaactcagtttgtcagtcacactagccactttccaagtgcttgctagccatatgcactttgtggctactgcaggggacagcacaaaaacagaacgtttctatcatcaggaagctctactgggcagcgctagtctagaattttgtagcacatggatagagccaatatggaatagtggttaagaatatggcctttgaggtaaaatgtagattgagatcccagctctaccactcaccttaccagctttatgatcgtatggtacttagcctttctgagctatagttttgtcctctgtaaaatgggggtaataatgcccgcctccttgggttgtaatgagaattaaagatgatgcattaacatgcagtcaatatagtgtttattgtcatcattattatttgtattatgattatcatcctcatcattattgacattactcgcagatggggtgtttacaaccatccagacagatattttatggtcattaagttctgtaatgttcctatttatagaggttttcaaagattaggctgtttccctgtatctgttctctccctctatggtggtcaccacccttatccccaacaatgcattataaatcatccaacagcctggacttgggggccagctctgcccccatgttgatgactagagaggtagagggtaactatagagtggtaactatacagaggtagaggtaactatacagtgtagagaagtataatcgttgatttgtgtaaatatctgatatatccgggaaattggtaggatggaggtggattagaggaatgggaaacaaagacccgtgctgaaagttactacaagatagttgctgtgctccaggacagaggggaaattggatgactacttggggatgtatttgtttaagatattttcaccaagatctcattattatcaagccttttattgccagctgagtcctggagtacaagcagaggcaccagcccatggccaaatcattaagacaaattaagacatattaacatatgctgggaacaattatccacatagatttaatttgtttcactgctggaagaaaatcctgagagagtaccaaacacatccccgagaacagctctgtaactactctgtgactctcacttgtcagcacttcaggggctggaatctgcttaaactggacatctaccaaagaaggacgacatatctgaaaatagatcccatattagggctacagatgagttacttggagtctgttaaggtggtgattctttttgtttctttttaacctatgcatcttagaaataattattacagttatcaaaacaatataccaagctctaaaatgaaacaggcacatattttataatcatataatatacttagcaagcttacatatttgtattatgatttgctctttctttaagagacctaaactaaatatgagatagtgaacttgtttctgaattttggccttcaatctctcttgacttttttgttgttgctgttgtcccttgcctaattgttatctttcattgtcttactgggaggaaaagaaagactcttcaacacagcaaactgcatttttctcaaatcgaatagaatctatcatcaagattattctagaatgtgactattgcagtatgcccattatatggcaattgcacaatcttttctcagtggttgatgaatggcgccttaacaacatcctggggtagctgctacagaggccagagcaccttctctcaaaatattaacttccaaaggagcaatcaacagccagagaaatggtgtgtttagagtgagaaatgacttgttctgtcatcataatggtgatcacttccttgcagattttcttcctgtacatcaaatatgtatgattatatatgagaagcataaacccccagtcacttaaaaaaaatggataggccttttagtgtgggaaatgaacataaaagttacctatgcatgctgatagccatacaggtttactgcctttcccttggggttgccttgtgacaacctcttcctttttcctgctaccctgtaccttaggctttgcaaatggttatgggacaactcatgcgtgttgaatatgcaaaatcattttctataatgctcctttgactcaaaatatgaccctcattttggaaatcaggcttggtagtgtctgaaacctccaatgacagcttgccgaaagatgattcagttgtttctcaacttggcccattccccacgtccaagtccaattggagaacggcttttgactccgtttatatgagcatctttgatagagagcaaaggtttctggcaaggcgggatgcctgccttccacctctaatccagctgtccttgacactccagacagccctttcaaatctgggcaacacttagtcatcttactggtagccaaggaccatttgaagtgagatctaacaatatgatcgtaagtctctgacattacctgtgccctgggaaattatttattaatatctttcctttttcaaatagaaattttaagatgtctcacaataaaagctatacacaataaggttgtttacacagaagcaatttgaaaatcatgaaaagaggaaggaaacacactaaccagaatggataatgacattactgtgaatgtggccccgggaccatttaaagatccagcaataagtggatcattaaatacattctggtacagccacatgacagattactgagccattaaaattatcctcagggtgagtttgtaacaatgtgggaaaatgcttacaactataatattaagaagaagagagagggttagaaactataaaattctcccagctgtttacaaaaaattgagaaaaatattagaagaaaatcaccagaatattaacttggttgatgagatgatgtgatttttgttgtcatctttaccttttctcctttttcagatagttgtaatgaatatatattacttttataattgtatataaacattattttttccagttaagcctaagcttcctgacagaaaaggcagaaaggaaaactatcatgagttacatgattctcaagtgttaaaaaaaaaaaaaatctcaggcaggacatgatgactcacacctgtaatcccagcactttgggaggccaaggttgtggatcacctgaggtcaggagttcgagacaagcctggccaacatggtggaacctcatctctactaacaatacaaaaattagctgggtgtggtggtgtgcacctgtaatcccagctactcgggaagctgaggaaggagaatcgcttgaacccaggagatggaggttgtaatgagccgagatcacaccattgcactccagcctgggtgacagagtaagactctgtctcaaaacaaacaaacaaacaaacaacaacaacaacaaacgatctcagttctttgagataaatttttcctagataactgaattccaaaggaggtttatcacaagggatgttgaatgatataatacaaatcttggtaaagttcttagtgcaaatgtgggacagggactccttatgattatttcctgaccaactccaggaagatctgaaggcaggacactcctggaggtgaaggctgtgggaagctgcctgcaggggaacttgcacctgactgggcttccctctcttaaatctgtttggaattttgaagtgttgcttttgcccattgcatgttattgcccattgtctgtagatgagaacgcctctcagctctttatttcacaacctgaggattaaatcgcgggtcctggaaacctgtcttttaaaattaatgtaatttgatttctgtctccccttcaggtgttgctgcactggattccaacgtatccggaaaaattggtctgcgcgctgtcgtgtattatttctgtaccactctcattgctgttattctaggtaatacttatttctgaatccttactactttatgtaatggtgattttttcattcgaaaagtagttggtggccagatgcggtggctcaggcctgtaatctcagaaatctgggaggctgatgtgggcagatcccttgaggtcaggggtttgagaccagcctggccaacatgaaaacccgtttctaccaaaaatacaaaaatattagccgggtatggtaacatgcgcctgtagtcccagctacttgggaggctgaggcaggagaatcacttgaacctggcagacagacttcaaaggaaaaactttatggtactttgacaatactactttctgattttaaaaaattgtatgttaagaaaagctcaactactttttaaaatatgtatttttttaattaaaaagagacgtggggagtcttctatgttgcccaggctggtcttgaactcttgggctcaagggatctgcctgcctcagcctcccaaagtgctggaattaccggcatgagccactgtgcctggccctaactacttttttttttttttttttttttcaagagggagtctcactcttgtcacccaggctagagtgcagtggcatgatctcggctcactgcaacctctgcctcctgggttcaaatgattctcctgcctcagcctcccgagtagctgggattacaggtgcacaccaccatgcccagctaatttttgtattttttaaatagagacagggtttcaccatgttggccaggctggtcttgaactcctgacctcaggtgatctacctgccttggcctcccaaagtgctgggattacaggtgtgagccaccatgcccagccacttacataattcttaaagtggatgattggtctataatagtggagttgagtataattataaaatatttccagaaatatagcattttagtgcatttcacgtagtaacaagagctaacagctaatagatccttgttaaggataaatcccacttgtaagagggagaaaattctaataagggaggagctgctcttatacccttagcatagttttttgaagaatgcttggtctttgtaaccctgagtgacattttaagaagaatgcccaattcccacctatgagtgagaatatgtggtgtttggttttttgttcttgcaatagtttactgagaatgatgatttccaatttcaaccatgtccctacaaaggacatgaactcatcatttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcctttagatcacatggacacaggaaggggaacatcacactctggggactgttgtggggtggggggaggggagagggatagcattgggagatatacctaatgctagatgatgagttagtgggtgcagcgcaccagcatggcacatgtatacatatgtaactaacctgcacaatgtgcacatataccctaaaacttaaagtataataataaaagaaaaaaaaagagagagagagaaaaaaaaaaaagaagaatgcccagagggggaagacagaaggagcatatactcagatgtggcagcagctcggcccttgtagccctgcttcaatgagctgataagaaggggtgggatgtggtgaggctttagtggtattaggccaagggacccaggagggcttgaactgtaccataaaacaaaaccacatcatctcatgagtttcctgaggaagacagacacagagaaaaaatagcaatgagaatcaagatactgctctcttattagctggaggcgtatagcccttctacaaccctgagagaggaaaagagtgggccatgcccagtcatggccccttattgcccaggagttcctcccattagcaaaatggacccattcagcatcccagagccctaccccctggattaccattgcctcttcttgagggaggagcaataaagagcatgaggacctttttcttcttcacttccctccagtcaaacaccctccaatgtcttggtctcttctacagcctcccatcttggcttggatactcaagtgacaggaacccattacttcccaaggccacaatgatgctgtcagatgctctgccatgtagacagttcttccttacagagagatgaaccttctctccctataaatcccatctatttgtcctcattccacccccggaacagcattttcctacatgactgctttctagatacttgaagacctacggtatggaaggaaggcaaggcttgttttgtatgatcctcaggagaataaccagcatctgggtaaaagttgcagaaagacatcagatgcattctctgggctagaaaatggatcatccttaccctaacaccttcctaggctggtctcataagttcaagaaaaagaatattctcatcagcaggtgtttccagaagcaattctgggatgcagccccttcatttaaaacacacatacacacacacacagacgcacacgcacgcacgcaagcacatggagttctttctgcttactcatttaaatggaagagtaattaaggtggctgctgaggttccagaggaggctcagcattttggctggacctcagggtcctccccatcacactattgcctggtacaaccatgcccattgttctaaaggtgccagctgtgccaggtgccctggaaggttcctaatgctctgtggacgctgttcttggccacaggtattgtgctggtggtgagcatcaagcctggtgtcacccagaaagtgggtgaaattgcgaggacaggcagcacccctgaagtcagtacggtggatgccatgttagatctcatcaggtgagtgttttgccacaaggtggcttcaagggcatgcggatagcagcacaaggccttgtatgtggtttaatattctgctgttactgtattgaaatttttaataacttttgaattattgtgcactttcattttgcccaggaacccacaaattacatagccagtactgtttgccaagtcttggttccaagagggaagggaagaaacaggcttccgcatcaggatttaggatgaacagagatgcagctacatgttccagagagatgctgggatggattggtagtcagttctgaagcgcacttagaaaaatacatcttttaattgtacaggagaaactctcttatctaaagcaaccagaggggtaaataggtcagtcaataaaaaataccagttaaagcagagactcataaaaaaagacataagatacacattacaattttgttttcacttaaaacttagtgcatttattcaccaattgtttgacataaagctaaggtcttttcttcaagtttgttagctcatggtaatttcttacgggttctgttgcatatacagcccttataaatatatcatctgcaatttccaggtaaagtttctatagaacagagcaccaaaacttttagacattgcaaagaaagctaagtgcaaatctttccagtttttctttttaatttcaataatcttcccatacctaatctaaccataaaaattttagtcactggcctttattgagtttccaggtatgtggcttagattttatagaaaccataccttctttttatgctcatatttcactggtttacataatatgaaatgcagtaattatgatgatatttgcaactggtataaagaatttgggaacaaataaaatgaacccttggtaagtgtattagtccattttcacactgctataaagaactacctgggactgggtaatttataacgggaagaggcttaattaagtcacagttcctcacggctggggaggcctcaagaaacttacaatcatggcagaaggcaaaggggaagcaaggcacatcttacatggctgcaggagagagagcaagggcgaagggagaagtgccacacactttctaacaaccagatcttgtgagaactcactcatgatcatgagaatagcatgggagaaaccaccccccatgatccaatcacctcccacaaggcccctcccctgacatgtggggattacaatttgacatgagatttgggtggggacacagagccaaaccatatcagtaagcatacaacctcattgatgaaaacagaagtgttcagaatattaaagaataaatagtctcttgactgtgagtgtccatttcaccaaggagcgtaagcatgtcagttactcagtgaatcaattaagtgatggttgattacagagctttctatacttgggtgaagctcagcaggaaaaaagaaatctcaatacaaggaagtattacgcaaagcaggggccagaagagaaaccagagtactagttttatgttatactaatttctaccaatatattaggtatgacaaaacaatactttttgccctaacataatactgccttttatgtctccaacaggaatatgttccctgagaatcttgtccaggcctgttttcagcaggtaatattaattacttgtgcccttaacttgctaccctcttcccattatcaattaaaaatgtttttttctgctgtgactcaagaaatggaattagccccgtgaaaatggcagcaggaagtaaacctgtgactggccaagtttaaggtgatgtctctgttttgtatgcagcctttctggctcacagtaaggtgcatgtcacaatttacactgcttccttttcctttatgctttttcccccaaaaaggctcaaatggtacaaatcagaaatctgtcaaataatgagtattttaaaatgtggcctccagtacctatttttggagaaccatagtatatttgtactgaagtttaaactttctgcagaaaaaaggtagctctctatctcctctttgcttttcctctggtattagaacccaggatctaaccctcatggtgtggtccacatctgggttcagtcttctccttaatcattgtgtcccagagaggcgtggaagctcacacctgtaatcccagcactttgggaggccaaggtgggcagatcccttgagctcaggagttccagactagcctgggcaacatggcaagaccatgtctctaaaaagaaataatttaaaaaaaaatataaaaaatcgttgtatccccattgctggagctctacaatgcagtgtaacaaagccatgatttttttttctgtaggaaaattgaacaatctcttcactccatttacttcaagcctttccctcctatttatctatgtgctttaagacagctgagtccatcacaaactgctgtattcattcacataagttacatgaacacagacttctgtgtataccaacaaaaatggcaactctgttgctctctgccggcctccacgagggacagaacctcctctattacagggggcctttgcagatcagtcacagtggttgtttgtaaggttctcagtgttggcagagcctggtagtgggggacatttatgcctggtgtaataatatactcactctttcttaaatccccatgtggaagctccacagaaccaaacagggctgaaagaagagaattcaactgcagtctcactcactgaatagccccaaggggactgttgattttggaacaaccatatcgttaaacctttcttgatgcttattaaagttgtagtgatgttatcaaagtaatgaagtgtgtttgctcagattaaaaatcatttattaattaataaaaacaaaaatgattgacaggaatccttacagagtctgtctctgacagcacctgcagatcaagcctgtactttcttttgtattattcttctatcaacttgtcgtttattgtgaaagtgaaggaacattttgacataattgaatggtgatcgtgggagtcaggggtttaaatttctgcctcgcttttagttccaaaacctgatgggaggtaccgttgacaactggagccaacagaggcattggatgtagatcccttcagtggcactgtttggccaaaataacatgttcctgtgatttagtctcaaaagcttaaaaaaaattctttttttgtttgcttgtccttgattttctccaacatgcagtacaaaactaagcgtgaagaagtgaagcctcccagcgatccagagatgaacatgacagaagagtccttcacagctgtcatgacaactgcaatttccaaggtaccattcttatttcctgttcctcttccccaggagacaggcactgagtcatgactgagcaggaaatacaatcaatcctcgtcattcacagaatcgcatttgcaaattcacctacttgctaaaatttatgtgtgaccccaaaatccatacttaaggggctttcatggtcatcatctcgcacacaaagagcggcaaaatatttgagtcacccgacaggcacgttcccagctaaggtgaaaaaggctgtgctctgctttcttgctttgattctcatgctggaaacaagtgtcccttttgcagtgtgtttagtgtcatattttttgcatttttgtgatttttcttgctgatttcgctgtttgaaatggaccaaggtggggttcagtgactcatgtctgtaatcccagcatgctgggatgccgaggcgggaggatcgcttgagcccaggagttccagaccagtctgcgcaacatagtgacacctcacctctacaaaaaatgaaaaatagccgggtgtgatggtgcacacctattgtcccagctactcgggaggctgaagtgggaggattgcttgttccagggaattcaaggctgcagtgagccatgattgaatcattgcacttcagcctgggtagcagactgagaccctgtctcaaaaaaaaaaaaaaaggaccaggctgggcatggtggctcacacttgtaatctcagtactttgggaggccaagacaggtggatcgcttgaaaccaggagtttgagaccggcctgggaaatatagtgagaccccatatgcacaaaacattttaatattacccaggtgtggtggcacatgcctgtagtcccagatacttgagaggctgaggcaggaggatcgtttgagctatgattgcaccactgcactcagcctgggtgacagagcaagactcttgtttcaaaaaaaaaaaaaaaaacatacacacaaaaaagcatcatattgaagtggtctccagtgttcctaagcacaagaagactgtgatgtgccttagggagaaaatttgtgctttagataagcttcattcaggcatgagttatagtgctgttggctgtgaggtcagtattaataaattaacaatctatatgaaacaaggtgtctttaaaagaaacacatacaacaatgttatatattgattgtttgctgaaaaggatgtgtccaaggttcccagaaacttaaccctgtatttcccccaggagcaacggttcagtatttgctaattcagtgttcatgagcactttatagaacataactaccaggaatagagagagtcgaccacaaagagcaaaaaaagagccctgttgcctctacctctctgggtctgcttacagtagagctggccatctctagaaactgctatagatttgtcaggtacataagcatgcaatgcaggcccacaattcctagtctgaatctctctgcccagatgtaattcagagttcagagtttctcagactttagaaaggccatgtggtgtatatactgcatattatgcaacctttataagtgggatgggcaacaacatgccagaatcaaccacatcaatgtttttataacaaactcataaatattctgccaaggagagaaatggacccttagtagccagtagcctcatctcagtttaggatgggatttgctgccaaaagagtttgctataaacttatcaataaaatcaacatgctttgagagcttttgggatttcagaattggagatcagaatgtgtgggcctgcattggtacctctgtaagcctgtagcagatttctcccgaatgttctctcaacttcacacaggaaggaatgatttaaggagaaaaggagtgttcattagacttaagaattcaaattaaataaaccaccgttggctccctgcttcctactgcagaaagccttaactcctctggctgagttcagaggccctgcatgacctggcttctctctagttttcacagcttacttccagtgggcacctctcttctttccagattcacctcctccatcactccttattcctgccttttgatgttgttccacaaatactttctgagcaccctctataccccaggccctgctgggcattgggattataatggtgaaaagacagatgccaggcctctgtcctcacacaaagaatgatgagtattataatcaggaagaatgggatgtttgggaggcattcagcaagggatgttaaattagtctggaggccataatgaatgagcaagaattattcaagcagggtgcaaaggcccagtgcatgatcgtttttgcctttgcttgccatctttctgaaacatgctttttctcctggctgctgattcctcagccctagctttccctaaccttgaaacccacattcatgtcccactcttcatatgacgcttgtatctcatagtttgggcgcacaattaattacataccttcctgctattattggctcatgcttctcacagtcagtcttgtctctccagctgaatcttaagaccttatgctatagccagtgcagtaatactctagcttttccctaaatatatgtttgatcataagtaagaaatgactggtagcccagtgggtcctcaacataatttttttttttttgagatggagtctgactctatcgcccaggctggagtgcagtggcgtgaccttggctcactgcagcctccgcctcctgggttcaagcaattttctgcctcagcctcccaagcagctgggattacaggcacgtgccacaatgcctggctaatttttgtatttttagtagagacggggtttcaccatgttggccaggctggtcttgaactcctaacatcaggtgatccacctgcctcagcctcccaaaatgctgggattacaggtgtgagccaccgcacccagctaacataattctttataaacatagttggcaccactcagttatctctctgtaaatctcaggctatttttacccaggataaagtgaagaaattaagccaggcatggtggcatgcccccgtagacccagctacttgggaggctgaggtgagaggatcacttgagccctcctttgaggagtttgaggctgcagtgagctatgatcatgccactgcaccccagcctggacaacatgagaccctgtctgtttaaaaaaaaaaaaaaggtaaaaacatgattcacagtagtaggtatttggctaatttttatatgtctaaaatcctaccaatgatagactggataaagaaaatgtgtacatatataccatggaatgctatgctgccatttaaaaagaacaagatcatgtcctttgtaagggacacggatggagctagaggccattatccttagccaactaacacaggaacagaaaaccaaatactgcctgttctttcttataagtgggagctaaatgatgagaacacatggacacatagaggggaacaacacacactggggcctatcagagggtagagggtgggaggagggagaggatcaggaaaaataattaatggatactaggcttaatacctgggtgataaaataatctatacaacaaaccccatgacaccctgtacatcctgcaccacatgtacccctgaatgtaaaagtttttttaaaaaaatcctggctgggcacagtggctcacacctgtaatcccagcactttgagaggctgaggtgggcggatcacctgaggtcaggagttcgagaccaccctggccaacacggcgaaaccctgtctctactaaaaatacaaaaaattaattgggtgtgggggcggatgcctgtaatcccagctactagggaggctgaggcaggagaattgcttgaacccgggaggtggaggttgcagtgaactgagataccaccactgcactccagcctgggtaacagagcgagactccatctcagaaaaaataaataaataaataaataaataatcctattggtcatccaagaccgcaggcataaagagtgttactgtgcttcattatcagggtaaaacagaaggtaaaatgtcctaaaagtgttcacactggtaagtattctgtacttcctgcattattaattcctgtgtttttttaagcagactccaaatgtagctagcagttaaaatgaccctgaaaagtgccttcaatctaaaattcataataaaaatataaaccattccagaataagaaatctttataagaaatattcaaatatggacttgttgaaagaagagaaagcattttaacttcggggagcaagggtaaagtttgttacatgcataggtgtttttattattgtttttatattttctatagttttgttgactctgcctgggagatcaccagtttattatgtttggtcattgtatcttctcatttctggacctgtgctttctaacaagattataatcgtgcatcaatatgttttcttggttttgatccacagaacaaaacaaaggaatacaaaattgttggcatgtattcagatggcataaacgtcctgggcttgattgtcttttgccttgtctttggacttgtcattggaaaaatgggagaaaagggacaaattctggtggatttcttcaatgctttgagtgatgcaaccatgaaaatcgttcagatcatcatgtggtgagcagacactgtttaatgtcattttgcttcccctgacaattctgtctcctcaaaattagaaagaagaggttttatgtttgtcaactgatgaagctagagaagttggacatttaatattgaaccaccagagtattttgtgggggcttttgttgctgttctttgtttttgttttagaggcagagtctcactctgtcaccccagggtggagtgcagtggtgcaatctcggctcactgcagcctcaacttcctgtgctcaagcgatcctcccgtctcagctacctgagtagctgggactataggcatgtaccaccatgcccagctatttttttgtattttttgtagagacagggttttgccatgttgcccaggctgatctcaaactcctaggctcaagcaatctacccacttcatcctcccaaaatgctggaattacaggcattagccaccacacccagccaccactagagtattaaataattccacatattacccaggagttagttcatgaacagaagtctagctatcaaccattgtcttttccctcaaagccttgggagatcatcttgcactcaaccagccttcgtgtaagaagtaattctttaaaaaatgatttgaaggatttcactgtacatgagaacacaaagtgctttccctattgcaccccatgcaaaagtgagtttcaaaatatttataactggcactgcatgggcactaacccatctgaatgaaagctaccatccgtgagcataccagtgacaccatttcagtgtctgtcctctccctgaaaatgccaaaaagtccacctttcttaggatgcatctgtctcgcttacctcatatttaatttgttcaacattatttaatccaaagtgtagatactgacagtgatgtaaagggttcagtaaaaatggcaaggcaggtcacttaatactgcagaaacctcagcttcatcatctgttaaaaaggataataaaagctacccccagggataggagaagtacattaaatgaaatgatgcatgtaaaatactttccctcatgcaagatacaacgatagctccacaaatagagctattatgatcacttccagtactaatactatcgcctctattgctgatacctgggaaacagatgaccgtggctagaaagagccatatttggcagtgagggtcaagctcaagtgagatctgcagataggacaatcagcaggatatatatgcactaggaacacggcatgaggtgcgcacccatctaaccacatgttcttgccaagtttgcaaactaccctatggtagtttggatgggtagaatttaaggtgcacacaggtactaaaaactagagccaatattgttcacccaggacttgaaacaactcttagcttcaattcccatcctgtgctccaccaagtgtgcatgccaagctgagggtgcccacactggagtgttccttccccaccaacctagcatgagaaagcacttgatgacggaatcacgcctctgttgtgcttcctttccagttatatgccactaggtattttgttcctgattgctgggaagatcatagaagttgaagactgggaaatattccgcaagctgggcctttacatggccacagtcctgactgggtatgtcagactcaagagaagagacagaaacctcctttgatctaataggatggccgctgagaggttgggtttcagttggttaaaactggcttctgccctatgtgctgggaaagatagggttcagagataagacagcagggggaggagggctgccctttaacagctgtactgtaggtggatcatgctgtgctaattgtcagctcttggcagaacagcctggaccaggctttgtcactgcctttattggttatgttaaaataattttttacaacaagagagaaacccactcgtagcctcccttggctctctcctggccttcatttccttaagaatgtaaactagccaagcaagcaagaatagcctccatgtaccctgaacctgaaagaaattagcaagggcctaaatgaaatcagacttgagcaagtaggagcaggatggctgttggttcaaacactgttgctggggctgttaaccaccaccatgtcctgcagcatcagagtgtcagagagggtgccaggagaatcttgaggctgggaggaattgtgtgggcctttttggaagccattaaacaggaaggcagcaggggttgggtagtttccatatttattacagcctagctactgtttccttgagaaaagatgaggtgggataagttatgaatggtgcccctggacacctagacaggggcagaatatgtcacataccctaagaaatacagactaagggaataaataaatatcattgatttgactctcacaagtcaatacctacaaacacccaacttgagcaatgaactcacctattggaacttgatcgtattggagatttccaacacagcgcatttggttcttaatctgtgtttgccaaaaacacagccctgccagccaacacagaggcagatttggtccctacagtgtgaggcccctggcgctaagggaggtgggacctccaattcactggaggccaccctgctgtagggctgctgaaacaggcagtgccagggatcgtgtctcagcagtgacgtggctggggtgtatgagctgagccatttcataaccgagttctgctggtttctattctcttaccccagctaggtgtctaacaggaaactaaaagtcagttcctcatggtttttagctacaagctctctatcaagaagatcctctcgccagaactccaggatctatatttttgatggccatttcctatttcaaacacacataactgatctgtaaactctaagctgccagttacatatatatctatctgtgaaatgagtctcatttcttaagcctcctagttcatgtaacctgtgtatttccatgtgaaacaatgaacagtttgagaaggcaggaataacaaagaaagaaataatcctaaagtatggctgtggaagagctgagacttttttccttactgtaactctgacttccctcttagacagtgggcgccaccagcaagacagcagcttggtgcagggaatggagtgggtgaggactgagcgctgtgataaggggtataatgaggtataaggtagtggtgacatacagggtgccaaggaaggaaggctcagccctacctgaggaagtgagggaaggcttcctggaggaagggggatgcctatctgagtcttaagaggagaagaactgagcagcaacagaaggaaaaaagggcacttttgtgcatgtggcaggaatagcacacacaggggtgtggcagcatgatataattctgttctgtgaagccttgaatttggattcagctactggctttgtcattaactctgacaagatgcttcatgtgctgagagagcctctaaaccctcatacatggaatgggacgtatattcctgccctactcccatttcttattgggccattatgaaagtcaaacaattttataaattaaaaagatgtttgataaaaggattaagtgtggggaggtggtattatctttgaaactttaatttctctttcttgtttacaggcttgcaatccactccattgtaattctcccgctgatatatttcatagtcgtacgaaagaaccctttccgatttgccatgggaatggcccaggctctcctgacagctctcatgatctcttccaggtaaacagaagaggggtttctggaagaagcctccaggctcaacgttatcaactctcacctcactttacaaaacagactccagcttgcggtttttgtagctgtctttgagaaatgacctccgtattctcggcccctggccctgaacacattgcttcatgctgttgcatatttcctgctctcttggcatgacctgcagctcaggaaggggttatggaataactgggagcagtggtgggcacagcaccttctgattcctggacctgcctaaagggctagcatgatttggatcctttgtttcattttgttttgttattttctttacttttctcgacaagattacctaaaaggaccctttgtttactttttggaagacaggcatgtcttcaggcagggactaaggtccagcatttctagacataagttcctttctatttttatcacacagttcagcaacactgcctgtcaccttccgctgtgctgaagaaaataaccaggtggacaagaggatcactcgattcgtgttacccgttggtgcaacaatcaacatggatgggactgcgctctatgaagcagtggcagcggtgtttattgcacagttgaatgacctggacttgggcattgggcagatcatcaccatcaggtggggcatggtgtcacattcattgtcatcactgatacagggattaccgccagtaaaaattgtccatgaagggacaccaagaatgtcgcagtgatgaattctttttcttgatctataaagtcccttcccaagattaaatacgactatatcctggtatgcaagatttctgcttcggggtctgggtagccaaagccatcactctgtgctcagtttactgaagccagtaggatctaggcacaggctagcacaaagactcaaggctgagtaagggccagtccctgctttcaaactatccctgctagatgggcatgcacatatccaaatgaatgctgaagaccatgatgagggatgtaagagaactctgtatggtgttcacagaggactccagagagggaagggctggttctagctgggaaggtgaacgatggcttcccagaggaggggaacatttagctgaatcttagaagaataggaatttagcaggcaaaagaaaagctaggagcatttggagtggcagaaatagcttgtgatgcagccatgggctagttacagcatacagatttcttgctatggctggcataaaggatacataaacattcctttatgtttaaacgaatgaggaggcaggggtcatgtcatgaaaggttttgtacgaagagcttgtggaaagctcttagatgctttgtcatattatggacagatttgcattttatgtatttatttattttttgagatggagttttgctctgtcgcccaggctggagtgcagtggcacaatctcggctcaccacaacctccgcctccagggttcaagcaattctcctgcctcagcctcctgagtagctgggactacaggcgtgcaccaccacacctggctaatttttgaatttttagtagagatgggtttcaccatgttggccaggctggtcttgaactcctgacctcaggtgatttgcccacctcagactcccaaagtgccgggattataggtgtgagccaccacgcccggcagatttgcattttacaaagataagcagcaatatggaagatatattggatgggagcagggaccaaatctaggaaaccagttaggagaccactgcagaagtccaggcagggtattagaaggcactgacactgaggttggagaagagctaatgaattgaagaagcatcagctggattcagggtgaaaggcgagggaatgccaggatgactcccaggattggcagatgattctaaattggtgggtggggcttaccagaacaggaacgagtgtaagagaagcacatataggtgggaaagataaatagtaaatactttttgacagattgaatttgaaatgcctttaagacttccagttgcacatatgcaatgagaaatataggtctggctgcagatacagacatcaggaacatgggcttaataatggtcttcaaatgtgtaagtcacaagttattgcttgtattggaatcgcggctacatcatgattagctgtgatcttgggcaagtgacttgaatttttaaacttctgttttctcatctgtaaaatgaataatagtacctacaacttattcaagtagtggcaattaagtaatatgcatataaaatgtttataactgtgcctatgtagtgagtactcagtgaatgttgaaaatggatgacatgacgtagggagagtttgcagagaagagaaggagattaaggactgaggcttggaaaaatcctaatactagaagcaggtagagaagggaaaacccaagagggagagggagaaggacagagagatgggagggaagccagtaaaccttggtatcatggaaacccagaaaagagagattttcaagggtgaaatggtccacagagtcagaagctgcagagaattctagtgaaatgaggatagacattgtctgcccaagtagatggtagaactgtcattagtggattttgccagatttgtttctctaggacagcactattcaatatggtaaccactagccatgtggcccactgaattggatagcacagacacagaatagtttcatcattgcagaaagttcttttggacagcactatgttagagtgataggctgggattagagttaacctgaagacttttgttcagtttagaatggaagtttaagactaaactggtccctaggcctgctcaaggttgaatctgaactttttagagttaattcattcttgtgtcccagcctaaacataaattctagggataaaatcagagtttgttaactaacaatgttctaatacaatgcattttttaaatcctccccaaccctaaatcgcaaagtatttctgttggctgaagacaagtgcaaaatacaccatttggcacaccagctggggaactatcccaatgctgtgtaatctataaaaagtgttagcggctaaagaagcctgtgccaaagagattgagcaaagtcctgtaattataacagcagagggtatgtcaaaattgaaaccttgaatcatgcctgaaaaagtttctgctccacaaccacccctgtgcttccaacagttgttacttttacatttccaagggttttttcccacttccctcaccctgggctgtggaacccagtcttcactgaactgatttccaaggagtggtttatgaagtgcctattcttttgtgtatttgacactttgtgatgaaatccctccctcttttttggttgtaagttttctagatctttctaatcatttttttaatctcactgccagaggaatgaactctgggcctagaagctaaatagtcaattctcattaaagcctctccggctacctctggtatattcttaaatcagatttgctgaaaactactggcccagagccaataacaactgtgaggcccaaagtaatcattggcttaaaattaaaaatcctcactggctctacatggaaaataataaaagttggttttgcttgacagttaccattatagttcatgtgactaatggttaaagagatttttagacccaaagtatatttctgtggactggacatcaaagaaacataggtaccatctacccaaaacatacccttttgtggctttatcataatactcaaaggttacaacggattgaaaattgtgtgagaatatgtgtcaaaatggaaaaaaaaaggataaattgtcttataaaaataattagggccggaagcgatggctcagacctgtaatcccagcactttgggagacctaagtgggtgaatcacttgagtccaggagttcgagacaagcctgggcaaaatggcaaaaccccatgtttaccaaaaatattctaaaaaagaaaaattagccaggcatggtggcatgtgcctgtagtcccagctactcaggaggctgaagtgggcagactgcttgagcccaggaggcagaggttgcagtgaactgagatggcgccactgcactctagcctaggcaacagagtgagattccatctcaaagaaaagaaagaaagaaagaaagagagaaaagaaaaagaaagaaagaaaagtaaagctaattatacagcagggcgcagaggctcacacctgtaatatcagcactttaagaggccaaggcgggcggatcactttagcccaggagtttgagaccagcctgagcaacaaggcgaggccccgtctctacaaaaaatacaaaaattagccaggtgttatggagtgcatctgtggtctcagctactcaggaggctgaggcaagaagatcgcttgagcccaataggtggaggctgcagtgagctgtgatcatgccactgaactccagcctgggcaacagagtgagaccttgtctctggaaaaaaaaaaaatatatatgtgtgtgtgtgtgtgtgtgtgtgtgtgtgtgtgtgtgtgtgtgtgtgtgtataaggaataaagaagaaagacaattgtaggatttggggcctagaaagagctgagagaaaaaaaaagtagcagtagtaatagtagtagtagtagttgttgtaatagttgttgttttggttgctgcagtagcagtagtaataataccagtggcagcagcgacagcagcaatagaggaagcattagcagcaactgctgttgttgcagaagtagcagcagaaatggcacgtttttaatctttttgtttgttttttgttttattttactttaagctctgggatacgtgtgcagaacatgcaggtttgttacataggtatacgtgtggaaatggcatgtttttaagcatctactatacaagtgctatcccagatgccttacgtgtattaacctcatttaatcttcccagcagcttgcagtagacatactgtccccatcttacaggcaaggaattgagattcagagaagtaacttgcctgaagaaatgccatcagtaaaatggtagagcccaaagtacatcacccaggtgtgtctgacactaaaacctgtgttccctccaagtcacaagccatccttcaacctgtttagagagccaagtccaatggccggtcctaaaactaggacctcagtgtgaggaaagaactttgtaccactgatatttatgttttcttctgtggaaatcctctaactcaaagtagaatatgttcaagcagcaggaataggtttttatattattttctcccatctgaaggttcatagttctgagtttcagaccaatgccagtcaaacagcagtagtctggtaagcaaggtcaaggctcaaggacagagttttctttgactaaatgaattttgagtttcaagcccagcctcaggctatagagacatggattactgtgacacgtcagggtttccaagagggatcagctggcatggacacaaatcacttctgacaaagaaaacctgttgatgcattccatttaaatttttttcaaccagcattaaaataaacttgggctttccaaagagtacttaggtcagaagagatccaaagggttatagaggccagaaacctttgagactgaggcctgaaacctttagagtaattggtacagccccagaaatctctaatttactataatttggtggtcaaaaccactgaatgaaaatacacttgtcaaaaaactctggcctgtgtttgactgtaccctcaaatgctttctgcaacacctcagtaggcagatgaatgggcagtagaatcagcttcctaagaactctggctttttttagccccaaagaatatgaatgtgtggatagaatcagggattcttccagtttaaattgccaatttttacattttcacctttcaacacagtggaacccgggcaacagttcaggccttggcccaagggcaaggacttgtctccagaaagcactgtaggtgtggcctccagcttatccaagtcaagggatttttcagggcatgttgaacccttgtttccttcagaatgatccaattaaaataaggaagatgttgctgataaagagactgcacattacaaagaaaaaaatccctactgcctcagctgatcttaccaagagggatctttttaaatacctggtaataaagttcacctggctgcccctcctggattccagatctttctttcccacaaagtgcatctactggcaaaaaggagcagtcaggagtaaatgcttgtaccttggacaggatcagctatttctcaattcagtgccctgaagagcagttcccagaggtaaagagtcctgtgatgtcaagagagtgcataaagcctgcttaaccattgtctcattcctttgccttcacctgaaatgcccttgcccatctgcccctacaactatccttctgtccatccttcagggcaacttaaattcctgccatatattaggtgctcagtaaattattgggtggtgagtagatggaacaagggagtaggaaggcaggtgcagaggtacctggcacttatttaggatgagtgtatgtatacatagatgagtacacgaagcctcctattaacaccccatttagtaaactcctgctttcctcttgagtatctctcttacttattttttggtgccacttatgcagttcttccttgcattagagtgatgtgccatatctccgtctgcaaggagatggcatcatacccctcatagtccccctccccccacagctctaatcctgtaatgaggcagagctggggctcagcaagtcacagattctaactacccaatttagggacacagcagtaatagccatcgggactaagcgggagtaaccatttcaggccagggctttaacgggagaggtaagtgtctaactcctttcctgctggtatgtttctgcagtatcacggccacatctgccagcatcggagctgctggcgtgccccaggctggcctggtgaccatggtgattgtgctgagtgccgtgggcctgcccgccgaggatgtcaccctgatcattgctgtcgactggctcctgtgagttggaataaatgcactgccttagctggatgtgcaggcgggcttcccagcctcgcaggcgctgcagtctgtcatcattctctcctcagattgcctaatgagccacctgttgctgctttaattttcctctgaccaggccatctgataacatgcctaaaaattaactcctcataacgtggagcagtgattttaaaaagccggtgagctccattagctcattatacctggtaacactcaagcttaggagctgggtgtgggacagagataaacacagaacaaggtgagaagccaggcagggccccagagccatcctgacctatcccagccctggttcagcatcataggctcagaaccacctagttcaaaatcagtccgtcttcctaagcatcttccgaaccatcagggacagtggcacaagcacttgggtttgaatctccgtcctgtgtcttaccagcttcttgacctcgagcaagtttccttaacctgaggcccagttgcataatctgtgagatgggaaaaaatctgcctatgtcattgggttgttttaaggactgagtgagctcatgtgagtggagcatctagaacagcgtttggcagcccatacatgctcaataaatggcaagttttattgttatgattagaatgagttggaccattcaggccccaatcaacaacacttctctctctctctctctctctctctctctcacacacacacacacacacacacacacacatatggaatacagcagaacatctgggtgagaaagtaccttcagtgaccctcaaggttaaagttagaaccagcctggctccaagctttacccttgatgcccacttctgtgcatggatcttacagcatttaggtctggctctgtcccctggcattgcaggtaagtattgctccacatggagcctttgctcagaaccagctcaggctcactggggagtccagtgctatgtactgtagtttgcaggtgacagatgagatggaaagggaagcagagacatcctattgggcttgaaaacacagattcacatttcaaatggcaaaagcccctgcacctggcttggaagctgtgccatgaggtggcccctcagtagctaactgggctataggcccaaatgaggtggcacccttcttgcaaagatatcctatcattgagtcaagatttggttctttctagtgatgctggtggatttgcatttttctcctttccctgagtcttcctggaaccagttaccttccctgccaagatacccagatgagtcaaaggtccaattggaggtatgggataaaaagacactagggccagttcaatccctggacttgttctaaataacagaagggcatccagggtggtcatgtgtaagcattgtcagccttttctgttctgcaggtgtagttttcacaagattccccctgcatgcagttcctgtcaacaaagtgccagtatcaaaatggatcctctcctctgcagtgtgccttctctacctgtcttcctgccaccagtctcttccccaggctctctggaaattaagactggatgagggtggcccacagagaaatccattcctgggctgacctgtgttttctgaccccgtgctctgcaccatgcctcctggtttgctcataagtagagtgacctagattggtaaataaacaagtacaccatggacctgaacaaacacatacataccccacatgcacatggtacatactccacccacaaaacacccaagttctctgacctttgcccaaagagagcccacaatggcatttgcattgaatctagaaaatcccaagatagaggttagggctgaaaaacttactgaattctgaacctccctcagtcccccaaaaaatatctggaacgactctattcatgtttctttgggagaagaggaaggaatttagggagacttaggggagtcattgctactttgggggagctcatgctgtgcctttatgaacaaccccaggcctgtgaggagccttcagtcagtcagccatgaggacagcactttctgcacttactgaaatctaaactgaacatgtcaggtccttgcatctctccagtgatgaaggaaaatgaaatctgggcctcctgtctgactcctcccgtctctccccagggaccggttcaggaccatggtcaacgtccttggtgatgcttttgggacgggcattgtggaaaagctctccaagaaggagctggagcagatggatgtttcatctgaagtcaacattgtgaatccctttgccttggaatccacaatccttgacaacgaagactcagacaccaagaagtcttatgtcaatggaggctttgcagtagacaagtctgacaccatctcattcacccagacctcacagttctagggcccctggctgcagatgactggaaacaaggaaggacatttccgtgagagtcatctcaaacactgcttaaggaaaagagaaacactaatggccaagtgtacatttgatttgatatacagacctccagattattttctatatttggattcacagcctttgcgctctgggttttgggatttgggtgtggggtaagttgaagggaaatcaatttaaaggaaagttctattatctgggttttagaaattctataagagacaaagtttggaagtacataaagtaataactgttagaattaggtaatggatatgaaagagaaaatgctttctcatgcatagacaagtgttttgggtttttaaaaaaaatattctgtcattggttacaaatttttactcaggctttctattggcatggatttcctttgacctctcacttttttataaattataatgcatctaaaccacctgtccccagttaatgtgccaaaatgtcaatttttaacttatctccagccaatttcaaagaaaacagaccagcatagttctgcaataacagttttaagatgggcatagggtttggaagaaagggagaaggattcttttttcaatgtactgtattgggacgctggtaactgttaacccagtgttcagcatagagctatatatatatatatatgtatatatttattattttcatataatttgccagacagagatcagaattgaaccgtcaatgtgaaataaagagttctccttgtacttgaataataaccacgattccaacccaggtctgctttggggcttatcagaactcctttctaaggagcactagaatgagaaatcatgttgttcgatcgtttcacatctgtatatcagctctaaagcagagatgtattatggtgatactccaaggtggcatagccattcatttacaacttccagatttgagctgcctggagggaatccatatcagctctgcataagattatatacaaagctgtcactcacaaaaggctggatgtgctttcatccaactggaaggctttattcttccaagttcattcatactcaaagaggccagtactttgccatccttgcacttctgttatcagggcccaaataacagtggcaagctaccaactaagttgtattttaataaagattccatgggttgaacaagccacgttgcagaaaaagagcttcccctaacctgggttgttgcagagtaaatcccacgacataagctggtatcagtggttcgggggaaatagttccattctatgactcttgtctcctcctccaggaggactgttctaactagtaatcttggccctattcattacatcctctgcttgtcattctgctaatttatgaagatagtttattatagtctgtacttcagttctcatcttgtaaataatgcttaacataaacttgtacttacactgaaatccaaaatagtcatgtttctgcagtattctgtagccaacttaaacctgtgctttcatgtttaagaaatgagaaattgtgccaaagatagcagaagagtagataagtgctcagtattgacgacctacatctgaaatctacaacataatgatactgaattgttatgtaaacatcataaatagtaaataatgattcaatgtgaattttaaaatgcaaatattgctattgtttataggaaataaatctaaatataaatg

SEQ ID NO: 36858 - DNA, 130988 bp, Homo sapiens; identical to SEQ ID NO: 36504

SEQ ID NO: 36859 - DNA, 185638 bp, Homo sapiens
gtctggagaagagagtttccacgttgtcatcataggatctggactcaagtgaccaaaaccttgcttggatttttacctgatgaagtttgtcttgaaaagtgaaaatggttccatttccattttccctgttctcaaggtaattcagctttctttgtgtgtgagtgtgtgagtgtgtgcaagtgtgtgtgcgtgcagtctccccagcatagaacacccacacatgcacccacccacatgcagacacgcacatactcatgcatggattcttgttcacgaagtacacacccttttgcaaaataatttttgaataaaaaattatagccctttaaatttattataatttagaaagggaccatccgatggttaaaacttttcctataattcctacattaattctctccatcacccgccccccccatctaatctgactgtaccaaaagatttgaaaacaaagcaaaaacaccaaccaaccaaacaaaacaacccacctgcttctaaagtaactttcagactccctgggcaaagattcttgtctctttctgaaagatgagcatgaattctgagctccaaattttgcttttaatctgtctccaacctaattgaaaaattaccataccacacaaagaaaactccgcatcgggatcaccatgctgatccaattgggttctgctttttgacgttagagaaatcaaattgtctggcgatttggtgacatgcttgaatgtccacctgggagaagactaggttaaaagttaatagcacttgtgcttttcttccccccgacctttttttaaactccagtagaacggaactcttccccactggccaggccctcatcctgaatcccttgtccagcctggaggtcttctgagagttctcagttggcacctttcccctgacttgtccctgtgaggtaaggcagggctgacactgagattttagttctgttgttcttttttttttcctagaaattcacaccccccaccccttggttaatggctctttaaatattgaaatgcctggaaaaacaaaacaaaataaaataaaatgcagcctgtcaaagaaataagaacaacaacaacaaaaatgttggtatcttttagaatgtgtcttcctagtggtaaaagtatataattaataggagaattttcctccagatgtggctatactataatagagccttataaatgctacagaaagaaaaattgcttggaacgaaggcgtcctcaatgagagcacacctgggtctgacaaagattgcatttagggactgctgtgctatcacaacgcagagaaagaccaagtctctgggagcagctggagagaaagccccggcaaatctgcatgcaaatagcagcacattgttaacttaatcagatgccgaggaaagatgtgccagaattccaggatgatctacacacacggaggaggagcggcctgagctgcagtgggagccggggccaaggtgggcctcagcaaggtgcacgcggcccggccccagccccagggccgcagcccacccgccgcccgcctgttttccgggcctgcagtcaattcaccacataatgcccgattcgctctttgcaaagatagaaacgatagagcgtatttcaatgggatggaagctttattattattattttttaatggtgatataggtatgggcattatttcgcctgagtccgtaactccaattaaataatatttctgcttaaatatccgggtgcatgaagataagaaatattgccctggagtgtataaagaaagagtttttttttcaataagaaaagtagttctctataggttgaagtgctgggtataaattgcaccttaagaagaagtggaagacacctgttatttatattttatattaatattaatggaaatatatatatcttaaatctccatcttttagtctagcaccgtaaaaaatataaagtaatactatttaatcacccacagcttaatagtgccttagttgtttactgccattgcactaattgctctgtactaatgtgtttttctgtgatatccagtagtgctaagagaacagagatccataaccaattaaatatagtgtttttttttaatgttaaaaatatatctggtgaggctagaaaaggaatagaaaccgccctgaagaaaggcgccttggcaccgcctcggtgcccaccagaaggtgcccggattgcctcttttgcgcaaagacaaagggggtaattttttggcaagaaaacaaacccaaggaaaacacaacaaactgagtgttgtttttttttctttccctcctgcaacttctcggaccgtctctgccctctctcctccagagagggcgagtttcatcctggagggaggccgggggagctgcgaggccacccccagccggcgcccgggcggattgcgagcccccgcgggtccggccgggggagcggagactggccccccgcccgggctggggcgcctgccgcccgcgagccggaagagcgccccattcacgagcaggcagccctggcagagggttaattgaggatcattgttgttggttccaggaggagcgaagcgcctggagatcgggcgcgcgggcgcggctctgggagcgggggaaggtgaggggaaatgggacatgatggcattaataatcgttaccaaagacggtgggagtaacaaaggaatgcgtctccgagacgccgcccagccccggggtgttttctggcgcggtcgcggtgcaggaacgcgagccccgccgccgagcctcccgccgcctgcgttcgttggcgcggcgcccggcggtagtgccaccccgaggccgagcgctgcccccgccggcccgcggctgccagccggccctgcccgcgcccgggccccgcgagcggccgcacttcaccttacggaggggagataatgagatcaattagaggcgccgtcaccgcgccggagacagctgccgccgcatagtaatcacccgcgggctgggtgcgcgggggctccccgctacctgcgcgcctgctgctcccaccacgcggcaccgacccgggcgcgcccccggcccctgtccgcagcccacagccacaccgcgcaccctacaccctccttgcgcctctgctggggagctcaccccctccactcgcacagtgcgctgcggcccggggtgtgggaggtcccgggacttggggtgtgagtgcctgtgtgggggtaggggcaggtgtccgcttgtgcgcatatgggcatgagtgtacatggcgtgtgcctggagatgggcgagtgcaggctggaatgtgccggcgtggcacgtgtgtgggcccaaatagatgcgtgtgtgatcacatgttgtgttcgtgtttgcacctcgtgtgcctgtgtgtccgtatttgagtgcttacaggaatgtgggtggtgagtacccgtatgtgggtgctatctgcacttgtatgcgtgtgtgtgtgtaggcgcgtgtgtgtgcgtgtgtgtgttagggatacgtgtagatgtgcattagtgtgactgtgtgtgctcatgtgcctgtgcacgtgtgtttgaggtttgtgtgcatgggtagcgtctgtgagagccatgtgtatatctgcatgggtgatgagtgtgtgaatgagtgtgcgcgggtgcccactccatgtgagtgtatgcccatgtgtgtgcttgatgtcttgagggtggggacagctgctgtagcgccctctccctcaaccccttgtcctctagtggctccatgggtaccaaggtttctttgccaggcagttgtccctgaggaaatttccagtgcccagtctccctggtccataccttggcatcccctctcccccaatccctatacacgcctttgttgagggtgatggtgatggtggctcttgacctccatctgtgtctttgccctggtgtatttgcctttgtcggctggccctgttccaccccgcagagggcgatggtgtctctgacctgagcatagaggtgccttgccatttgctccaccccagccccctgcctcccactacttataccagataatgaggctgggaacagccaccagagccctcacagacccagggtggtgcagcacctgtcaatttcacacagatagcacccactggatactccgtgggtctgggcagggcatctgctcactttcagaaacagaatgggccagggtctgaagaagagtgggaagcagctgtggtgggagtgagctgtggtgggagtgtcagtgagctcagggcctttgcatgggttgtttcctgcctggaggcacttttttcctgtgactctcagctccatggtgtgggttccctcttcagcacatcctccctgacactacccagccagtattcccattcagtcactcacattgtccagttgactcccttgactgccgcctggctcccccattaaagcacatgtgcctccccctgccccgaccccacccccaggctaggaccttaccttcgggttcattgctgcgcccagcatctggctggttctgtgtgcacagtgggtacggggcagatggccaacaggtgtttgcaggcctctgctacttggctgccctgtgggctcatagtccatcaggggaggctggcaggcatgctgggctagggacagggccatcctgacatggggaccctggaaggggatggagcttctctgtcatcgagagagccaacgtggcctgacactggggcaaagatgtgaaggagaaagaaaggggacaactgtctccagacttgcccactagactgaaggcctcatgagggcaggagcctggctcaggttctcgggaaagctggcagcccctctggtctcagagcctcgggatgtggtgggagtcctggatgttacccgtgtgggccgcgctcacagaactcattgtgttacaggaccccaccactcacccaaagttagcctttgggccaggggtttccacactatagtcgcttctgtggtcgccagaatgatgttacgggaaagaggtaccgatccagaccccaagagaggcttcctggatcttgtgtaagaaagaattcagggcgagtccgcagttcaaagcaaaagcaagtttattaagaaagtaaagtggtgaaagtacggctactcgtagacagagtagggcgttcaggaaagtaagaaaaggaatgagtccaccctaggtccaatgctcgtatatataggataaaaaagatcatggggagatgtgctctgctacaagggtttgtgaaaagggagtaattttcttaattactatattttgcaagaattgattttattatctttaaagcaaaattaggaatgcctttgttctcaagatattgggatattaggatactcccaaatctgggtctgttgagtaaccattatcaatctgctcccttaaccataaacatctagcagctaggaatacctcactttctgggaatgcagtccagcaggtctcagcctcattttacccagctcctattcaagatggagttgctctggttcacctgcctctgacagttgggtggattctttgttgcccaataggctcccaaggccaccctctccagctgctgggagtctaatttcaaccctgtctcctcaaatcttgtgcccctgaacaagtgatttggccttgctgatggtctcaacatggtctgagagtccctgtgctgtcttccctaatgccaaaatggacttggcaatgagtggaggcttcttagtcgccccagcctggatgccctaaccaagtttgggtctactttttatgtttttttaaagacaaattttcactcagtcacccaggctggagtgaagtggcacaatcttggctcactgcaaactgcctccgtggttcaagccattcttgtgcctcagcctctcaagtagctgggactacaggcatgagccaccatgcctggctaatttttgtatttttagtagaaatagggttttgccatgttggctagtctggtcttcaactcctgacctcaggtgatctgcctgccttggcctcccaaagtaatgggattacggatgtgagccaccatgtctggctaatttttatatttttagcagagatggggttttgccaggttggccaggttggtctcgaactcctgccacatttgggtcttcccacacatgctagtggtgctgaatcggggtggtttggctccatctgagataatgggaacatcctggctgctcttgaaagttctgccttagacccaactgcatctcccttgaggtctctgcccttcattgtcttctttccatctcctgcattgctccagccgaggtcccttttgctctaaaggagtgggacaggaacaaaaactggtgaactttcttacaggaaagaaaagcatgaaaccttgagtgccccttaacaaggtgggagatggcttgtctctgttctggacctcccgaagttgttcacttcaagttttgaccccctgagggcctcctgtgtgcaaaacgctgtgccagtgctggagggacaaaggtgtgggcctgtgtcttgtctctcccaaaggatgttgacaggggtctggatttcccagagtcccaggcataaggagtgtggggagggggtgatagctccagccctgtccaatgctttggtcctgaagatgggcagttggaaataacacatgtgccgtcaccttgaaaacctcggtcaaatattgtttgaaatatggaggtgatggttattatttttatgtcccaaatgtgatttgttttgaagtttgtgtattctcctgactagagctttcctgacaataccgtgggaaggtttgagtaaggcatccctctcccacttttgtttgtgagggtccagttggtcctggccacttcctgaatggcctctgtgttgggagctcccggtgaggataagaaagagaagccagcctgagctctgtgctgcccggcatgatgacagtgatgtggtcttgattctttgagcgtcagtcatggctcccaagtctggcaaaatggactcctggctgatgtcttctccactgagcctctgcaaccccagtgcgtcatgggggtgtgttgaatgctttctgtggggttgattcctgtcgccataaggaggatggggtggggcagggatgtatcatcgttgccaggagatctgacaggtggaaggggtgaagggtggagaggatcatgggtgaggaccagaaaaggaggggtggggcttgagggtagacaagcagaagggctggggggtgtagtgggtatgcggtgggaggtgggacgatgcccaagtaggctgctcaggggtggtgcagggtggatgaagggaagagatgccataggtgggagtactcattccactggctgcaggggatgctgtaaggggtgctgatgcagctttgcaaagccaccaaggcatgcctgggacctcctgtgactgcccgtcactcaggagctttctctgtgccaggcactgtgctaagtgccctacttaccttgcctaatttcatcttcactggggaagtcctggcgaaggagctgaggcttttgatctgtgaatgagagagctcagatccagaggggtaaaaatttgccagatgtcacagagctggccagtgatggagcagggacttctgagcccaggccaccaccgccgaggacatggccactcttcgtgtttcctgcacagagcagctccagcagggagctgagctgaagaccccaacagaagaagtcaaggcaaaatatagcccaagtcctagtgcattcttcagggagggcctttctgtgaaaacagatttttttttttgccagccgtcagccttttgtcccattttcacatggcccaattagacaattgcaccccctaattagccagccttaggcactacttgttgcctgcatagaaattcacacatggggttaaacgttggcaggaaacttcgtccttgcaaatgggagccgtggtgtcagtgttggagacgggccaccctgcagtgcatggcccagaccatgctaaacccagccaggcccacgagcacccccggagaacccacggctcggccctgagacactgtgaggccacgtgaatctgagttatcagtggccaaaaaagaggggagacacagaagagtcataaatgttaacttttttagcactctgtaattccaaagtgattcaactgatttgtttcaaactctgcaggaaaacccagctgtggcatcagatgtgagccctctcagaccagaaggaaatctcttgcccttcgatgcttagccttaaggcagtgagagggaggaagctgtgttctgatttcccttagaagtgcagcttcctgaaggaggagtgtgtggcattttccagaagactcaggtctggctgcttctcagcaaggaatggtcctgagtccacccaggtgcccgatgcgtgtttcttatttattttaaaataaatttatttatctaaatttatatattgttacatatttttaatttttaattttagagacaggggctcactctgtcacccaggctggagtgcagccatgcaatcaccgctcactgcagcctccaactcctgggctcaggtgatcctctggcctcagcctcctgagtagctgggactgcaggcatgcaccaccatactcagctaattttaaaatttttttgtagagacagggtcttgctatgttgcccaagttggtcttgaactcctggcctcaagctatcctcctacttcagcctaccaaagcactgggattacaggtgtgagccaccaccatgcctggtctatatatatctaataatcagcacaaaccatgcccccagagggagctaatatctcttgattagatcaatgctcctttgcatctcctatgtgccaggcactgtgctggggactgggtgacaggcaagttccttgtttaagttatggggagggagaaggcaggggtggatagaggctacacagtcacctcatacatgaacaggattattcccactggaaaaaagtggaatgtggcagggacagggtgcctcattcagatggggtggtcttgggaggcctctctaaggaagtgacgcttgatctgggactggcatgggaagatggagccaggcttccagacagtgggatcttgcagggcacaggtcccaaggaaggaacaggcctggcacgctggaggatttggggctggagcatgagggaccagggaggtgagatgggaaattaggccataatggccccaggtcccagagcctttgcaccattgcaggctggggcaaggggctaattccaagggccataggaagcctcaaagggtatggatgcggggtggttgatggggaacgttgtaaacaggctttctttccatggcaggggacagtgcaagggacagaagcgttcagagtctgcagggaggtggagctgaccggagcgatctatgtggttctgtgtatttcatctcttggcctgtgtgtccccatcctaatatccttgaagtatcaaagcattgctaaataaatacccatgaagtttgctacaggggaagccagcaaaaagttcttaatttaaattcttgttttggaagagaacaagcagagagaagagaatgctttccattccctggtttaagtctcaatgaaaatggccatgtgagacattttgggtaaaaatgaccttctttggctcccattttggctgatgtgttcacttcttttccacggattgctacctcccctccctgctgcccccgcctgcaaagagacagctctgcatccatgtcccatttccgtgttatggctagcgacagacacagttattagaagaaagttgtccgatttgaattaagcataaacatgtcagcttagtggtctggacaccttgtaagtccttgtgcatcatctgtgcaaagctcttatttgatggtttgatgaagtttcggcaactgcatggtctatccagtgcctcccgtgctttttctccaagacatttgggtggaaaatccacaaaacaataatagatcaatacatttaaattagaactttcaaaaattcaataatggtatttacaaattaataaagcactgtaaagaaaatatctgcacttctttatttagggatacagttaattttttcattgattaagcattcttttggtggatgggatgtgggcagggaattttttttttttctaagaaggaagttctgtgtgaaaactagaagtatttgcgtgtttttggtcccacttgtaagttactaatgcatcacccagacaaaggccgatagtgagggaaggaagtatggcttggcttggcagaagctaccgcagaggtggaatccactggatcccatgtgatctacatggttgtgatgaggatggagggaagggcaggtgtacaaattcctgcggtgggcggctctgacttctgaagcacacaggtgttaactgtgtgaaggaaatttggtataggaaattatcatttagcaaacataaaccagggagctactcttctttgtgcaaaagaatttcccatagaaatccttaaaattagcccagatagtcttgcacaattaaaatcaaatatatttctttttctcctcctaaaaacaacaaacgtggcaggtgtggtggtccacgcctgcaagcccagcactttggaaggtcaaggtgggcggatcacctgaggtcgggagttcgagaccagtctggttaacatggtgaaacccagtctctacgaaatgtataaaacttagctgggcatggtgctgggcacctgtaatcccagctactcgggaggctgaggcaggagaattgcttgaacccaggaggcggaggttgcagtgagctgagaccatgccactgcactccagcctgggcagcagaatgagactctgtctcaaaaacaaagaaacaaacaaacaaaaaaaacaaatgcaactcaggttttcaagactatgcctcctgtatccaggaaggtagatctgtaccttgctaaggtctggggtctgcccagttcagatggtgaacaactgagaaagagttgctgacaagttccaggaggccctgtggaggtggctgcaccccaccaaccactctgctagctggatgtggacacagcctaaaccacgtacacacctgcatgcctgtggcccagggcctgctactcacttactcctcccctttatcctctcttcttctgcccaccttccttcctttctttctctctttctctttctttcttcctttcttccttcctttctttctctctttctctttctttcttcctttcttccttcctttcttttctttctctttctttctttctttctttctttctttctttctttctttctctttctttctttctctttctttctttcttttctttctttctttcttttctttcttttctctttctttctctctttctttctttctccttctttccttccttccttccttccttccttccttccttcctcccccctccctcccttccttctttctttctttcctttcttcctttcccttcccttcccttcccttccctcccctcccctcccctccccttcccttccttcttccactctgccagctggatgtggacacagcctaaaccacatacaccacctgcatgcctgtggccccacggtctgctactcacttactcctcccctttatcctctcttcttctgcccacctctttctctttctttctttctttctttctttctttctttctttctttctttctttctttctttctttctttcgtttccttctttctttctttctccttccttccttccttccatcctccctccctccctccctccctcccttccttctttcctccctccctccctttcttctttctttctttcctttcctcccttccctttccttcccctcccctcccctcccttcccctcccctcccctcccctcccctccccttcccttcccttccttcctttctttctttcccaaaatattgattaaggacccatggcagaccacaggctgtgttaatgctgggggcctggtggcgaagaaggtgtcatggccaagaccctcttgtggatgcacgatcccagtgggctggcacaaagtggacacccagtgcttttcctattgaatcatgtcctgggtgggaccctgctttggttgcatgggaccttcaggcatcgatgtgggtctggacacaggattcttcttcctgcattggatggaaaccagaaacccctgtggagcatgagggtcaaaggtcatccacttcttgcaccctgagggttgagagaggaggaatggcttggaataggggtaccaaatggtgtttagaaaatatgtgttcagccaggcatggtggcttacatctttaatctcagtgctttgggaggccaaggtgggaggattgcttaaggccaggagtttgagactagcctgggcaacagagcaagacactatctccacaaaaataaaataattagccaggcgtggtggcatagcctgtaatcccagctactcaggaggctgaggtgggaggatcccttgagcccaggcagtcgaggctgcagtttgatcacgtcactgccctccagcctgggcgacagagtgagatattgtctctaaaacaaaaaaaaaagcaaacaaaaaacccagctccacctcccattggttgccagtccttgtcacctgcaggataaaggtctaacacccggacttgatgtttgaggccttccctgcagcagctgccccaggcatccttctctttcattcagggtaggaagggcctttccaggagcaggagcagccctgaaatcgggtggaaatggacatgaggaaggaagagccggtggtggagtttgtctagcaaccgcccagagactgagggaggtgatgacccgatgggggtcagtgtgggttgtggtggctgaagcgggaccaggggccacctgcctggggcctgggtgccctgggaagcagtgctggttgcactggggggacagctgcctgacgggtgtctccctgtgggctgggtaacgaccgttaccctggttgcagtgcttcctctcttctcctggagttcctgactgtcctctgtggccttgtcctcattgctcttccctgcttcacccactggttccagtccttgtcacctgcaggataaaggttaacatccggacttgacattcaaggcatctccccaggcatccttctccttcttccagaccctgcatgacaagctgccatctcccagggaatgggcaggacacacctgtccacccctgcgtcttggcttttattattccttctacccatattccacctacttctccccaacttttcagacttgatggtttaccccaggtgcaactccgcctccatcatgaatctcctgtcttctgaaatctgcatgtgcgcactgcctggaggtcccttcagtgatgctgctttgggtccccagctgggtggagccacagccacatagagcatctggtgcttagtgggaccccatggagttatctgaaggagtggcagtgcctggatcactgagctggcagatggacatcagggatcatgtggcaatgtccgtctgtctcactcctaacttaaacttcgattttaaaaaatgtggcccagaacattctgatgtcagctggtgttgcatccaaggcccctcaatactggtcccatcccaccttcccagcttcatctcaggcaacatcctcccatccctcagccctttgcctacgctgtcttagaaagccagccactttttctccttcatctccactccagaaaactccctttcatcctgcaagagccagctgaaaactcacctcactacagaagccaattctcacgctgctctgagtggagttagcccctcactcagctgagctttcatctctgttacctgtgactcttctgaccatgttattgtctctctacagtctctctttatgaatgtctgcccctcctgtctcttacctccttttttgagatagggtctcactctgtcacccaggctggagtgcagtggagtgatcatgggtcactgaagagtcgacctctctgggctcaggtgatcctcctacctcagcctctcaagtagctggtactacagatgcatgccacaatgcctggctatattttaaatgtttggtagagagggggtctcagtatgttccccaggctgttcttgaactccagagctcgagcaatcctcctgccttggcctcccaaaatgttgggattataggcgtgagccatgatgcctggcctcttgtctcttctgacatgtagtgggtctttggtctacatttgccaacctcaatatctgtaggtccctagggcagggcctggcgcacagccagggctataggtattaggtatttatttgtggctttcaggaaccgatttttggtgaaagacacttggaaattagccctgcgtttcacagaacacttctattacagcggaaacagtggcagtgcttgtctgcgggtcgccggcatggacagcaggggactgcttccgagggcttatccaaagtcacagcctatcagcaatttttaagataacacattgacatctgtgtgtttaagattctggtaaaaagatgctagaggaagcaatgtgcagacgagagtcggtctgtttgatgtgtgattgaagtgtcagtggagacacacagagaaaaggtgtttggtcaaagatgaagcaccgttttcatgctgaagatctgccctcactcatgggctccaatgtcccttggctagaacctgtccaggcctcagtatggtaccagagggaggcctggatgtggggagaaaggcaggtgcttagctgatacttgcaaaggaaaatttgcaaaaggggctgtaacagagctgtcgctggttgcagcctgactttgaatcttgctctgagcaggaccgtggggacccgagacttctgcagcccctggttgctgtgggctgggccccaaagaccccattcagggaggctgatgcaggggccatgcttgagagatgcccagaacctgccctcccatggttgacggcggtgagggacccactgcctctttccaagccatttattgccacttaccacgagcttggcttacatctgctgctgagagcagagcgatcccaatttggaagccgtggaggccgtttttcacccacactgacataagccatgactctcgaagctgatgacacacttgagataaggtcaaatgctcaacagaaagggacatttgttgcttaatccctgtttgcagagaggctgcagacactaatggctggaggaatatgtggtccttgtccccaggggacctggctggaaggcagggccctctccactccatcgcttggaaactacttaccctactgcacaggatatcagggaagaggcttggaaagcccagcctagagaggggacttagaccctgcttgagggatggggttggggaatgttctcgagacgcaggtgtccaggctggttggtcagtgggctttgggccctggagggggctgtgtgatgagccaggcaccagctgggtgtctgtgtagataggatggtccataggtggagccccttagaggtcttcttcctgcttcccatgtaatctcctgtggctctcagattttgaggtcaggttttgaggctgtaagaggtgctgatttggccaggatataagtactgggagaaacacgaggggaaaagaaaagacaagggtgtgtctataagatttcccgggggagtgagtcagaatgaacggtggcctacttcagtcaacctgagttaagataaagaagaccatggatcgccttggcctgggacctcggtcaaagtatccgtatggatttcctttctgggtcttggtgctgttgagggaggtcatgtgactttgcctaaatcaagttagatctttctacaattatggatactcggtggggttaggcagggggcttggaggcaccctccagaagccttaatgggggcgaccccgctcctccagccattgtgaccactttgtagggtttattgccccagccctcatggtccactggaaggtgggagttccaccccacagagaccacccagcggtggccatgcccggggcttgccatccaggtgcagagccctccacgatcgcctcgtccctcctgtgcttggcagggcttcttcaacttcttcacttgggggaattttccagggcaagccagtgttgtaggtctaaaccctcacggtgttttcttgcatgccaaggctgttgggagaagctgaatgtgctgttatcaagagaccagttctttagaaacaaatgctatgattttcagaattaggatggagtgtaagattccttctttcttggttaatttatagtagccaatgggaagacagagagagattcctttatgggcttcctccactttccaggcttaaaatcatgtgctgggcccttctacatctcattcagacagctggcaatggccatttatgtagggtgagctgaccaactgcagagggctctatttcctggaattctcccctacaaagcaagtgtagccccttcaggaggtgtaaaggcttgacgacctgtgaggaaggagggagtcccatgccccatctctcttgatttaccaggctcctcttaccatgagccagagaacacaagactgagtgtcaggcctgcctgtttcctttccttgggtgtgggacccccctagtgtgagttcacccagtccgcacacgttccacgtgcctccacgaagccaggcctggttctccaatttccaagtagagttctggtttgcgcagcttttctactcaaagggggtatgcggaaggccaaccatgtggttggtgatactcgtgtatagggtacatttggggagaggtttcctgggagggcgagcacttgcatagagggttatcttagtgcccttgaaaaatctagcgaccatagatgggaccttgcctctcctctactctggacacgagacccttgtaaaaaaaaattccctttttgctcaagatacatgctcctcacccatggatttttaaaaaatcttgtccatgcttcacagctcagaaatctcttaacctgttcagtacagatacgactagtaatgatttgtccccaggggctgtattatggtgacactcatcatgggccattctctgcctttctcattcatgagaaagttccagactgggctaagcgaaggccaagaccagaacccttgaaggtactggcccagaaaatgtcctttgggtgaagaagtggtggtgcccttggctcctgaatcctagcagattctttttctagggactccatttctgtcccgcctaatagcatcctgctggcccaagcagatagcagagagctgctgtgggcccctccagctccctatcttccagaagggccacttggctgctgagtgtggcgcagtgacattttccaacttgagctgctaaggtctctagaaaaagatttttccagcagaattagagaggaaagaaggcttgctgtttctgatatgttttacctaagatttctcaaatggctgctgggatcccaactcctcccagggatttccctcctcaaagatatcttggtagatattcaatgggggacctcagaggtgttcaaggaaggactccatctccattgaggcaggtgctgtgcaggggaaggttttactccttcctaagcacttactgttgcctgaatctacttcctaggggttagctgcaggggggttaaggttgtgttgagtagagagaagagaagagaagcctgctaatttgctttttttcctttactttaatctttagttcagctgcccttagtataaactggaacttataaaataaaaaaatgctagggacttctcctctttctctgttaataagctcgcatgctgaaaaaggtctagatgagaagaaaaggaagcccaagtgagagtagcattaaataaaactctttagggtgaggtgggaccagggtggcaggcagctgcaggggagtttcagtgctagaaagtggagttgaactctccaaagggaaaggctggaggggctgaagtgagtacaggctccccagcccctatgctggtccccacttggccatgccaatcttcctagccaggctctttgagagcaaatcccacattctgccggagagctggaaatccagtcttcttgaggtctgaaggtgcttttatgtttccaaatctatcggagcctggagtgtcctctgtagcccttagaaacagtccatggcaaagtcagggatccccactggcagagcaggaggcaggcagccccgtgagcttactggaggattctaatcaagtgactgggaggccggagctcttggcatcaccgccagcccccgcccccatgtttacactcagcccccgttggcaccaatggggatctcaaacccagcctgggaccttgggagcatctattccaatgtcagaataaacagaaatccccacttgagagtgttatgaatcttctcaacacagcactttataaacctcgggggctacgtgcccttgagtgctggcagcattaatatttattcactagggaccaagttttgcctgcagaagcccatgctggtgcctggaaattctcctgtgatcagagccagaggcagagtcccagctcttgcactgcacatacctgggaaggtggttaggagcaggcctggaatccctcccaacacggccaaatcactcactgccactttgtccctgaggaattccaaaacacaataccacaggatgtcttgcccatttctgatcccaggtccaaagggcccaccttctgccccacatctgtcccagtagacttgactttaaactgcttttgctggctggctgcagtggtgcacacctgtaatcccagcactttgggaggccgaggtgggtcgatcatctgaggtcaggagtttgagactggtctgaccaacatcgtgaaaccccatctctactaaatacaaaaaaatagccgggcatggtggtgcatgcctgtaatctcagctacttgggaggctgaggcaagagaatctcttgaagccgggaggcggaggttgcagtgagctgagatcgcaccattgcactccagcctgggcaacaagagtgaaagtctgtctcaaaaaacaaacaaacaaacaatcaaaaaaactgcttttgttcagggtgaactttattcctggcgcttaattgtaaagaatgataaagtccaggatagaccacagagcgatctgagaaagaccaagagaaagagagaaaaaggtaaaggcacacacagaaaaagaaaaacatgctttcaaattcactgacaaacagcatcttccactaaactttcccttgttctgattgtaactcccagccaccccttagctagctgtctttgaattataattgcctctcaaactcctggtactgtaaccttaaaccttgtaattgtgccccaggacaaatcagtactaatttagctaatgcagtacgtcttagacatctctctagcctccactttgaataaggatatcctccccccttcacccccgccaaaaaaagtgtattttaggaccgatgaagcaagtgtgcatggattctaggttgcggttctcggatgtccggagctgggggccagaggagaggggaggtgctcagcttccaggactctgaggggagaagggagtgagtgtctcctctttcacagccctgggaggactctcagccacaccctttcccttgggaattccagtccttcctaggggaggcccagcgctctcatgggtctcctctagaatttgcaggaaaccagtaggaaaccacagatcccctggggcgagggaggtagggacagaaagattgtgcggttgaatctaaaatatgaagggaggttaggagcagccgccaaagggattccattaaggagaccacagaatttagccttatgaagttcatgcccatgtggagacaacgccagggtagccagagaagggttggaagggctgggatgtagaatccgtgccctgcaccaccgcccggcagcaattatctgcggttagctggttactccgagctgccaactcctgaatgccacggcctcccaactgagcctgagacatggcattttctgagccagtcctccttctttctgtgtgatttccattttttctagggtgtctctgttcttagaagtacatcagataactgctcttaagtgagctaaaattaagctcccaaacaaagagttatgagtgctgttttatttctagagatgaaaattgcacgagtaacttatttatttgactacattacattacagtagaaggaaggagaggactgtggtgcaaaacagtaattaactgttttttctctgtcctgaaaattagtgcatagttagatcaaaatatgacagggtgcacgctcatttaattttttaaattgcttggtaacttcaaataaaaccactgctgtggatctgtaggactgtgtgaatgctgaatactcaatggcattttggaaaccacttctgtatgatctgtatggcacaagatgatagcattcattcatttatctggtcagcaaatattaacgacacctactgtgtgaagctgtctctggggagcagtcatgcgcgctggggaattatgtgagtccaagatgctgaggaacaagaacaatcccctgtatcatttattcgtccatccactcattcattcactcaacaaccacttaggcaacttcatttctgtgttgaggttcctgctcacagtttaatgcggtaggatggggttgggggcgggggagaggaaatgagaactaccaggatacatatgagtcactgaggcttgtttgctgatctgatcaaaagaagcacatgcaaagccatccaagaagagggtctgattcattcatttcttcctatgctcactgattaattcactcattccaaagagtttattgaagacctactgtgccctgcagataggatgatgagtgaaatagacttgatccctctctttatggagcttacagtctggagagaggggcagatgttcgtcagagaatcacatgaaccaatgtgaaatcattagtctggcaggtgccttaaggagaggtgtctggagctcacggagcctctggtcctaggctaggggcagcgtcacattctcaggcaggggttacatggaaacatctcagggaagagcgttccaggcagagggaacagcaagtgcacagaccctgtggcagatggaacttggtgaagatgaaggctgaaaggtgggcagagtgaggctagaggcacagaggaaggggaagctgtgagctgagctggagagaaagattgaggcgacgccacagaggccttgatgaaggattttaggctttatctgaaaagcagtgggtaaagccatcatgtaatgtgaatgttgtttaaggggcaatgtgggcagaatggaagcctgggtgtttggtggtgttggacagggcagtggtggaggagatagagagaaagcagatgtgaaacatgtgtgggaagagctgcctttggtccagagatggaagctgaaggagtcagagtctgcagggctagatgggcaggcagagacagtagggaagggcacgtgcagatggaaaaagggcagctctctatcagatcagtgagcaagcctcagtgactcacactggaggccacaagacctgtaacaatgaacacacgggacccccttggatggttccttaattggtggtccaagacttttccttaaacgactttccttttctccttcttgtgttatagaattgctgaaattttctgaagccagtccaacaggtgtgcccacctattgcctacttatccgtgatgaacccttacacattgggtaattgtgtgtgcaaatgggtagttaggtatctaactatgatagtgcatgtgtgggtatgtaattactagatttgcatttgcaaatgctcatttccctaaacagccctctccccactcccacttctcagctaccctcctaccccacaacacacacatacccaggtgtaggactgggccaggtgcatctcttacgtctgctcggctgcaccagaggaagctccttcttcagcgtcccttccccattctatgcaccaccatgccctccacactgagaggaagaaaccagtgacatggccctgtcttcttccatctctggtggtaattgtttgccccacctgtaaatagtacagtctggaaattacacatgagcagttgcttttctactcccagttcagcctcacctttccaagggagaatcaccatttatgaactggacttacacaatctagtgtgcaagtaagctgcacactgagctgagctcaagagaaaagttgaggtgacaccatggaggccttgatgaaggattttaggctttacctgaaaagcagtgggtaagccatcatgccatgtgaagggttgtttaaggggtcaaccccttaacactggttttggagcactggtttcggagtcttgcacatctgcttcccctttcagcttgtgagctcggttactcctgaaaataaatgtaatgtgtattcagggtttagtgtaatccttatttgcattaatgcatttgtgcttcatgtcattgtactgaatgaagttctagtcttcttagggctttcgttgtgtacaaagggacaatgcttagattaatcttaattgctaccaattttcatcttatctatggtacaagattaatgaaaagtgataaaagaaggaactgacaggacaggtagtttatgactctaaaatcagatagtctacaaacagacaaggtgtcattttgggtaccataaaggggatgtccaataactagaacatagaagtggcattttgttgttttgtttgcagtatctacagtcaaacacctaagacacacatctggtttggggtggaccagttgcagtttaacgttaaaacccagccctgctggtggatgtagaatgctggtctgaatgtgtcagagtgattggttaagaactgtgcctcctgcaggaagatgactcagggtcacccagaccttggtttatctgccaaagaagggccaccaggatgccttttctggggaggttccatatgttgcgcctaaatgtctcagtgattggattttagtggcatgttctcttctgacaacaagctttgcttctgccatgttgaaatgcaaccttaatagctgtgtacctcttcatgtggctgagtctgagaggcagcaaaagatctacctttctccataatttttgtttagtaaggactttttatcactttaatgcaagttaagctttgttttgaatataagacttatgataactaggtcagttacatttttgttttcattatgttttttaagttaataaacttgattttttaagagcagttttaggtttgcagcaaaattgagtgggaagtacaaaggctcatccccacaattcctcgctattaacatcccccactacatcagtacaattgttaccactgatgaactacattgacacgtcaatatcacccgaagtccatgtttacattagggtgcacttggcgtacattctgtgggttctgacaaatgtatcatgacatgtatccaccattgcagtatcatacagaatcttctccctgccctaaaactcctctctgctctgcctacttcattatgttgtaaaaaaaatgacttctcaccaaataacaaatgccagtcaccaaaaatcccagccttttatttaagcagagggttgattggtacctctctccatctcctgatgggataattttgcctgtagatgggaatttggaatggagaatctctttcaaataagagatcacatgatctgtgttctagagtctataaaataaccaattgaaaaggaagtgtccaacttgacttatattttctggatcaatttgactttctgggaatttggggtttacttttgcttttggcaatttctttagatttgtctcttccatccatctttctttgagaagcttgatgcagacctgccaattgttacagtgtagcagtttcagggaagagagtaaggaagtgattctaaggacaggaggagctttctacagatgtgtcctgcctccatttgctatgagagggctctctcttttttttttttttttttttgagacaaagtctctctctgtcgcccaggctggagtgccactgtagtggcatgatctcggctcactgcaacctctgccccgccgccaggttcaagtgattctcctgcctcagtctcccgagtagctgagattacaggcatgcaccaccatgcctggctaatttttgtatttttagtagagacggggtttcaccatgctggccaggctcgtctcgaactcctgacctcaggtgatctgcccgccttggcctcccaaagtgctgggattacaggcgtgaaccaccgtgcccagccaagcaggctctcttttaaagggcttcctgacctcaggccagctaggcacctccaccttcctgcaaacctcttcttacactccagctttttgctagagcccagagctcccagttggcccttccacatcctataactctatggctgcaaacctgggcacttaatacttgttagaacttgttacttcaggtcttggataatagaggctggggtgacaatggttgtggcttgagactcaggtgataggaaaagctgtacctgtccctgagtttgtgttcttaatctcatgattcgttaacagatggtgttcaatgtctaaagccacctttgcattataaatgggagaattttgctggaaagactctctctggcatgaggactctccacctagccctcatcttttgttcattttgtcaaacaaatctacatgtgttaaaattgcaaagaactaaatacacacaccacactcacagatgagtgcatgtgaaactggtgaagtctgggtaaagctggagggatgtatcaacgttagtttcctggctgtgatgccaaactatctatcattattcaggatattactattgggagaaactgggtgatgagtagacaagattcctcagttatttcttacaactgagtgtgaatctacaattatctcaagacaaaaagcttaaaaaaactcagcttttacttctttgttttatattgccatttccaccatactccttacagtttggtgttctgtggattctttactaatctgcctcgtttatttaaatgttaattggcgtctgttaatttgatttcagtactagaagccaaactcaacaataagaccccttaatgattacaaggtattagagcttggacaagggggtctgaaaagaccctcatccctacaagaaagtaaccagtgttcagaaataaataggcatgagagagatagaaggagagagagaaagagagaataccctaacagaaagaatgactgattggcaaatttaagagctcacaaaacagaccaggtctaggatgttagaaagtacaaacagaaaatagcccatgattttaaacattaattctttagtttctttttcccttttaaattttgaaataattatagattgataagaagttgcaaagatagtatggagaggtctttggttttccccattgcttgcatcttcgataactgtagtgctgcataatagcaaaagcaggaaaccaacatcactacaatgtacctggccacttctgtgtcatttgatcacgtctgtagattccgtaaccactgcctttattatgacacagaagtgctcttcaccacaagatctccctcatctacccatttccagttatatcccctccgtgccccaaccatccctagcccttggtgcctacccatctgtttaattttctcaatttgggaatgttgtataaatggaaccatatggtatatgacctttggcattggctttttctttttcttttttttttttaaattatagtttaagttatagggtacatgtgcagaatgtgcagttttgttacataggtatacacacgccatggtggtttgctgcacccatcaactcgtcacctgcatgagatatttctcctaatgctatccctcccctagcctcgcaatcccggacaggccccagtgtgtgatgttcccctccctgtgtccatgtgttctcattgttcagctcccacttatgagtgagaacatgcggtgtttggttttctgttcttctgttagtttgctgagaatgatggttttcagcttcatccatgtccctgcaaaggacatgatcatccatgtccctgcaaaggacatgaaattatccttttttatggctgcatagtattccatggtgtatatgtgccacattttctttatccagtctatcattgatgggcatttgggttggttccaagtctttgctattgtgaatagtgctgcaataaacatatgtgtgcatgtctctttatagtagaatgatttataatcctttgggtgtatatccagtagtgggattgctgggtcaaatgggatttctagttctagatccttgaggaatcgccacactgtcttccacaatgattgaactaatttacactcccaccaacagtgtaaaagcattcctatttctccacatgctctctaacgtgtgttgtttcctgactttttaatgattgccattctaactggcgtgagatggtatctcattgtggttttgatttgcatttctctgatgaccagtgatgatgagctttttttcatatgtttgtcagctgcataaatgtcttctttcgagaagtgtctgttcatatccttcacccactttttcatggggttgtttttttttcttgtaattttgtttaagttctttgtagattctgcctattagccctttgtcagatggatagattgcaaaaattttctcccattctgtaggttgcctgttcactctgatgatagtttcttttgctgtgcagaagctctttagtttaattagatcccatttgtcaattttggcttttgttgccattgcttttggtattttagacatgaagtctttgcccatgcttatgtcctgaatggtattgcctaggttttcttctaggatttttatggttttaggtcttaagtttaaatttttaatccatcttgagttaatttttgtataaggtataaggaaggagtccagtttcagttttctgcatatgtctagctagccagttttcccaacaccatttattaaataagaaatgttttttttttttttttttgagatggagttttgctctgtcacctagtcacccaggctggagtgcagtggtgtgatcttggcacactgcaatctccgcctcccgggttcaagcgattctcctgcctcagcctcccaagtagctgggattacaggcgcccaccaccatgcccagctcaattttgtatttgtggtagagacgggatttcaccatgttggttaggctggtcttgaactcctgacctcaagcagtccaccttcctaggcctcccaaactgctgggattacaggcgtgagccaccgcacccagccttggcattggctttttaaaattcagcataatgcccttgagcgccatctatgttttgcatgtattaagaattcattcctttatatttctgagtagcacctcatggcatagatgtaccacaattcatttcactattctcctattgtaggacttttttttttttccagaatttggctgttatagccaaaatttctgtgaacaatggcatacaggtttttgggtgaacgtaagtttatttttctaatataagggctcagaagtgcaattgttagatcgtatggtaagggtatgttttattttttattttttaagaaaatgtcaaagttttccagagtggctgtaccatcctacatttgtaccagcaatgcatgagagatcaggttgtttgcatcctcagcagcatttagtatcgtcattttgaacagaattttaactgttttaatcagtatgtagtgttatgttcctgaacatattttcatgtgtttatttgctattcatatctcttttttggtgaaatatctggccatgtcttttgcctgttttctaattatattatttattgagttgagttttgaggggttttgttttgttgttgagacaaggtctcactttgtcgcccaggctgcagtgcagtggtgctgtcatagctcattgcagccttcaactcctggcctcaagtgatcctcccacttcagcctcctaagtgagcagatgagactacaggtgtgagctaccatgcctggcctgagagttctttctacatattagatatgagtctttggtcagatacatggtttgcaaacattttcccctagtctgtagcttgtctttttatcttcttagcagggttttctgcagagcaaaaaatttaattttgacaaaatccaatttattaatttttccttttgtgaattttacttccggtatcatatttaagaaccatttgcccaggacctaggttcctatgatttttttcctatattatcttctaaaagtttcatagttttatgctttatatttacatttgtaatccatgttttgtgtaagatatgagatttaggtcaaggttctctttttgttgttgttgttgtttgtttatagatatccagttgttctagctccatttgctgcaaaaaactctccttccttcatggaattgcttttgcatccttgtcaaaaatcaattggccttacctgtgtggggggctacttctgagttgtccattctgttccattgatctatctattttttttcttttacgagatggagtctcactctgtcacctaggttggagctcactgtagcctggaattcctgggctccagctatcctcctgcttcagtctggtctacatatcttgatatttgagaataagaaagaaggacttcaagatccgggttagactccccatgtcccagtacctctggcctccaccaagaatggatgtgagcactggaactgggctcaccaccccagtggggtttgctctgcacaggagcacgtgtgaaggactttacccactgctttctctaccacattccccagacactactgttttgggtctcttttcatttcttttccttgcttacacatgttctcagattaaagtgggattttctgaaacagattttttctataatggggtaaaaaccgtaagtaaacagaattatcataaccatttaaatagtaataaaatatgtttttctatttctattcaaagagggggaaaggtaactggagaagatgaaaggaaaagctagatttgtgggtggtaggtgtgttttcttcttcttcaacaacaggtacagagttttagtaaaggacttcaagggaaaaggaaaaaaatagcatatactgttatggggttatttttatctttcatttttgtgacaacttatttgtacttaagagaatctttccaaagagttagaagcatcattaaataaagactgtgaaatgtgcaatatggcttatttatttaaatgttaattggtccaacgaacacttctaattagctctatatttgcttagcaaaaagttttacaaattccaattgtgaaaagcagctattttgagctggtaagcatgttgcagcctcagctatgatttttctatagttctcagcccttgaaggcacaatttaatttttcatgtatgcatactagcaacggtaaacacttgcgagtgtaaagaaccttctttaattagctgcacaacaattaaaggattcacaaactaaattgaaccctgtctcggtgcttactagctgaattctaccacctgtcacaacagcactttgttcaatctgttatgcaaaatcattatagcaatatagtggaggggaaaaaaaaagagaaaacagcaattatttcttacttttctcttgaatgggttattttgggttatactgatgtcaggttcattgaagctaaccttttgaaatctgtaacagcataatacttctaaggcagtctcagaatggctggaagaatattccattttacgcttttaggaggaagcagcattcatttctttcctcctaaaagtgctggagactctgatcatttgaaacaacctgttctacctctcccagccaccttccatttgccttttttcaccgggaaccctgtacggctcgacaggcttctgtgttttaaaagcttgcaaaccgcggccgacgtgggtttaaagatgcaattctcaaactgccgcctccagagcatctcgagtcatattacttcataagcccagtgacttactgtaaaaacatgtgtgttgcttgctttttaaacattttttaaaattaaaaaatatatatatatatatatatatatataattttcaaaaatttgatttaaactaaactgctctcctgtttagactgggtcggaggggaatgttacccccaccccaccctggccatttgcagagacaaaggctttattgtgaggcccaaacccaaagcctgacatgacagacttctccctggagtcaaggaataaatgtttacatttggtgttgccgtgccctggccccctggtaggaatgcctgcaactctgggctttcacatacagaagggatggggagggatgctttgcggaggagaacaccgctgctgacgagctgcactttgagatgctgcctggcattgcttaaaatggcatcaataacatattgttagtcccagcctccaaagcatatgtgatctggccatttcagacgtcggagtgactgtagacaaaccgctgagctcagtcagagggtctgcattctcccacattacaatattttttataagttgttctttacatcatttcaggaaaatgcacaacgcagacaaggcaggcctttgaaaatctaaactctttccctgaaaaaatgctgaaaggaggaaagtgagagccaaaggtcaaaggctgcgcaagaatgtgtttctctatttttcctatttcttaagcagaggaaactgtcatcgttgtggcatttgggtaagaaggactatctccaatcaggtccaggagggagaatttgaagtctacaggggcttctctcttctttctgctgaaatccaactctttggctggtccagggctagtgcatggaaactaaagtgagctgctatccgctttattgaagttggtgaaatgcatacctcctgcaaacttgcagctctagaaagaagacccacttgctgtcttccacagcctccctgtctgctgctgcactcggctgcagttttattgccagagtctccaagtgcaaggtccagctgctctttgtccctgggcatgctgtccccctcgttcttcctgtgctcttgacaacggtgtctgcaccaggcttttgatgggaggctgctgttgccttcagggatgggatggtcacatagtaggctctcagtgaacatctggtgatgaccgtaaatgtaatctccacttggccgaagaactcatgggaattgaagggtggattcaggcaatttaagcccttcagcattcccctctacatttttttctttcctttcctttcctcttttttttttttttttttttctgctgttcatttagaatctcctcatcacggtgcactatttgttccatcccacgtttcttattgctagtcttgcaagggaagatggtaggtagaagaactgtagcgtaaggccagcgttgcccacgcagggcctgcctaccttgtgctcagacctgggttgggcacaaagggggccatcctgccttcaagaggcttctagtctgggcgcagagcccagactccccaaggaaatgtggagacagccttggtgtagattctgtatttggggcaggccagagggggacactgttttctggcaccccagcatccctggaactccagcatcctcaactgcaggccacttgaggtagtgatggcttagcagtgaggcgcatggcatgtggagacaggcagtctggggttcagtcccagcaatctagtgatcagatgtgaaactttaggcaagttatttaacctctctgtgcctcagtttcctcaaccataaaacgaatatgatagtagtaaaactcactgatagagtttgagaattatgtgaaggcacttagaacaggactgagtgcccaggaagtaccacgttagttaccattgctgtttgtttctagaaaactctccaaccatgattttcctcttctcttatactacaaccacagtcatcaacacagaagaagacttctgtgaccaaatgtccggaggcgggggggctcctcaacacacccagcagtggacaccagctgggtgtccccaattcaattctgccaccatctacccagagatcccacaggttgcgagctcagtccccaagacggtcctgccccaggcaccagttgcaagtccaggcctcacgaacttctgaccaacaggcttcacgttggggttcccatgaccccctctttgggtcctattaatttgccggagcagctcatggaaacatttacttatgtttaccagtttattatcaacaatattacaaaggatgtgggtgaagagaggcgtaggggaatgtatggggcatggtggggagcttccacgccttccctgggcaccactgtccgggaacctcaaggcattcagctatcccgaagctcccagaacccagtcctcttgggtttttagggaagcttcatgatgtcatacatatccttcagaatatagggtgagaccctctttggggagggtcttaagaccccaagtcagaaagatgggggaagattagagtcctgccttggggcaggtgaaaggaggtcagaaaaagatcagaaatattctgtttcctgaggcctaatactgccaacattacaacaaaagactctgacagggaccatgggagttatgagccaggaactgcagacaaaacctatgtatatataataacaccgcactgctacttcctgaacttggggtctccctgtgcctgaactccataggttctgagattcaacagaaccttaggaaaccatctcctagctcctggcttcaggcttgatgggtctgatgagccatcagaccagagtcttccagggaaagcttctccatgggtaccaaaccatttaagactgcacttctcccttgcctcttgatactgtttatgggcgcagtgttgtagtctagaaggtggattttcagaaccggtgtgatcagtcgccacacccgaatcgttttccacctttgcatcctgcctactggaaattggattacttactgaagaatgtggaggcccttgatgcagaggcactgttaacatttttttttttttttgagatagagtctcactctgtatcccaggttggagtgcactggcacaatctccactcactgcaacctccacctcctgggttcaagcgattctcctgcctcagcctcccgagtagctgggattacaggcacccgccaacacacccagataatttttgtatttttcgtagagacgggatttaccatgttgtccaagctggtcttaaactcctgacctcaggagatccacccaccttggcctcccaaagtggtgggattacaggcgtgagccaccacgcccagccactgtttctatcttatcagacctgaaggatctctaaagtcaggagttcctgagtatcttccatgctagaagtatgtgcattgttccatgtgcagggcacatgggagagacacaatcattgttaacatatgaatttatagcctagcaggggcaccaagaaaagggaacaactagtcaaccgcgatgcatgcccagggagaaacaacccaaggaagaggagtgggagacgagagagcggagtgtggttaaggactaggaaaggatcaggagcaggtgccaccgagcaagaatcttaatttgccatggtcatgggttggggaaggttctgaaggtgttttctttgaaatccacaccgctttactccaggccaacagggattttggccaggagactgcaggctgatgtaggagagctctgctgttggggaaggatacattgtagggctataaatacctgagataggaaatgcgtatttttagctccaagcattgaggaaacttggattatctagcagtgattggggtcatctcccagctctgtttctacactgggaaactgtacggccagttttccttttaagggttgagcaacgtgccggggctggcacagcttggtgcctgacacagagtgacccctggagactgtctgtggaatgactgtgtgacagcctccagtgaacaagttttctgtagcgggtgtgctcctttaaagcaggggccaccacaacttgttggcatttccctgggtgttgctatcatgtcagtttctcatggtgataaccttttaaaagatgtttgatccctaaacagtgtagaaagagatgcgagcagaggagatccacagagtagacagagggcatccccaacctctgttgtctctgctttggaccctggactgactgcaatcatgtcgggtcccaccagttactttaatgaggggggattttgcttttgcagaagttgctgcctttcttgtgcctgttactttgctcacttattactggggtcacagcaggtggctggataaaggatcaccggaaccagggagccagccctacaactccactttgctcctccctgacctaccctgtcctgtgtggccaacagactgaccttatgatccccagaaggctgaaaaatctacaaaggatgtttcttcctttttgtttatattgacgttttgctagtttttctaaacattacataatgagctgatttcaaaatcagcttgctgtttcgagaaaactctccaaccatgattttcctcttctctcacactacaactatagtcatcaacatagaagaagacttctgtgaccaaatgtcagggtggggggctccccacacacccagcagtggacaccagctgggtgtcccccaattcaattctgccaccatctacccggagatcccacagggtgagagctcagtccccaagatggtcccgccccagacgacagtcacaagccggggcctcacgaacttctgaccaacaggcttcactttggggtttccaaaatcccctgtttgtgttctgagcagcaggaagggaatggacatccctgggtgatcaccaagatgagttctttgctgtctctcctttcaggcccttatgcatatatattctctctttttgttgttgtacataaagtggattatgcttgcataccattttgtgaacagccactgaatttaatgtattcttctgcacccttcttgatgagtgcaaaaacaattgcatgactctaccatgattgatttatttaatccagtcccgtgggtggaaatacagatggtttccaattttctttttctctcattagatctggggactgggctccttgtctttggctcacagaggatgactggggtttcctttgttgagaggaaagtggccgtcatgaaatcagttgggttttctctgatgtgatgggcactatgagtacctgccttggcccactcatcaccaaccctgaaggggtctcaggcatatacttttggattggaggtgggttatgagaaagatgggctgtgtttctttttgtgtgagtggatgcatgtacctgtgcacgagtacatgtgtgcacagaggtgtagaggaagttcaacctgttttttgctttgggtttgtggtgattgaatccaggccattatagaccatggggagaagggtggaaatctgggtgttgcattctagtaaaattggccactagtataattgccctaaccttctgagtgtctgctcacgggtgttaagcatttgtctgtaccatttttgattagtgcatggtatccaggggatgcccttgtgagccagcctcccctccccatcaccacctttgttccttgagcttctttccttcagtactccatctgcattatttgtccaggccacagccttttctccaggaattagaaagtcatcactgttttctactgccattcaatcttcttgacctctggtgagagttgtgagctgctctctctgccaatttcagcagctgggagggatattggtgagggcacaggaagtaagtggaagaagggtatcaaggtggtcacatcgcagttgcaatctgcttttgttttattcctttggttgttagtaattagttattcatccatccatatgtccatccatccatcagccatcattgatccatcggtccatctgtccatcatccatccatctatccttccatctattcatacatctatccttccatctattcatccatccattattctctatcatccatccatctatatattcatccatcctccatccatcgatcttctatccatccttcatctatcatcatccatctattcatctgtctattcatccattcatccatccactcatccattcatccatctatccacccacaaatccatcattcattcattcattcattatcatccattggtccatccatccatccatccatccatccatccactcattcatccatccatccactcatccatccatccatccatccacccacaaatccatcattaatccattatcatccattcgtctattcatccatccattgatccattcatccatctatccatatctttctatctaaacattcatctctggtatgtagaatggtgtctggcatagagtagttgctcaataaatatttgttgaataaatgaatgaataaataaataaaagtcagaggttttgaacttggagagtgtatttcctgccaatagtctgcagcaggcctatgagattcagaccaccttgttctgctaaaggacatctcaagcctcgctaatcttacagagctctcttttcttatgttgttatccttgggaggcgccctgtctaattttctccttccgaatccctggcccccctgctcccagcttccttggcagcagacaaggaagaagggcaatctaggtgtacttttataaatgacactttgatgaacatcatttcagctaaatctttgtacacgttcttaattatttccttaggtttaattgctagaagtggaattgccaggttaaagagaatgcacatttaaagatttgaatacctgttgccaaattgcccttcaggcatgttatgtcaaattacgtcccccgaccaccacaactgccatacaaattatgaccctgtccctttccttatattccttcaagtctgaatgttatttaacaaagtggtacaccgtactaattttatatgcaaactgtctcattttgctttttatttctcaagcttaatatgtatgtatatctatattttatgtagatatctctctatatagatgtaaagatacatatctttaatggaatgcctctaagtccctttggtgaattacctgtttatgccttctgtctggtttccttttgggtatttgaatttttttttttaactgtagcatctcttcatacatcagagatattaaccctttgtcttatacacatcttctaattgtttcttcgaagtatttcacttggaaaaatagttcgtacatggtgttttctaatgagataaagggatttaagtgattaaatcttttaatgtattcctttactttttagtgccatgctttgaaaatgatttcctaccccattaataatactcctaaattcaccttaagtatttatgattttattttaaatataaatttctaatccattaagtgcttattttgatgtatatccttagggtaaaattttgtattcacacattgcacacatattcataattttctattaaagagattttaaaattacattttccaactgatatataagatatataggaaaactccatttactttttgttctttgaaatttataaataaaataactttaaaaaattatttgaaataaataaacaatgaaaagtgaaggtctttttttttttttttttttttttttttgagacggagtctcgctctgtcgcccaggctggagtgcagtggcgcgatctcggctcactgcaagctccgcctcccgggttcacgccattctcctgcctcagcctcccgcgtagctgggactacaggcgcccgccaccacgcccggctaatttttttttgtgttttttagtagagacggggtttcaccgtgttagccaggatggtctcgatctcctgacctcgtgatccgcccgcctcggcctcccaaagtgctgggattacaggcgtgagccaccgcgcccggccaagtgaaggtctttttaaaatctctcaccttcacctcaatttcaccctcttctcaagaggtaataatttttcatggattggcattatctctgcacatgcacaaatgcatataaatacaaaggagttcttgtttttcacaaacatggcaaaaccgtatacacattgctttgacactagcatttatatacttaagaatatagagatctatttaattctcttaaacttggacaaaattccatgatatggatgtaccataactacttaggtattttccaatgggtcaatgattgaatcatttccattctttctccaattaaaaaaatgctgcaaaaaaatttctggcacatacacatgtgaatatttctataatatggatacctccaagtggcattgttaggttgaacggtatgcacatttaaaattttcgtggatattgaagaattgctttctaaacagggtgcaccagtttacttttctgcagatagtgtgtgagaatggtcagtttcccaaacctgtaccaacaatatatacaaataaagctttttagtttttttttgcaatctgatgcaccaaaattttaaaatttttatatgaatttcctttggaatatagttaaagatacatttttatttatacaactttatatggcttcattttaaaaagtctttaccaaggattataaaaaaattctcctatgatttcagtgatgacttcttagttttaaaactttttgtgtgaagtaatgttgtgtaatgtattttttaaatgcatagactattatctcaatatgtttactgatcagtctatttttatatctgaatcatcacctttatcaaaaccacgtgtcactttcgggcttctctctacctggttcattgacatatttgtctacttctgtatactaccacattatttcaattattatagttttactgtattttgatttgatagtacacatgctgtctttttattctttcttaaaacttgcttggcaattatcacattttttaatgatgaattttagatttcacttgataagtttgatagatgatcttattgataatttgacttggatttatagattaattttaaaaaaatttatgtatttatgatatcaccatttcatccatgaacatggtatagttctattcaggtcttattttatgcccttttgtaaagttttctgttttacttttatagattttgcccatgtcttattatatttattctgggtgtttgaaatttcctctgacaacttacaattgtttttttttatacaggaaagtgatcattttcagtatattgattttatctttgacattttactacgatttattagtactaacagtttcatactttattctttggatcttttaggtacagtcattttcaactgtgaataatgacagttttgcctagtccttgtaaataattacaactcataacttctttttttttccaaaaatttcacattgtttgtattgactaagacttccaggacagagtgtcttgttgctagctttaacagaaataattccaatgttttgccattaaacataatgtgtgatttggccatttatctttttataaatcaggaaggaatgttgaattttatcaagtgatcttgggatgttgttgatataatatgattattctcttgtaagatattaatatagtgaattagtagactttctattgttgaatgaatcttgaattattgggggtaaactctagttgttctttaataaattatgtgaatataccatatggttcatttcactaatattttatttgatatttatattgctgtttataaatgagattgccttatagcttctaatagaaagtagtagtaatagtagtaacagtaattcttgtccttccttttccccttctccttcttctcctctttctcctccctcccttctttctttttgtcttatatgctatatctagtagcactatcctagtctcagagaatgaaatgagaaactttctatcttttctgtgttccgagatggtttatatacagagacgatctgtttctttgaacttctggtaaactatgaacataaaagtgatgaggcttttttttaaaatgtaaatgttcgttatccttaaatttcttctatagttattcttttattcaagtatgttacttctcattgtcatatctgataatttttttagacaattcatttattttagtgtagattttcaaatttaatggtataaagttgttctgtattttatcattattttaaaatgtgttttgtatctgaatttttattcccttcctcaatcccatgttgtttgtgttttctctttttattctcatccatattgccacatttattttcttggtcttttcaaagaaactgtttttagttgtattgaatgagccttttgggggaaagggtgtggagcggttctatttaattagtgtctgctcttatttttatgaatcccttcttactttcatcaggtgtatttttattacccccctccctagtttatggaattgaaggctttgttcatttgttttcaattcttttcactttctattcattacattaaaggttataaagtctcatttgactaccctcttaaccacatcctagaatttttattcgtttgttttgctattgctttgtttttacttttaatttgaacaggtatttaataagatttataggttttggaactttattcaggtatttttgaatgctgtaatacatgtaacatttttgagatgttgcatggatgtttgtaaagaattcatattttctgttgggtatggggttctgtcattcttatttttaaacatttatttttaaagtctaatttcctatctgaggaaggcatgataaccttttccatgatgaatttgttagttttgcattacattacccgcttttgcattatgtattttatagctttgttgctaggtgcatagaagttcatcactatgattgctccttgaagttctttgatagactgtattctttcttgacataaaaattccctgtactggctgggcacggtggttcacgcctgtaatctcagcattttgggaggccgaggtgggcaaatcatgaggtcaggagttcgagaccagcctggctaacatggtgaaaccccctgtctctactaaaaatacaaaaaattagctaggcgtggcggcgggtgcctataatcccagctactcaggaggctgaggcaggagaatcacttgaatctgggaggtggaggttgcagtgagccgagatcatgccactgcactccaaccccgggcaacagtgagagactctgtctcaaaaaaaaaaaaaaaaaaaaagtttccctgtacctatttaatgttttggcctcaaattatattttatatgatactactatttcactacttacttttgttttattgatgttgctttgtatatatcttttccattcttaaattttcaacctttatgtgaaactggttctcacataaagaatataaaactggggaatggtgggcatatatttaacctaatccaatatttgaaattctttcttttttatacatgattttaacccattaacatttattaagtttactaatatgtttagtttttatttttgctatcgtttttatgttgtctgttaatcatggcatatgaagttttctctcttttattgcatggatgaaattttgtttcattttttttcttttctgatttaaaagtgtacacctggggtttggtcacataatgagaatgcttaatttctgacacattttaaatgtgtgtgtgtgtgcacatatgcattcagcatccatatcctcccttgaacaagacaaagccttatctgtcatccatcccagccccatgtcctttgcctttccttcatgtgaaaatgatctgtgattttaattccagacattgtaaaaaccattatgtactacccattatttgaacttaaatataaatataaactgacctttggtttacttattttatttcctctgttgtataaaacctttaatgatttcagagtgagtctgagtccttttttatctgaaaatgtgttattttatcttgcacttgatgctacatatagaattctaggtttaaaataacttcccccagccctttgaaaatattacctgactattttgaaatatccagtgttgtcattgagaagtctgatgacagtccaattctcattcctatgtgggtaagctgttgtcttcttcctcttctttttcttcttcttttcctcctcctcctccttcttcttcctgcttctgcttcccctcctcctcctgctctcttcctccttctccttcttcctccttctccttcttctcctcctcctccttttccttcttctcctccccctccccctgccccctgtctccctctccctccccctcctcctcttctccctccccctccccctcctcctcttctccctccccctcctcctcttctccctcccccttctcctcctcctgctcctcctcctccttcttcttcttcttcttcttctccttctccttcttcttcttcttcctcttcttcttcttcgtcctcttcctcttccttttccttcttccttcttctccttcttcttctcctccttctcttttttttccttctagcattgttttttccactttctttctggaggttggaggtctcttcttgatgtgacagtgtgtgaattcttttttccagaaattttcccatcagctgggggattctttcaaacgtaattctttttatttttctcagtctacagactgaaaaatcatcatgatcatcatcatcgtcatcgtcatcatcatcatcatcatctttttatttgtgggggacagagtcttgctctgtagcccgggctggagtgcagtggcatgatctcggctcactgcaagctcagcctcctgggttcacaccattctcctgcctcagcctcccaagtagctgggactacaggtgcccaccaccgtgcccggctaattttttgtatttttagtagagacagggtttcaccgtgttagccaggttggtctcgatctcctgacctcgtgatctgcctaccttggcctcccaaagtgctgggattataggcatgagccatcatgcccggcccatcatcatcatttttcaatccttagctcgcttgttctttctggaacttctacttgatgggtattagacactttggattgtatctgcatgtcttttcatttatctcctatactttccatttcattatttttgtactactttcacatgatctttcatgtcaggaatttggctgggaccatgtctattcagcttttagatcttcaacagggatttaaagaaaatatatgcaatcaaattgtgaatttccaacacttttttgtcttttccttctctgatggctctatttccaatcagtcctttctctctttatggttgcaatattatcctttttgtgaagatactagttagaattttttattaaattatctttgtcctctgaatttttttttttttttttttttggtacatcttggttcttctttgttgtgtttttagcttccttcacatttgtagtgagctattttgtcatttgtttttgtgaaaagaggagtagtggcttagtattggtgcctggcagatattcttctgtggttctctaggtctgttaccccatcaggctctccatggcatgggagggatgctcattggctcttactgtggagggttctgggactgtcagactcacgttaggatgtgcagtgtggggtgtgtgggcaggaaaataggcaggctgggactcacccacctcctccctgccctccccatcctccctgggaagagggcaggctttctctctggcactgggagactcaggtgctcaccttcctagtgggtggccctttcatctttttccccaccacgttgatgaggcaactttaaactctctcctgtgtctttccaggtccctgtcctcactctagaacatttttttggttaggtgattcatattcttagagtgttggataatacttggcacttggctttgaggatgatgcttccctctaccactgcactttccattttgagtttttgtggatcagctcattattttcaagttctttccccacagtgtatttgaggctgttctttggcctatgtctattgatctgatcccatctatattatttctttctttctttcttgagatggagtcttgctctgtcatccagactggagtgcagtgacacaatcttggctcactgcagcttctacctcctgggttcaaacaattctcctgccccagcctcctgaatagctgggattacaggtgcatgccaccacgccaggctaatttttgtattttttttttttttttttttttttttttagtagaaacagggtttcactatgttggccaggctggtcttgaactcctgacttcaggtgatccgcctgccttggcctcccaaagtgctgggattataagcatgagccactgtgcccggccctgatttcatttactttccatcctcaggaatatctcaacattcctggcatgccgatgacctgcttcttgtttatttagtgccattagggaattattctatgtgaaaaaaacatcttttatgccatttccagggatttgaggtggcagagaaggagggtgaatgtgtccagttttccatcttgatacaatccactgcaaatgttatttaaatttcgactttctgggttttaagatttaatggaattctctaaatacaaacataccattagaaaaaaaaggataaagttttcttatttccaatatttatagttcttatttaattttctttgctaattgcattagttagaacttccataacaatatttaagaattggggtgatggggcatctttgcatctttagtttgcttttaatttgatgaaaacgtctctagtgttttatcacaaggacatgttttgggggtcggaatttttgtttgtttttagacagggtcttgctctattgcccaggttggattgtagtggcacaatcattgctcactgcagccttgaactcctggaattaagtgatcctcccacctcagcctcccaaataggtgacatgtcactatgcccagcaatttttttttctattagtagagacaagctcttgctatgttgcctaggctcgtcttgaactcctgggctcaagcaatcctccccgcttggccttccttagtgttgggagtacaagtgtgagccaccatgcctggcttgggttgttttgatataagtatattttcatgatcttatttttgtattgccaagcattttttttttttaatcagaaacgaatacccaattttgctggaggatttttgatgtctatcaaaatgatcatgtagatttgttccctggcctattatgcttgatttttaaatcttgcatcatcatttttgacattgatggagcattcctggtgtcctgttctaaaatgaaggagacatctgtgacctactcactgtatagtttcttctcttctctggagaaggcagcctttcacaggtgaagtgcgttcagtcattcccaccgtgggtgcagcatggatgacaggaaattaacttaatgctctttgttttgttaaatctaaatgatagatgcttagtaattgttggttgaatttaacagaaatatttagacttctagggttttttgtaaaatttcaaatatctgaggagaaaaaaataaacttgtgcatccttcctcataagatgttaaatagcatctttactcacttcaattacatttttggaacacctacatgtgtactgggcattctgcctagggatctgcaaagatgggacagaggtggctcctctgaaggtggggttggccggggttggaagggtgtctatgatgatgtgcccgtctcaagaggtacccatttccttcatgccaccatcactaaaccttcacctctgggagtcattttcttccaaattatgcaattaagatacttgaattgttataatggttattattattttaaactcttatttacataattctggtgcagactagatatatggccagttaccaaaaattttcttttaaaaattaagtattaaagattggtctctgctaaatgaggatggattttcttttattttaattttcccttcagaaataactttatattttctgattagagaaacgatgcgtgtccatgaactaatttggaaaatacacaatagcattcagaagagtgttggtcctgccacccagaaataacattttgttattttttctttctttattttctatgcctatatattcttttctttttcagaattggtaccaaactgtagccatagctgtatctttcacttgaaatgttatcatgggcatgttcccatccactgaaacgtcttttgaaagcctgagttttaaggcagaacgctccttcatggctttgatgtaaccattcccttactcttgaacatttggggtgtctgagtgtttttctcactataaatagcatttccgtacagttttgtctttattgctgatagcattctaggtttgttctaggagtggaaaactgagtcatagtttataaatgtttttgagccttttgatctataatgccaaactgctttcagaaaaaatataccagttttcactccttccagtacttcctaagaatgccctttctctgtaaccagaagcatatgtcatcattacaaacacacacacatatgcgtgtgtatattcacgtgtgtgtatgtgtgcatggctaattttacaaacgataaatgttgcttcgctattttaaatcagattctacccaagacagataaaataaaggaaacgtgagttttgtataagatgagagctgaatgtgcaaatgggccagcagtgtgaggagcaggaggattggatggggtctgagaagaggcagcacgctccgtctcctgatgtgctcacatctggggaggctttggcgtgaggcttctctcaccatggctctccccatccaggcaggactcccaacacgtcctctgctccacggcatcctttccaggcacggagaagccatcagcaacccgggaagctcagtgaagaggaaaggcagcaaagcaggaggggacagagttcccatccgggtgctgcttctggaggctggaggagaggccagattgtggtggccggtcctgggatgagtcatgacccagtgcttgcaggagtcacaggcaggctgggcgctgggcagaaagggtgcagggcatctgcagggacccagcctgcatgtgacactcccagggatgtcacggggaactgcttgtgcgtggctgagaacagaatctggcttaactcttttaacaagttaatgtttgtgctcatgggccctgtgcacatttaagaattaattaaatcctttaaggaagccatttatgtttgagaccaaagaagatacttaggggccaaaatacccccaaagaagaaggcctgatcacatctcttatgtcttggaagaccccacaagaccaacttccttataccccgatccgcagtgcggtgtgtacaaatacctttaacccattctttccggaaagctcctggggaggcatattaaacctgagttattttcaatttcatctaaggtgtctctatccaatgcagtttcttcaaagtctgcaatgtgggattcaaaatctcttagcatcatcaaagtcttagaaaaatatattactaggaagtagagctgcttcttgtgtgttaattacaacaagcccggctgccgcgcagataatctctagcgtcagaagcatcagctcaggcaatatcaggaaaaacaaaatctttttacaaaagaaaatcctaaattctctttttttttgccctctgaggaaaaaaaaagtgtggttcattgtgaagttaaatcccatctatttagttgttcttataaagatttcactgatatttgaaatattcctctcttgaaagggaaaaacaaggtaggttttcaggatccagcctcagaattatggtgctattttcggagtctttatcttcagaggaaaagctgtgaatcgtccatttgggccaggttctgagtacaactagaactttagcctgcctgagacgaatgcttggtttgcatgtgtgtgttttttggtgggtttcaccgttcaccttcacttacacgctgaggttgaagttgtgcggcagacggggctcttctttcccgtggctttgagggaagtagggatctgttaccagctgtccctctgggacatctgtgctccctgaaagtagagcaggctcctaaccaagacagggtccttgggcttcggaggcagtgaaggtcagggataggtatgtagaggatccagcgtgcagagaagggagaagtcggtagattttaaaattacttttttttctttaatgaggaggaaaactccatcggttcccatttattcagaacttcttaagaagatcctaatctactgtggccttaagatccaagttggttaaaggaagagctgagtgacagcctgtcctgaccagggagaagcaagccattggtggtgcccagggcgacttcattttttttaaattttcttttttagagacagggtctcactctgtcactcaggctggagtgcagtggcacaatcagagctcactgtagcctcccagttcctggcctcctgggtagctgggattacaggcatgccaccacgcctggtaatttttaaattttttgtagagatgagagtctcaccatgttacccaagctgttctcaaatgcctggactcaagtgatcctcccacctcagcctcccaaagtactgggatttcgggcgtgagccactgtctctggcccggcaagttcagaagatacggagacccccgtgtaaaacaacctaagtcacagggtgagagatctacccttgtcacgctccctgggatctccaggagagaagccccttccagcccccagtgtgtctttaacaccttctacctctgccagcctccctctgtacacgagagcaggccccaggccagggccggctgcaggcagcagtattcagccagaatttaataacattgttctctttttatttatttttataattacctttaatttagagcaagtgatacaaatttccatttagggtaatgatatagtttccttttaaatgcattaaagtaaaaaatagtgaattaattaaaaaaatattagcaggggtacaaaaacatgggaaaaaatgtgaaggtagtttattgcagtacaactctatagcaaaaagcatcaggaaggtgatatgcgggtgcctgaaactgggagcacagatctgtaaggcccttttagactatttttattttatttattttctgaaacacgtgaggtgacccttagctactggagagtttaggattttaggaaacagggctctacagaaaacctcctgaagacaagacatattgacctaagaggtttaggatggattccaggcccaaggaagttgcatcagaaagatcccaagatagagtagcccctctcctctttagcattaatttttctagaaaggactaaagatatctccctaagtaagctaagaaccctactgcccaagaaaaaggttactagatgtcaagtaatattataatggatgctgaattttaccttttcctttctctgaattctcctgccacctccctgcaagagtatagcccatgggggtggcctactgtgttcttcctgctctcagtttgggtatcaggtcttgaccctcttcctttctagaggagacttgtccaggcttatctccacagttctcataacacctagcacatagaaggcatcatttgcccattccatctatccatccatccacacatctacccatccttctatccttctatttagcccttctctttctctctcttcctttcttcttttctctctctctccacctacccaaccatatagccatcgatccatgtatccatccaccacccacccatccctcccttcatctgcctatctacacattcatccatccatccatccaaccatccatccatccatccatccatccatccatgcgtctacccacccacccatccctcccttcatctgcctatctacacatccatccatccaactctccatccgttcaaccatccatccatccaaccaaacatccatccatccatccatccatcctcccacccacccatccctcccttcatctgctcatctacacatccatccatccatcctcccacccacccatccctcccttcatctgctcatctacacatccatccatccatgcatccatccatccatccatccatccatccaaccatccatccatccatctaaccatcttctatttagcccttctctttctctcccttactttcttcctttctcccttcctccacccgcccattcacatatccatccatccattcatccatctaccacccatctattcatctatgtatttacttcttcatccactaaataaatattttattaagaatattcagtattaaacaatagcaccaaaaatctgttgggtgcctccagcactcaggtatccaatagggatacagtaataatagaaggagacattgtcactgctgtcacagagtttatggctaatgagagacagaaatggaacaagtggctattctatgcccttaatgaatgaagaagtgaatgagtggattggtaaatcccttttctctgtcactgctgggcactgggacctgtggagtccaagaatgctggggtgaacaagcagttccatagatcagaggttgcacttgccaggccttcgccagctgggcttctggagtgagataacaggctctgcacagtctgctcaatgtgtccccagccgctgagggcctgcccagactgtgcgaagagcatgcaagggcagggctccctcccgggggcttcggcaggagcaaggctggcagtgacagcagctgtggcggggaacgggggcctgggagcggtcgctgcgaaggacgtcagggaggtgggggcaggtgggagggtggataagtagtaatatgatggggatttcagggggtcagacacaggcagtcccaggctccctgccagggtcaagcatggtgtcttgaaaaaaagacagggggcaagtttcccagggtctgggcagtgccctctgcacctacagtcccgggtgctttgctgggggcctgggctggccctgcttgctgtgagtatgcaagggcggccactctgaagctcagctgatgctggccaggggacactttgtttctgggccacaggacctggatgtagctcattttctttctctctgtaactctccacctgctctgggtgccctgtttctggttccagatacccttacacttcctgcactttccaaggcacacacacagtgggctgcaggggggtctggacttggagcaggagcactaggtgggtgcctggtcactctgggcttctgggctttataatgctcactgtgcaataaagaggaggccaggaatccctctctccagggcagggctgaccgagggagcacagggaatgaacctcaaacctgtgcaacatcaaacaccctggggctcccctgtcatggacagcagactggcttctttactgagcacaggtaacacagtctgctgagcacacagggatctgagtgtgggtaacaggggaatctctgggttctggggaggctgagagacattcctgggacagggacgtttggctgtagatcagagaagttacccaaggaggggatgaggaggggaggatggatgcaaaaaaaaataatagggtgtgcaaggctctctgctgagagggaacttattaaatccacacggccttctttccggaagactctggaacatcatgcctaacatagctaaaatcacttctccttgacacagacaaggaaagcactggggaaagacccattagtgggatttcagacccctgggcaaatggctaggaggcagctgggcagggtgagaaatgcatgcttggtgaccatggtggagtgcccattctgtccagggcacacaggagaaggtgctgcctgccaccttctgcttcccacccaacgcttctggaagagcccaagccaacgtatggctcaggatcccaggggtgtgcgtggagccttctgggcttaggatggtcaagatttaaatgagtttggtagaagaaaacaaagatggtgaggacacaaaggcataagaatgacacaatggactttggggactcaagggaaagagtaggaaaggggtgagggataaaagagtacacattgggtacagtgtacactgttctggtgatgggtgcaccaaaatctcacagttcacctctaaataacttatttatgttaccaaacgccacgtgttccccaaaaacatgttggaaaaaaaaaaacaaagatgggagtgccttagtgtgatcatgggcagggagaaggctggaagggcagaggagtaaccgagggccccagggggtgtctggaagggagggcatatttgtttatcagccaggactcctttcgtttccagtgattgaaaatttaacccaaaccaacttaaaccaccaggagacctgtattgactcatatcagtgcaaatatgtaaatggttcagcctcaggtgctgtttgatccaggggctcaaatgtcaccaagcatctgacgtctctcctccttcacctcctcagcactggccttgtccccagtgctgcataaccccactgccacccgcttagactcttcttggtagcaaaacagctgccacagctccagatcttactgagagtgtctgaaccatccttgtagctccctggcaagccctagttatcactctcgttggcctggaataggtcatatgatgatccttgaaccaattactgaggctggggcatggaacattctgaatggctcaaactgattttatagtcagaagcagggagctggctacatctcacccaagctgcaggactgagtaggaagaggggttctcccatgtagggactgtggtgggcatggatgcaaggatgtgagtgtccatgcaggcatctgtagttggctgtggagtctggacctgattaataggtgtgagcgagagtgcaggaagtcccagaccctactaggaaccctgagcatggagtgacattttcagggttcccctcccagcagagcagtggtgggtcggggctggtagcacaccccaactgggcatgactgtgggagcctccccagaggtggtctactttggcaggatctctgcaacccctgaggagctacaaacaggtaatgcttggcttccccaggcctgcattatgaaaagcttgagttacaaaatgctctggctattaaaaacctgctactgactttaacggcaataaaatatctgctgtttatgagtaattagccacttctggaaaagaactctattcctttaaatttatgaggtgccttgatttatgcatttcatggtggggggatgtcatgttacatcacatcaacctgatgtaatttgatgcaaatcaaacacatgaaggagtgcatggaaacgctctctcctgcctcctgaagtgtgtttttatatgggggaaggttttggtccttattccatctttgttcttcttgcttgctttatcaggaaagtcttaggtgaatctttaccctgaaggtccttggtcctgagtgcactggctgcagcctctgaccacccttcaggtgcttccaagggggacttcacatccccgagggtggcagagatgcaaatatctgaagctatttaatgagcacccacgccttgccctgggttgcaggagcctggggaggccaacagggagacgtgcttcctgattttaaggaccccagggttggttcctatacacaggacatgatgtaatcaatgagtctgatttcatattgtctgagaggtgagcgtggggcccggcagggggaaggtatattttggaagtctttcatagcttctgaacctctgtctgacagcttagagggtagaggtgagggcattcaataatttgttggtgggactatgtatctatttgtctgtgtgcattatttcttctttagtccacccactcatctatctatctgctcattgatccatgcatccatccatccatgtatccatccatccatccatccaacatccatctgacacctactaaatttcttgagtgaggtaacaaagaaaagtaagacacagatgcatatccactaacttgctgtggaaccataggtgagttatcccctaccatctggcctctgtttacctatctgtaaaatgggcacatcagaccaagtgtcaaggagctagatgatctcagatatttctcttgctctgccatcctctgtaccattgtccctttcctcaaggaacatctctgtgcaaggacagaaggtgtggacaactctcattcatgggatgcagagatgcttgccaagtagttgaggagaatgtggggaagagtgataggaagagagataaggtaggatgcagcagtggccctttggtggaagcttttggcatgaatctgggtagtttgccctcaggaaaaacaatgatttttgatctttgatctctgcacttaaatggagttatcccaagggtgcaggggacagcaagtggaaaaagcctggcattgggcatggagcaccacccctagtcaatgtgaacttgttggttggctgtagatgtatctcagccggttggctttcttggcaggatggctggatgggttttactagatttctcggggtcatgtagaaagcacacaccttggtcttctagcatgaggcccttttctgttccttttggtctcaggcatactagctttccagaatgcccagcatcctagcctggcttcctcaaagtgacagtcagtggtgttcaagcatcatgtgtaatgtctctgggctcctgactttagaagggaagttacagttgaaacaaggccacttgacctccttcccggttccaccttgggtgtgacatgagacgatggaggaagtttagggttctcacaaagtccaggttcaatctgtaatataattatttaaaaatggaaccttgctattgttttgatttgagtcttcttgctttctggttaggagtgacatttttgtggtcacgagccaaattttgttgcttttgtgaattccctgctcacatgccttttgtccaggtttctaatgggggtgtttgacttttccttgttaactgcaagtgctcttaaaaatacaaaaggtaaagttattaactccttgcctaccacgtatgcctctgaatgctggtcttccatgaggctttggaacaggtgactgtgagcaggactgagggtgattgcaggcctgatagaggccgcatcaacatgcagatggtgacaggggaaggaggaggagaggcaggagcagacgcaggctttgcagagcacctgccctgtgcagacgctgcttcaagtacttcctagcagtgacctcactcatcttcccaggtacattagcattgccaccgtagcacactcatagagctgacaagttgccccttgggactcagttcttttggagtaagatactgtacaccttcttgaagcagcagcgagttttcctctgttacccagagtcccagtaaagagattcctcataggagcccagagagtagcagtggccaccctgtggggaccacagtggctgctgaaggctgcttgcagcttgggtaggtgatacttccacaccaagctactgaagttacagaacaccttggggttctctgaaggcctctccataggacataacttctggcacctggaggtgggggtgggggaagatgttgatatcaagaccctggtgagatagtacagagtgtccaacatcagatggatggtgcactgagggtcctggaccagcccatgaatggcattttctcccttgtgcagagagaaacattaattgcttcattttagaatatttctctgtgttcagcatcagcaaagttcaactgcagatgggtgatggttcaagatcagggtttggctatgcggtccctccctgtcaggtgggcctcagaggcacccacagggggatagagagaggggctgagttcagggtccagcctgacccgcttccttgtctaacacatgggaagccatgattcagagaggggccagggcacctgaggccacatggctacctggatgaccatgcaggtgtggtttaagggggtggaggaggctatagagggaggatccaggcccactgatgtagtggtggggaggccgtttgtcttggatcctggccctggggctagctgggagaggaggtcagtgcacctgggctggggagaggagtcattaattcagtcagcacttcctgagcacacctgctagtgtgaggctctgctcttggcacttgggaatgttgccctggtggatgtgtcatcatcacagagaggatgccttagctgcccctgagggcatcctatttggttccagttggctgtcttcttcctgacactatgcaaggatctagatcttggggtgcagtgaactgagatcagggagagaggcagcagtagaggttcagaatggaggctgttgtctccaagaacaactctagggaagggagtggcagtgtcaccccgcatcgtcagctcaccccaaaggcctcctctgcaccaggcactaaggagacaaatgaacaagattgttgttctcaaaaaaactcccagtcacctgatcctttttcgagtgaacagtgctcaaatatttgcatcgtctctttgggtggatgtttcagatccatctgtcctttagatgatgagtttcaggagggcagggtgtttgagattctctctgcagagccaggcaccgtgcctggtgtgcagtggagagtcagaagggcttactgaataaatgaatgaatgagtatttgcatgagcaagtacgagaatgctgaaagtagctagggagtcaacaggagagtggagtttgaaaaaggcacgttgaaggacttggaatccaaattagttcaaccagaatttgtaggtacttgtcacctgcaaagcattgggtttcagtcacatgtgggccccaggaggtcctggataagggtacagggtggtgaggcacgggctgtgaaatccaccatgagacagagtggggttagctctttatggagggtgtgaagggtgggggaggggattgggagtggctgtgtggaagaactgttctcttctaagttttctggggtgacattaaagtaaagttctagtgaccaaacttctcacctggctgtgcctccatgagtagagggcagggctggtcatgttgtctgagtcttcctcccggcatccccgctttctccccaaggatagatgttatgctggaggcctgcaacttgttcattcattcatccattcattcatttgttccctcatttgattatttatttatttgcttgttcctctattcagtcactcagcaaatgttcatcaagtgcctcccctgtgcctggctctgtgttgggtgctgggggggaccctggtgaagccgatggtcacagtgtggccctcatggggttttggacaggcatacaaacaaacccaacctaatgtagaagacactgttcggggtgaggccaagataccgtggagatagacggaagggctctggaccgggacctgacatatcagggagggcttcctggaagaagtggtatttaatttctcccaagattactaggcacaggggcaaggagggattgcagagaggagttcccaacaggggaaatgatatgcataaaaggataccaagttgcccctctctgctccctgagaaaagggagtcctttctctttcacccaggctagagtgcagtggtgcaatctcagctcactgcaatctccacctccccagttcaagcgattctcctgcctcagcctcctgagtagctgggactacaggcatgcgccaccatgcctggataattttttgtattttcagtagaaatggggtttcaccatgctggccaggctggtctcaaactcctaatctcaagtgatccacctgccttggcctcccaaagagctgggattattggcatgagccacctcgcctgcccattgggagtcctttttcaaaacactaataggttgaagcaagatgaactggagggttatccattctcaagtcacactttactcccccttctttcctgatcacggttcgaaattggtctttgtccctggaatccatctatggcaggaacactcccatatctgagacagcagcccccagcagccctggttccatgagatgggccacctgcagccagctcccccagaacctgcgttgagggggtcagagtcagtcttccctcctctcccaggaggccagcccggcagaggctgggccagtctggtgacctgtgcaggagctagggatgctaaattggggacctcaagaccaaaaaggaccaagggcccagcccagccctggccagcctccatctgttagcctcagcgcagaaattgcaggcagcaggggacccgatggagtgcctggattttctccttagtaatgatcgtgcttacttaccggatgatgtgtatctgagcttatgtcttcgacaggtgcccctgtggacgaatctccctgggccgacttctataaatatttcaaaatcaagccccctttgatcactcttgcgtatgtgcattttacattatatttagttttgcaccgaatcaaatctgaggcctctgtgaaatgaaaataaactgttcgacacgatatcatagtccacaagtgctcaaatgtaaacggctttaatcaggggtaaaggagcagggaggtgtagcctgatgtctattccctggctgctgctgccccagggaggggtcctgcggaggccagggcctctggttcccagggcaggggctgtgcgctgaggctggtgccaggagccaaggcgggttaataggggattaaatgtctaacttcctgccatgaccaagtctgctttaaaaagggagcaagaaagccagcgagaggagagtaatcaatacactcctgacaactgctggtatctttttcagttttgcattattatgttaaagatataccattcattaaaagcatatatatatatatacacacacacatacacacacacacacacaggcacgcacagagagagagagtcagagagagagagagttcttgttgctttccttggtggggtggacacaattcagataaaaatccattacagagaattagggggctatctccttctcaaatcatcccatctgggtgaaatgggagccctgcttcatggcctagatgctggggtgtcagggctgagttgccattcccaaactgcagtccgtggatgtgacaccgtgggcaacgtcccctctccggcatggtgactgatcataagcttagaggaccagggggcttggaggactttccatagggtgggattctctatgagctgcagacaggaggctggtaacccacctactctcaccaagcttccattctgaggaagcaggatcacttccagcccgggtcaaatccaggaaggtttcctggagcacgtgaagccaggatgtagcatggaggatggagttgggctcacagctgtggtgaggtggggctgggctgctgggagatgtggggaaagtttctgcttctactttttcaccattaaaaagaaggcaaggggagacgaatgcctttttccaaaccctacactcttctttctcatgcacgcggagccctcatcaccacaagagctttgaccttccgatgtttggtttgtggtccaggagtttattttcatcctttactggtttaccatcttctctgactcacattggatagaacactgccttttctagctgcgcatagacagaaggtgtgtacagttttgaagctgttctcttgtaagttttctggagacaagactgtcacccctatagttggtggctgccctagtggaagctctgtggggctgactggatagtcttaggacctcagccgttggcgtcttttttataggaacctggtagaaggatggatgaggctctccctggcagtgtgaggcgtgcatgttatgttcttcctctgttaagagcttcttgagccgctgttttgcccaaatatgaactccattctgctcagattgactttcaagtctgcaccagcccatgcctctgccctatctcctctctgtcccctgagcattacaagctccatatacattttgtacatgctgatcccttgggcacatgtggcctacttctcctctctacctggtgacctcctcaaggctcggccaaggcctgtctccaccactgccttccttcccttctctctcctgcactcccatcccactgtgaccagcatgctgaagctctctgcaattcagcaggtgacccaagcttcatgagtccatccatcttccccccacttccccaattcagcttttaaaggcaagggtctggtcttgcttatagatctctagatgtacccatgtcttgccacatgtaggcattacaaaatgttatcaaaagatgccagtcccactatatagatcctctgataagactgacaacaggagcatttgtttgtttgtttgtttgtttgattttgagacagagttccgctcttgttgcccaggctggagtgcaatggcgcgatctcggttcaccacaacctccgcctcctaggttcaagcgattctcctgcttcagcctcccgagtagctgggattacaggcatgtgccaccacacctggctaattttgtgtttttagtagagatggggtaactccatgttggtcaggctggtctcagactcctgacctcaggtgatctgcctgccttggcctcccaaagtgctgggattacaggcgtgagccaccatgcctggccaacaggagcatttttattaaccacctttacatgccttggtcatatccttcccctctcagcatgtcctctgctaccaaattaagggggcttctggatctaaaaactatgctaactgctgcggtcagcatctaagaagcattactgcacaggtagaaaatgcctcatattctctcccacaaccccctgtgccctctcaaaatcccttgaagtgaataggacagcctatcagtctgttagagcgataaagaaactgaggctctggcaggggaccaaggtcacaccgattctagtgggagagcaggcaattggattcatgtcaatggaacttcaggtgtcattctctttccattactccagtctagttgggggaataagccacctgactctacaggagaatgtggaataatgtatcagcccttctatatattaagaaaatagaagagtctaaagataatttttagggggtgaccctctgctctaccagccagtgagtaacagacctgctacatttctccgtctgcagtgcctgccatgtctgccccacttgatttcactgcctggcctgtgtctttgtgcgtcttctgttccttggcctcctcagagcttgcccatggctgtggcttccttctttccaggcatttcccaaatgactgagctgggttccgactgtcgttatccagcccaacaagaataaatgtgttgcaaaaagccagcctggccactggcatgtcttcatgacttaactttctgagcccctatttcctcatcttttgtattggaataacatagcaccaatcatctaagattgtataaggctaacatgagacaatgactgtgatgtacctagcagtgttggcaggtggtattttgatggagaggaggaagatgatgaagatgaggatcctgttaatgtacatagtgatggtggtggccatgatagtgatgatggtggtgatattgatgataatgatgatgatggtggtggtgatgacgacgatgatgatggtgatggtgatgatggtggtgatggtggtgatggtaatgataatgatgatgatggtgataatgatgatgatggtgatggtagtgatgatgctgctgatgatggtgatgatgctgatgctgatgctgatgatggtgatgatggtgataatgatgatggtgatgatactggtgatgatgatcgtggtgatgatggtgatggtggtgatgcggatgctggtgatggtgatgatgatggtgctggtggtgatgatgatgctgatgatggtgataatgctggtgatgatgatgatcatgatggtgtgatgatgatggtgatggtgatgatgatgctgatgatgatggtgattatgatggtgatggtggtgatgctgatgatgctgctgctgatgatgatgctgatgatggtgatgatgatggtgatgatggtgatagtgatgatgatggtgataatggtggtaatgatggtgatgatgacggtgatgataatggtgatggtggtgatgctgatgctggtgatggtggtgatgatgatggtgatggtggtgatgctgatgctggtgatggtggtgatgatgatgatgatggtgtgatgatgatgctgttgatggtgatgatgctggtgatgctggtgatgatgttggtgaagatgatggtgatggtagtgatactgctgctgctgctgatgatgacgatggtgatgacagtgatcattatggtgatgatgatggtgatagtgatgatgatggtgataatggtggtaatgatggtgatggtgatgatggtgatgatgatggtgatgatggtgatgctcttgctgctgctgctgagggttgttgctttttaatgagaggacagtccatagtcttaacaactaccccatgtgaacttgtcttctttccatccccagcagctacttgcctggctttgtgtggtataggcagaaggtgacccagggatccagaccagaagtcttctctactcagagaagatgacaggagaacccctttgttgccatttttcttttccatctgatgttgttgtgctcattatctgtcttcatttctgggctgcagttttagcagagactccaaaagccacagtgatggaagctctttgcctttgagaatttttttttcaccaaacccaaaccaaaaatggtcacgtctttgagaattttgaagtcatccaaagtttccagggagaagacattcaaattcttttcccaaattctccaactcttgtcctaccagcatggaagctgcctggggctccatgggaccacatattaagccagcccagccaaatcctgctcactactcaagtcagtgagggccttgactttggccaatgttccatccccaaggggacacttgggaatttgactacagtctgcaacttgactctgttggttacacagttgtcattctccacagcctgatttgaatgtggtatttttgttcataaattcagcaaggatttaactatttctggccccatctcatggcactgtctacacatcagtcaaaatggaacaggtcacccgcgctgccctcctgttcatctattaatcatctggcaaataaaccactcagtatcctgcccaccccagtaatgtttgtgatgtaatttgtttggatgcccaaatgtcaccagtgttgattgtaagagatcaaaaaaaaaaaatgcacttgctcagcatagcaagctctaggccaaaatgtaagcatgaaatctctggtttatttttgtaataatgtttacagctgtttaatgaccctgaaaaggttcagtagtctgatgttctgtatttcagaacaggagtgtattatgcttataacaaccttagttaaacagtttgagctacaacaattggaaaaatagtatttaatacgaagccattgtattctaggtgaaattgtcttaattactgtttactgtcagcataagaaagcaaggtgggcttcagggacagactgagggtcacgtgagcctccaggaatggggtctgcctgttactagaagtgcatgttatgagaagattttgagtaaaatccacaatggtgtttggaaacccccttgctgtgaacccgagtcctagaccctgcagagtaacttggaggtcagggactcctacaaggcttccgaggtagcagtttcacccacgtcgatgaaaaagggaatatatttagttgtgcttggctagacaacaatacttgattttttaaaatccagtgcaaatggttattttgaaagcattttattttccaatgattctttttcgtggtataaggaaaaagctctttcatacaacttactggcaagatctatatttttttggactattcataagattacttttttttttctgtgctagcaaaatgaaactgtgtttttgtgtaaaatttatttagactcgtagcagctggcatctctggtgtcctgatagttttaaatttcattttgagtgaaagatacaattaggttctctattggaagagttaagtgaaaacttttgtcattgatatcacaggaaatagtcttgaaggcagaaatgcaaaatcaaaataaccattagcaccatcaaaggcagctgaatggctcacggtacctgcaatgatggcagtgatgagacagaatgtattttgataatctgtgcacccaatggtgggtttcatttgctgagtgtgaaattgcattgttcaagaagaaaacctgtaatgtttggaagccttcacccggggcccctgcctgtgtttagaggtgcagcacaggggtttccacactgtcgtgaagaatcctgtggccaccgagagcctagcttagttcttcatcaatactgactgtggagttgagtccccaaggtgccccaccatgaccctgtgctcagaaaaggtcaggactgggggggaatgttgccatgtttctacattggggggatgatgctgcaaactcaagagtttacagtggcctttaactgtccagcctcggtaaggacatctggctgcctttgcagagttaggtaaattatgcattcatttgttccttccatcaatcagccagggtttattgatcctcttccttataggtttcaggctggggcaatgaactgaaggccaggggcaagctgttctcactgtttagtagtttgtttgcttgcttttaattgtgctaagggtttttctgcccaggtgagctggttcgatgagttcttgcagaggttattcaaagtcctgactgcccagttgccttaagcccaggatcatggcctgccctctgctggcccctggcttccttttttaaaattttagactcgggggtacatgtgtatgtttgttaagttacatgggtatattgcataatgctggggattgggcttatagtgcacccatcaaccaaatagcaaacattgtaccctataggtaattttatcaaccctccctcccctctctccctccccacttttggagtccccagggtctattatctccatctttatgtccgtgtatacccattattgagattagctcaacatggattaaagacttaaacataagatgtgaaattataaaaaaaaatcctagaaacacctagaaaaacctcttctggacatcagtccaggtgaataatttgtgactccagctcctgggtcacgcagtgctgagtgaagggtcagtggggcgtgtaggctaaagtgctctggcagcagggttgggggtgggctgtggcaggaggcccctccagggatattccctatggggcctgtaagggagcagcatggtctgaaagggaaggctcactccctggtgggctgggaaaagggataataagaccttccagcaggtcttttatttgaaattttaaaaaattatcttttaaattatttttgttttttgagacaaggtctcattcccatcgcccaggctgaagtgcagtggtacggatcatagctcactgcagcctcgacttcccaaggctcaagtgatcctcccacctcagcctcccatgtagttgggactacaggcacgcatcaccatgcctggctaattattttatatttttagtagagatggggctttgccatgttgcttagggtgatctcaaactcctggggctcagcctcccaaagtgctgggattacaggtgtgagccgctgcgtctggtcccttccaacaggtcttatcgtttgcaggcagctccacttcctccagccccatgagctcttatgtctgcagctggattcaatcctttaacagtaggataaatgatgccttagtttcccagtgtaggcatttgtatacatttctagagggctatcaggtagggactccccacccttccctcaacacagacataattattgcacacacacgcacacacacacacacccttagacaccaaagctgcgatggtttatcttttccccagctttgcattcagcctcgaagggacctttcattgctccctgttacttgtggacactcactcacgctggccccttagatgaacaggccctcgagggcaggtacatggaaggtccctggcaaatattgactgaatggctaaggtaaggaataaacgcattctggatgggtgaagtgtcaaggctggagaaattggggccgacccaggttttgtgagtcccaggccgggcctggggccagcttgtcctgcctcggctgttttggcgcagagacagcacaccaattaccccatactctttccaggaactcgtgcttccctttcttgctctaagtcgagcagcaggcatcagttatgactgccccattgcagcggcctcggctgcacctgctcgaggaatcacagaggattctaagctgactgtcgtggtcctttctcccagtaaggctctgtgcaggcttctcccaggcttattcaagggctggggaccagtatcctggaagcatctcctagggagctggtcagctcctctgaaaccctggggtctcccatgggcagtgacggtcagttaagttctaaagggaaccattgctgtgtctcctagtattcagcaactgggccatcaggggtggtccaagcctggggtgataaccatggacacctagactgtgagagttaggggtgtggacagcttttcctttccttttgtttctttctttcttttctttttctttctttctttttttttttttttttttttgacagagtctcgctctgttgcccaggctggagtgcaatggcatgatctcagctcactggaacctccacttcccgggttccagtgattctcctgcctcagcctcccgagtagctgggattacaggcacccatcgccacacccagctaatttttgtatttttagtagagacgaagtttcaacatgttgttcaggctgatcgcgaactcctgacttcaagtgatccgcccacctcagtctcccaaagtgctgggattacaggcataagccaccatggccggccagaggtggctttctcttggtggtttctgaaccttcagcttctcagtggtagccagggacccttccaactctgtccgattcggatcgtaggtgctcatggacttgtgcgaaggctgaggttaggtcacatgactgattttaagggctctggacttgtgcaaaggccgaggttaggccacatcaagttgaggttagagtgagtctctattcactcattcatccattcacttaggacacactgaacctaagataagccagctctgccttaggacccaaggcttcatccttgaccaagacagacatatcctctgccttcacgggaatgaagtatgtctgtaaaaggaccaatgacaaaatgttgcccccatggcaaatgctatgtagaagaaagtaacatgttgggacagagaggggctggggtgtcagcctcagacagggtgggcacagagggcttttgtgagaaaggatgtgtgagctcagacccacaagaataagaacagagccaactatgaaagagccggggcagcatgcatgttctagaacattctatcctcagctgaggatctagcaaaggcatttaaagaccttaaagagattacaaatctttgttaactctggccaggatagatagatagatagatagatagatagatagatagatagatagatagatagatagatttgaaaaaaataaaagaattccatactcaaaccaaatctgaaaactctcacattccttatttgacgagttgagctgtcacttgcatagcatgaatggtggtggtgttgggggacatggtcttcaactccatgcccctcatccaagctgatttgcagtctcgccgcattgcacattcagccttctttccctcctgctgaattggcgtcagctcatcagcagcaacctgaaaatagcccgtcttcctggattcatgtcttctgagctggccaactgggcagcctttggaagtgggccagccctgttggccttggactttccaaacttccatggagctgttgggtggaattctgagcaatcctgtgtggcttcagggtcatgatccctgttggctcagaagaggagccagtgcagctgtatggggcttgaaggtggagagagggtgccagacagggccctggggccaccagtctctgcctggagcctccagcaacctctgtacactgtgcctgctcctccctgctggatagtgggtgtcatgagtcctggggctggtgggtcttgtccaccatcatgtctccagtggcaaggctagggactggcacatggaaggatctcggtaagtctgttgaatgaatgcagcaacctccatgggatattagcttttttctgaccaacctccaaaatgggcccgcgtattttaaaaaaatttgagtgtagactgcccccagaagcaaaaaggaaagatgacaagctggaagccttctcctatggcaagtgcccatgcacctttacgctttgcacagttgtgcatatctttcattcgtggacaaagttggcccagcaccaccactgtaatccctctgcctcctggaagtaaacattcatggctctttcttcccttcccttgcaagatagactcctcctgccaaggaagtcaggtctcccattggagaccctccatgccacgcagtctcctggcgggaggcccagcaagcagcagaccctgccgaggctgcctgtgcttcctccacagttgagctctgtccccataggtctccctggttaatcacttagcccagaaatcagtcccggctggggttaagcgcagctcctggaccacctggctgcccaacacatctaaacaatgggatgcaagaggagaggtgtgtgcaaagatgattccaatggcaggaaacaaatttggactccttcaggtgggagacatagctggaaatagaaggatcccaggcaggggttcattgccttgcaaagctgagctccccacgtgctccaatgtggaaggggctgtttcctctgccctccctggagccatctggctttagccattctgcacaggctgaagagggggcagagaggactattaaagacaattatgcagaccagctttgaacgatagtgtttaacaaacaactttgagttctaattttctgcaaaacacatactgcaggtacaatttgtactcattattgtatattgggaaagttattaaaaacactcaaacttggttgagacttcctatggcatcattcctggattttaatgggtttttatctagttctataaaagacctctttaaacccaatcaaagtccctgctttggatatcttgccattgaaggatgggaagagccccattataaggtatcggtgtttcctttgacccaaatttgaacaacttcaacaatctgctaagattccgtcaggagataatttatacttcttttgatgggcacagttaccaaatgataaaataacagtgtttcgtaacataagggttaaatcttaatctctgaggtttgcaaagccgctactcgcagtctccttaaaatttaatatacctcgttaatgcttccttgcaaacactgaaggatttttatgattataatcatgtgttacagcacctagtactgtttctaagcagcatactaatcagcttaatgagatattactgcactttttgttgactaaagcaaaatcccttttattattctaaagcctgtcctttactttattttttcccaaaacattatcttgttttattatgtaccagtaaatatcatgccattgagtgttttttgtttgttttttttttttttttggccaaatcataaaatgatctctttcatctcagactggtgaatgtactgaatatagtaaacggaaacagaagttccaagtgggtttatttggtcttacagggaaagtcattctgctctcaggcaaactttggacggaaccaacaggtacaggtgcgacaatggggcaacggagaaaaagtttcacacgtagacccttgatttgttattaggtgttgaaagtggtaaaacattaataatttaaaggtgaatgaataattgcagtctgtaaatagaaaatacaaggaagacgatctgtcgccaaaacaaattggaggagcaatgccatattgcataattggcatttaataattcatttttttattattgtttttgacaagaattccttagcatgattatgtgtaggtaaggcatgaaatggaaattccctgcccgccaatgctgttgattcatggcgccacagccgcacctggcacggatctgaactctgcctctcttttcagggatggaagaagcgagcctgtgccttggagtgtcttcggcggagccggaagctgagccccacctgagtggccccgtcctcaacggccagtatgccatgagtcagaagctgcaccagatcacctcccagctcagccatgccttccccgagctccatccccggcccaaccccgaggagaagccccccgcatccctggaggagaaggcccacgtgcccatgagcggccagcccatgggcagtcagatggcgctcctggccaaccagctgggccgggaggtggacaccagcctcaacgggagggtggacttgcagcagttcctcaacgggcagaacctgggcatcatgtcccagatgagcgacatcgaggacgacgcccgcaagaaccgcaagtacccgtgcccactctgcggcaagcgcttccgcttcaacagcatcctctccctgcacatgcgcacgcacacgggcgagaagcccttcaagtgcccgtactgcgaccacagggcggcgcagaaggggaacctcaagattcacctgcggacccacaagctgggcaacctgggcaaggggcgtgggcgtgtgcgcgaggagaaccgcctgctgcacgagctggaggagcgcgccatcctgcgggacaagcagctgaaaggcagcctgctgcagccccggccggacctgaagcccccgccgcacgcccagcaggccccgctggccgcctgcaccctggccctgcaggctaaccacagcgttcccgacgtggcccacccggtgccctcgcccaagcctgccagcgtgcaggaggacgcggtggccccggcggcgggcttccgctgtaccttctgcaagggcaagttcaagaagcgcgaggagctggaccgccacatccgcatcttgcacaagccctacaagtgcacgttgtgcgacttcgcggcttcgcaggaggaggagctcatcagccacgtggagaaggcacacatcacggccgagtcggcccagggccagggccccaacggcggtggcgagcagtcggccaacgagttccgctgcgaggtgtgcggtcaggtgttcagccaggcgtggttcctcaagggtcacatgcgcaagcacaaagactcctttgagcactgctgccagatctgcggccggcgcttcaaggagccctggttcctcaagaaccacatgaaggtccacctcaacaagctgtcggtgaagaacaagtcccccagcgaccccgaggtgcctgtgcccatgggcggcatgtcccaggaggcccacgccaacctgtactccaggtacctctcctgcctgcagagtggcttcatgaccccggacaaagccggcctgagcgagcccagccagctctatggcaagggcgagctgcccatgaaggagaaggaagcgctggggaagctgctgtctcccatctccagcatggcccacggcgtcccggagggggacaagcactccctcctgggatgcctcaatctcgtgccgccgctgaaatccagctgcatcgagcggctgcaggcggctgccaaggctgcggagatggaccccgtgaacagctaccaggcttggcagctcatggccaggggcatggccatggaacatggcttcttgtctaaagagcatccgctgcagcgcaaccacgaagacactttggcaaacgccggggttctgtttgataaggagaagcgggagtacgtgttagtgggagcagatggctccaagcagaaaatgcctgctgatttggttcacagcactaaagtgggcagccagagagacctgccaagtaagctcgaccctttagaaagcagtcgggattttttgtcacacgggctgaaccagactctcgagtataacctgcagggtcctgggaacatgaaggagaagcccaccgagtgccccgactgcggccgggtgttccgcacttaccaccaggtggtcgtgcactcccgtgtccacaagcgggaccgcaagggcgaggaggatgggctgcacgtgggcctggatgagcggcgtggctcgggcagtgaccaggagtcccagtcggtgagccgctccaccacgccgggctcctctaacgtcaccgaggagagcggggtcggaggcggcctctcccagaccgggagtgcccaggaggacagcccgcacccctcctcgccatcctcctcaggtaggttagctgagaagcggggagaagcagcttgtacagcagccctgctcagggctgcctggttctgctcccaggcctccagtcagttccaaggccagtgggtcttgattgaggacaggggtgggttggacactgggccatgcctttctttccccccctgactggagggaaagggccgtcctttcacctcttaggccttcccttgaacactggctaccaagaaagtaagttgaggccgggtgtggtggctcacgcctgtaatcccagcactttgggcgcccgaggccggtggatcacttgaggccagggattcgaggccagcctggccaacatggagaaaccccatctctactaaaaatccaaaaatttaggcaaatgtggtgatgcatgcctgtaatcctagctattcgggaggctaaggcaggagaatcgcttgagcccgggagggggaggctgcagtgagccaagatcacaccactgcactccagcctgagcgacagagtgagacactgtctcaaaaaaaaaaaaaaaaaaaaaaaaaagaaagaaagaaagaaagaaaaaagaaagttgtgcgggagatggccaggtggtacatttttcagtgggcataatctacctttttcttgcaattgtccaaccccatttcaccgcctgacgctgtcggccatcatctggtctctggaactcaggagctggcattctgctctatccctgggtatgaatgtgtaagttccaaacttcaccatctttctctcccccttagcgtattcccataattctctcatgcaggcaccgcagtctccctccccaagccaaacctatcttctggccccttccaaaattacaacgtggctcacctgccagatccgtgtgacctaaagagccccaccactttcctctgatggtttggaaaagtacaggcatttgaaacacagacgcatgactgttctgtcttaaattgtactgtgttacacggctgatacagctttggggtctaaaatagcaaagcagaaaatctgtcatcaaaatgtctgtgaaattatgaagcttcctggcccagtttaaaaaaaaaaccaaaacaacaacaacaacaacaacaacaacaaaacacgctagcctcagacggctaaattaaaatcaccacctaacagcaggtaaggcgttgccttcatccatatttccaaagccccttactaatggatagtaaattgaaagttatctctagccctttataaagaaagcacctcgctaatactgtaatcattctgcagcctaacaacagaggaaatcatgccataacaaataccctgttactaatggcaacattgatttctgcaatcagccattaagtctagaaaatgaaagacagtttgaggcacctcgaggcactgccttgcccactgttaaagacgtagcagcaccctgttgagggtcattttttaaaagttttttcttctttcttgatcccccccaccctcactctttggtttagatacctatttcgatcttggaggcaattcactgctgcacttattaagtagatgccagttttagctttgctgttatagtcttgcttaagcatactcttcttctaggacaaaattagtattaaaataaagtgggactctgccggcttattacaaaccagtaaagaattgttaagacacataaatctggtctgcacattccagagattccgatagcacttaatgccgctgcttaaatacccatgaaacacactgtctactcctggagtcctagacttgtttgggatttattacggatgagacacttaggaagtgtctaaccagcagcatgagtgccaaggaggcgtgaggtcacactacctggagcgactgtcacatggaacatactaagattcgagggaagggttttcaccatgtaaagatagatccctacttgagaggcagccaagtgccaggtgtcccaatgtcaggaggagctctttctggcctcctaggatgaggtctgctcttctggcatgtgtcgtttctgattctggattaggacctttacaggacagggtgcagacagcaaactggttcccctaagtttttagagtgacatggagttaacattgacagatttccatccctctctcagacctcctgaaatgtaagggtctcggcagaatattctgacaccaaatgttcagcttcattaatgacgtgtttaccgtgtttttctcaccttctggccaagtgatagcctcatgctattcctatctctgttgcttgcctatctctcagtgcttggttgaaaaaacccattttgcttaaaaagaaccaaccgtgctcatgactcaaaagagaattatacttgagttgtggttatcttctcacttttatttcccctcattgaagtattttacaattgtgaatactgattctttcatttctggttgacttctttgttttcttcatattcaaattagaccctttcataattttctgactaagtaggagaattgagggcataccaatatacaacccgaatcagctgtgcgtctggggcattcaggtttccctgggatttaggactcttaaccaaatctggttagtcctccctcttatttccaacaagtttgacttgtatagaagtgcgattaaaataagcatttaaataaaaatctggatacaatgggtattttattattacctgttaaagagaaacctgcaaggtgaaggagagagagagaaaaaatctttaagcccttaagtaaagaaagaagtacttattaaggcttctattaagaaataactgcaaaacacggttttacaaatttctcagactgcataacaatgtcgcaaaacttaatttgcatcacttgattcttttttttgttgaaaactgggtcagtagggcctgagaaactattttttcagatcttaaccaatgaattcttctttataaatcgctgctcttaacatgatagtagttctgaattcatcataaaaaacctttttacagagcctcttagaacagatctctagaagaaggcttacaatgagtggcagagacgtcctttgttatctgatgtaattctttgcaaagaaggattgggaacggagtggctgtttaaaaatgtcttgctcagaccgagatgaagaaggggtcaagtttgcaatcaaacagttattgccgagatgggcgactgtcactggctaggctaatgtgggatgcagctgtttgttatgtgagcaaaagaatgtttgaatcagtgaacatgtgaaaatgattccagtgaaccagaaaatgtgtttgttctttggctctccaaactgctgagaaccaagcttaagatcaactgcgaaaactaggacctctgacaaattgagaggtcatattttctaacagaaaatggacaaaactagtcacacagatcacttccccatcttccccctttgttttatttttgttttgttgttgtttatttgacttaccagtaatttcacaccgtggtcaatgtcattcaatgtagcctccgtgtacaatgcaaagagaaactgtttggaaagcagcagcttattaattttacttttatggcatttagaaagcggggtggctgtttcgatgcctcctcatttctggcttgcatgcaaacactcttatggcattaatctttgcatctttctctaaaacctcctctagggctgagctcgaatcctcgctttgctctgagtcagaacacaaccaaagttctgtttcttcagattttgctttggaaatcacactcagaataattaaaacttaatgtactaagaaatgatactgttcattatatccaacagggcagttaccttctgaattccacataattttggagtggggataattgaagtgttgatggtgggaagggggtaattgaatgcattgaccctctgttcattaaataaagtcggctaagttacaggatcaatggaaagccagggagagatgcgaagatgaaaatatcgttaacccctactacttctggtataatattttgagatggacaaggattatttggtcagctgggctaaaagccttgcgaggtcttcttttgttgttagagctgcattcctgaaatgctgggtctccatcccattgaccacagcatcaaaggcctttatctggggcgctttcgcatttacatggggtgtatagtgatatgatagattttctttcttttccacctctttttctcatgtggctccccctccctgcccccgttcacgataaccggtgcctgctccacacacaaacaaatccaggcacccaaaagaagaaaaagaaaaagaaaaagaaaaaaaatttgagtttgaggattaagatcttcatttttttttttttttttgcttgtgcattccaattgttcttaaaatatttggcaatgtcaattagtaactgagcagagttagctgatgaacacaattttccagtagactgagcaccctattgttgccgagcgaacagcagatttctgaggtcattatcattcgctggttgcttggcccagctgcttcctgctgcaaaagccaaactttataccggagctcggggaggctgcagcaacagggggctggagggggggagaggggagctggctgcagagccgaagacagtcattatcagcagaggaaacagaaagtaaaagtttccaggcaattccaggaaaactgccggagcaggcttcttcctcctgttccagtccaaccaccttccacctctaggcagggaattaaaaaggacttggggagacccccctgggcatggtggcagctaatctctttgtggaggagaactttggaaaacaataatcccatttataaataatgcttaaaaatttttttagcccaggctcaagcatgtgagtgatgccctcttagatagcctccttcattgttatatatttaaaaaatcattttaaaaatgatattaggaacttgaaattagtcaatttggggatgacaaataggcaacattatttaattttccagagggaccttatgaacagatcatagtctgagattccttttaaaatcacatttagccttaaaggttccccctacgcctccccctgtcccctgcttccttatttttctgcccccagcccaccccaactccagccttccttccccacctcctaatttgggaactggttcagtgagatgaaaagctgcactttttttaaagctcagctgtgaaagccgagcgccatatgcagcccttcggtctctgccgtggaagcgtgtgcaggcggccgccgtgtttgcggagatttacggaggatcggctcgtgtgtgccgaagctgtgcccaggcggacgccggccaaggcccgtcccctgagctgagagccgagagctgaggtggccgcccgcctaggcgaataagccggctggtcaggtggctcctggggaatgtcagatggggcacagggtcagaggcccccgtgtcttcccctggcggccacctttccgctggggcccaagggtggtctgtccacttgggacgccctgctcgtgccgggatcgccgttgctctcagatgctggttcatgtgcggctgtcacatcatcctcctccttccccggagccggatgcctaccagcagtttctttttataaacttcccattcacttggtagacttgtatcatctcgtgcttaggagcgatgatttgggaacaatcagtaacacttcggggcttttaccatctttctgacccctttacatggagccataaatcccgcttctccggggctgcttgatgccagtccaccgtcacttggcatttcagaaagagggtacttgcacaggctctgaaagtcttcagactaggagtgtaacatcagagatgtgtggcataaaattgcagaggcagagcaccctctctgctccagcacttaacaggcaggacatggttttgcttgtgagggattagattcgaggccgcggagtcactcaaatgtgtttctctggcggcctcacttggcccatctgtgggatggacaccgctgttgcctgggctgcccttctgtttccaacactcctgcccacggagcttctgaggagctccatgaagctctcctccctatgcatgttagcgcaagggacggaacagttcatttaaacctaaatttaatggaaataaggaaaacatagattagctaaggacaggttacaatgaggcaaggaattaagcggtcaattttcaaaacagagcttgaagcattagctgcgtgatttccattgactcgaatgggaggttccaggctcaggtcttgaccaccaccttgggtgtgttggggtgggagttagtaatttgctttgcagacagccacaaggtgtcccttgattgatggtttggccagaagcaggtatcacgagcttccaggatctgactcttacccactcccatgcttaccatgcactcaggtagctgggaaatgatgcccactgtgttatgtgagccctgccaggggccacttctgcagagctggggcagcctctgcatagagggcagattggggtccttctggccgcccagatcccttcactgccaggttgcttatctttctaattctttctctggtttgaagctttgtgtcctgttcataggaagtgcgttcccaggaagggtaaggtaagactttcttcctctacatctcagtgcatttcccacgtctgccccttctccctgagaagtttctggcaggtagccctgatgtctcaaaggggtggggacagggctggcttcaacaaggcctgttatactggcctcgatattccactggttctagagagagaccgtgggtatacttggagacctagagatggagacagtgaatttcatgggaaagaactgtgcagggagcatttggaagccttttgagcctgggaagtcaggggagtgagtagttaactcctttacccgtagagctgttttggagcattgatggcaggggtggagaaacacctgcagagatcaggagattggatttgtgcacacttcccaaatccgtgatgattggactggaacctttgccatctgtgacccttgggcctgtttgctgcccttctgggtgtctcacctcccttcgtcttcctctcctctgtcggcatctgatgggtgcatctctccacccttgttgatggtgctggcatgtggaggaaggaggcgggggctgagcgaggcttgcaaatgcagaggaaaggggctctccaagaggggtgcatggtgtcgggggggtgggcaggtggtggggggactctgatctccccaggaagtgagctttgctgcagctgagagcggccatgggtcccccttgtcttttgctggcaggatggggcgatggcaacatttacttaagctgtggagtctggcactgccgcagccaggcgccatctggaaagcccttttcagaaagctgtgtcccccccacccccaaaaggaacttaggggaacaggacttgggcagagctgtgggacttgtttcttgggcagaacctgctcactgaggcacctgagccgggctgggtttccctgggagccaggtagataagacaggtctacctcggggtgcatgtgggctctttgctgtctgtggggccctcggttcatcctcgagccaggtctggtttaggtttactagggctgtattttccatctatttgttttgtgttgcattttgcttactctcttcacctaagtccttgtatattgtgagtatgatggggtggcgccagccgggattggtcagtgactgttccttccctgtaatagcagggctgattagcagaatataagaaatgaatgctgtgcctctgaaatgtgcctgtgagacaggatctagaactcagcggctcagcttgcaacaaacagggcaaactaagcacagagatttgctaccatcctttccctgagccacatcttcaaaaaagactgcagagtcccaaaacaatgcgtgtctgaacaaacaccatcttcagctacctgatgggtgggcctgggcaaaacgggggccatgccgaaagcaagggcagcagtccaggcagaattcatttgcctcctgtttccaccacccccaagagaaagttgtccagggcttagcttcttgtgggacccatctctttgttgctgtgagccttggggtttttgtgtgacatgtggcatgtgtctgggagaagcgagaggcacagcacaagctgactccttggcttggctgcccaccacaccacatgggaggccggccctccccttaacggtgcccagccaggaggctgcctccaatgtgggcatgaggacgggcttggctttaacacctcctcacttgcttccaaaggacagggtcattttccagcttttcttgcaagcagtgtctacctttaggaacctttcagttttactctgtgccatggggcccagggcatttcacggagaaatcagtcctttcctttacagaggcaacttgtaggactagacttttggccaacgctagtttcttttcttttgtctgacctcagttccaaaaccatttgatgcacgatgaaacaggatcgcgccacagtgctctcttctcttcattaaagtaatgtccagaaactcttagcacagtggtggtcatcgtggcttttggacactctcagttgtcctcaatcatcttgagaggcattctggaacatgttcaacatgttaacgttgagttcaacatgaagtgtatgcagtggtggttttcttgaagatcaagacagatacatgcttctctttattgctaaatatgtatatttttaaatttgttgctaaaatatgtgtttttattttcgtttcatttcattttttaaaaactcagtagtttgccctgaaaaattggagtgatcctgcagcaaagctgctatgtggcatcataatccctgttgagagagaaggcttggcagtgttcatgtccgtctctggctggggccagacccctcggaaatgtcctttttagtgaccttcaaaacctttccacttgggaccgggtgtggtggctcactcctgtaatcccagcactttgggaggccgaggcaggtggatcacatgaggtcaggagttcgagaccagcctggccaacatggcaaaaccttgtctctactaaaaatgcaaaaattaaccgggcttggttgtgggcgcctgtaatcccagctactcgggaggctgaggcaggagaatcgcttgaatccgggaggaggaggttgcggtgagccgagatcaagccattgcactccagcctgggcaacaagagcaaaactccatctcaaaaacaaacaaacaaacaaacaaacaaacaaacaaagtttctacttggtctcgtccacgagtcccgttcactgactttatgatgctgttgttgttcaatgacttcactattctttttttcttactataaagtaattcttgttcatcttggacatttaagagatacagataaataaaaaataaaaaaaattaaatgtgtatgcctaccaccactcaggaataatcactgtgaacactttttttttcactaaactagtaaatattttgttatcgatgcatagtttatgtatagattttagggtacctgtgctaatttgatacattcatataatgtgtaaagatcgaatcagggtaattgggaccttcatcaccttaaatatttatcttggctggatccagtggctcatgcctgtattccaacactttgggaggccgaggtgggcagatcacttgaacccagcagtttgagaccagcctgggcaatatagcgaaaccctgtctctacaaaaaatacaaaaattagccagagcggtggcatatgcctgtagtcccagctacttgggagggtgaggtgagaagatcgcttacgcccaagaggcagaggttgcagtgagatgagattgtgtcactgcactccagcctgggcaacagagcaagaccctgtctcaaaaagtattatcttttctctattctagaaacatttgaattattctcttttggctattttgaaatgtacaatagattattgttaactctcgtcaccctactgatctatcaaactcgaggtgaacatttttaattcatacttttccagtcctttttatgcaactaaaaatgtagttagccaaaaagtacatacttctgtgtaagttcttactgaaatgtatgtcatattttttcttgtcattgaacatttcccaccaggatcagcaaagttttcctgtaaagaaccagctaatgagtattttcggctttgggggccatgtggtttctgtagtaaacactcaattctttcataaataagagtgtgatggtatttcaataaaactttattgaaattgcaaaaattggcaatggttcagatttggaccctgggctgttgcttgcagattcctgtcctaatagtaatagttatacttttttttccccaagctttacacaagtaatatgcacatggaggaaatgctagaaagatggagaatccaagaaaaactctatatctataaaatggtttagccaatctctgattcgtgaacacgggacttgtttcttttcttttttttttttttttttttgcctgagatgcaacctctgaggtgtacgtttctgcagcatttgtgacctcatcgatcattctgatcttctgcaccattatttccttaggtgtgttgcctcgcagtagactctctggtcacaggctggtgagtccgaggtggcagagctaaaccacccactgtgtgctgcggctctagactgtttgttttacgctggtgtttgcaccatgagaaaatcccctcgtaagattgtactgaagcctgtctccctgaagctaggtagttccctatcaccacgccactctgtgacttatttgttcattcataaatacactcatttgtttgttcaatcattaattcacttatttattcactgaatgatgaaatgcttattaagtggcttctgaacactgagcaaggcatcaggtgctggagatgcaaagatgagtagaggccgggcacggtggctcatgcctgtaatcccagcactttgggaagccaaggtgggcagatcacttgaggtcaggagttcgagaccagcctggccaacgtggcaaaaccccatctctactaaaaatacaaaaattagctgggcgtggtggtgggcgcctgtaatcccagctactagggagactgaggcaggagaattgcttgaatccaggaggcagaggttgtggtaagctgtgatcacaccactgcgctccagcctaggcaacagagcaagacttcatctcaaaaaaaaaaaaaaacaaaaaaaaagatgaatagagatgcatctcagtgtctggaagcccacagcctctaggtgctggacaggtaattcacagagtgagacagacacatgggagggtttaccctggggcctgtgggagcaccttggtgcccagtttgttctcaaaggatctgaaagggcaaggaaccacttcaattagctcagcgacttctttggcaaggaggagtaactctttccctctgtagaattaggccaatcctggtgacttcctggaggaagcagacaagtctcttttagccactgtggctggctgctgttctttccctggctgggagccacagtctaagtaaatgccttgtcacatacagaagaggccctgggagaagagtccagtgggtgcttcccaggaaggcatcccaggctgggaagggagggagagggccggagcaggatgggagctgctgaggcccagtgaaagctttgttgcaccctacacaccacatagggggcctccccgagggagagcactctgggggacgcaggacagttctccacaccagaaagtgagaggcaggctcctggctccagctcatggccccctgaccatgctgtccttggaggcagtggctcatgaatggaggaagacacatcaggtggtcaggggtgtgaggctcctactgggaccctgcagctggagcgtgcagagaacctgtgaggccccacactgggaaggagggctcacattttatccatttccctgtctgccttaggaactgtccatacctgccccacaggggctctgggtgtctcatgggagggctgcacccccagtatgtcagaacgtccatctgcagcctgcagcagaggattgcaggcactcgtggatacggcccctcttctttttgggtggtgggtgggacatgaactgaacgagggcttgctatgagaatgggtggaagtgacttctagtcaattgccctttatcttctgatgaagcaaaacgtcatatacttagatattaagccagagacaaacacattttctcacgttaaaggaaaggctgagggcggaacgtccccacttcactttggagccgggccccacacacattttcggggccatgcgtttagtcatcctgctggactatttgggcagctcgctttccttctctgggctttggctttttcctccacatcatgggaatttgggtggggaagtgtagaagattcggagacgcctctcagcttccatttttccttcatctttcaatgtttcccccacctttctctcctctcccttcctaaatgtttccatggcttgggggtgattttaaagggtcttacctgctgttccttgagtagagaattaacgttcctagggtccaagtatttcctcaatttcctgctgtttttttttttttttttttttttgaccgagtttcactcttgttgcccgggctggagtgcagtggcgtgatctccggttcactgcaacctccacctcccaggttcaagagattttcctgcctcagcctcccgagtagctgggattacaggcatatgccaccacaccaggctaattttgtatttttagtaaagatagggtttctccatgttggtcacgatggtctcgaacttccaacctcaggtgatccggccacctcagcctcccaaagtgctgggattacaggcgtgagccaccacgcctggctgatttcctgctgatttttgcatctgagcttcatcgtgtcgtctctgagggacccatgtgcctggtgaggggctggggagactctcttctatctcatttcccgtgggccccccttccacctcccatctctcctggatgccatagaggcagagccttgcagctggaggggcactgccagggcccctgctttacccagcacgtctgtgagtgtgttaactgtggccgaggactctggtgctggcccttaggagctgtgtggcccagcaagggctcctcagcctctctgtgccttggtttcctccatgtaaaaatgaggacgatggtagtgtttgcctctctttataaagcccttagtgaagactccagtgctcaatagacgtcatctgttatgaggtttatttctacgctatacaatacaaacacaaacaggtgaaaatgggcaacttggccaggggagtggttggtttttcatttttatcattttcattttttttttttttaccccattgaatgtttatttcatttgggtacatctttctttttctttctttctttcttttcctttccttttctttctttctttctttccttctttctttctctcttttttttttttttttgatggagtctctccctgtcacccaggctggaatgccatggctccgtcttggctcactgcaacctctgctttcccggttcaagtgattctcccacttcagcctcccaagtagctgggactccaggtgcatcccatcaagcctggctaatttttgtatttttagtagagacagggtttcaccatattggccaggctggtctcgaactcctgacctcaagtgacccacctgccttggcctcccaaagtgctgggattacaggcctgtgccactgtacctggcctgcagagtgactgttgggaggtgtgcagctcacggggtcggcctcactggtttgtgtcattgaatctggtagccatttgtctatatccctagtgcgatgttgggaccagttgtttgcatcaggctctcttcgctggaggttgattagggtgcccttgtcgagcagtcactgatgctgtcctaggcaggcagctttccttctctgtgtggagcaaattcaagatggtttagttcctgcccaacatgccacagtgagtctcaattcaaactgactttaactacaattataaccacagaggagcagtgagattcacggaactggaaggtctggactctaactgaggtggagttagcagctcaaacggcaaccccatggacttacctcatagtagcaaaatggctgccatagctcacacctcacatccccatgccaccaaacagagcagcacttttttctagaggtctagcaatgatcttcttgcatcctactaggtgtttttgtactattatgcccattcctgaaccagtcactgctgccaggggaatggggtgtaccacttggttcatggcaaggaagttagtccttggaggagtgggaaagagagaatgccagctcatccatcccgtggccgaatgtgacagagagaagctttctcacagagattcagacggaggaggaggcatggagcttgggcaactaaatggtgtccaaaatgtcaccgctccgaggttcttctagtagcagaggcactggccctcctgctcaggatacctgaagaggtgtcctggcctccctgagcaaggtggtttggagtctgcacatggtgacgaggttctgtcctctcattctcccatcacagagatatgactgtgttacatgggtcagcgagttctttggccactttctccaggagtccattcctgcctgttctcttctttttggtaatactgagtctcatctcagctaggaagtgacaatggacaccagcaaagccaaatgacatatccttccatgtggccactgtgtgtgcaggactgtgtccctcatcatgttagtggagaaaggggtggcacccaagaggaagggaaggtgggattccctgctcttgaggagaagctggcctgtctttgggaatggcccacacataaaagagagttgggaagccacagaaaaacagtggttagctcagggattgcgactcagggtgcagggcctgggatgtcctctcaagcacaagggaacagcctggtcatcttccttgcacctccttctccttcactgcctcttccccaggtagaaacaagatgcctgccccccaaacctacatttgtcctcactctgaaaggacacagaaggagataagactgcagggtcaggccgtgtgggcgcgtcggaggggttgggcatagggtgagcccaggcctctggcatgggctcccatttccctgtttcccaggagtgttccacagaaggtatcactgggaatctgccctcccagagattcccagaggtctggaggggacagcgtatcagcggttgtgtaaactgaggcatggagaggttggattgagttgtaaggctagaagtggcagagctggcatttgaacccacctctgtgtgacctcacgccttttaactccacctttgggccatgctgggagttgtgtaaatgcagcagaaggcagaatgcagctcaccagcaaactcggctgctggtaggacaggctgcagggaggtcagaggtcaccacttccctctctttgcttctcagtaggagtcatcccgacatcccttcagagaaaggagcagggaaggaggatagcccagcacttactcccttggtgatgtctgatgggacccccctgagccccacacttaggcttgaggtgaccccccagagctgtggttgtgaatatccccgagcccctgctcaaggtcacacttgttcccctagtgtctaagacagggaggaggaaaggggaagaggccctctgaggccccaggagcatgggctggcagacaggccagcacagcctgacttgggctgcccggctctccgcctgtgtgagcttgcccccgtctcagttccccagtcccttctgacactatgatgcttcatgagtgtcctttacatgctctagcccgcagctccgtgtggggagatggcctgcatgtgtggctggtgggagaaggggcctgcaggtagaagaacgttgctggcaccgccggtgctgccttgtgcatgagcttgcagacaccatccggaagtcagctctccacccccaccccttctccagaagaggagagactcccccatcagtagacaaagagaaagagaagaaggagatctctaatcctccggcctggtcagggcagtccatggggttgtaaattaggagggctagatgattgtctgggagggcctccagaggaggggtggctgagagttttgttgttgtgggcacagagggctggagcaagcagccactttgcactggacacatgcagcaggaagcttggggctggcacgaggccctggccccacctaagatgctcttggagaaagggcccaggactcagtagaggggctgagtctgctgtgatggatgggaggaggccagcaggttcttttcttgtgattttgtgtgtgtgagtgtgtgtgtgtgtgtgtgtgtgttgaatgtgtgttgtgcatgtggggatatggatatattggtgggtgtgcttgtgctgtcttggggtggtgatgctgtatgtatatctgcaagttaccttaatttttcaggtgtaggtagctgcgggtgcatgtatccctctgtgcctgtgtgtatgtgttggcgtgtgtgtcttgggctatggctgtcttggtatgagagaggatgtgcctgtgttgagtatgtgtattgatgtgtgcacaggtgacagtgacttgggatgtgaatgtcagtatctttgtggttattgggaagtgttaggatgtggcatttgggtgtgcaattatgttgctgtgttggcatgggatggggtgtgtgttgtgtggataaggatgtgtgtgttgtgatgggtgtatccatatgcatttgcctgtgttggaatgggatagggtgtgtgttgtgtggataaggatgtgtgtgttgggatgcatgtatccatatgcatttgcctgtgttggaatggaatggtgtgagtgttgtgtggataaggatgtgtgtgttgggatgggtgtatccatatgtatttgtctgtgttggcatgggatgggtgtgtgttgtgtggataaggatgtgtttgctgggatgggcgtatccgtatgcatttgcctgtgttggaatgggatggggtgtgtgttgtgtggataaggatgtgtgtgttgagatgcctgtatccgtacgcatttgcctgtgttggaatgggatggggtgtgtgttgtgtggataaggatgtgtgtgttgggatgcgtgtatctgtatgcatttgcctgtgttggcatggattgggggtgcatgtgtgttgcatatcatgatggcttattattacatagggtggatttgacctcccccaaggactatgaccttcaactttccttagaggagaggtatctgggttctgagactgtccttgcccctttttccaaaaccttcgctcatcactagaggggtcttccctccctaatgctggctcagcctcaggtggaagatctggcttttggggtgcaagttgggaaatgcagaaagccctgccttccagtatgcagctgtggcctctccagcctcaagcacctcctggaagaagctggggcttgaggctctggggtccccattcagggagcctctgttctggagctcagccagccttgtgcccggaggaggtccgtgagctccatgaggcaggggttgtgttttcttcagccgtctttccatcatgcttccctgcacggggcatagagcacagcagatgtcagggaatgtggtcaacttatacagaatgaaatgaaatgccttctctcagcacaaaaggcactttgcccagcagccaactgggatttagtccttcccaccgctcttcctgtaagaacctaaatttacagcacagggcctgccaccgtagacttttggtgggggttattgtgagctgggcaggttaccaggtgcatgagggagcgtgggggtttgagatggggtgcaggcatggtggtgtggctcggggatgaaacctcatggtgatgtgttctgtttgctgtcagcatcctcgggaccccctctcagggacagtggtgaccttggctccatgtccaacttctccctggatgattattctccttcacgagcctaagaggcggctctaggagtagctgttttctctcttgcctccctcctgttgaagttcaccaacagagtagctgcctcattcacttgtgcctgttggaagccaggggtacaaccttcaactgcggtcactgcctcttaggtctgcggagtgtttaaggcctaagccctgtggccagcacctgcaaagtgatcacatcgctgcttacgggtttagctgaccaagttctatggacacgatgaaggattaggggtgcaggcctggggcgatgggggtggaagtgagtctgactgagtttaccacaaggcagggatttcagaaaggcacccacacattctgcagccagctgggggtgtcgaccagagcctggggaccagacggcgctgggccctcgaggggtaaaggtcaatcagcttttcctgacctctgcatgcacataacataggaatctccctttcctgaaattccaacacatcttctcccagccatttcataaggtcagaaagaacaaatttcaagaataagaaggtagtgggttaggggagtcatgaattggatgaaaatcatgggatcatgattttcctggaaatcaccaagaccccaagtggcagctccgccagcttctgcttggaaatgtgtgcagccaggtgcattggggtcaatggtccttttttggttagtggttgatgacacgctgtcatctccaggaagtaggtcccatgggaagaatggcacatgggtccaggagactattcaggggagagagagcctgagcacaggagaaagggcagaacatgagtgcccaggagggagagggcaaagcggggtccatcagggtggggctcctcctcctgcccgagttccttaccaggaagcacaaggttctgtggaggcctagagggcccctttgatggctgtggctcttcggggaatttggatggaaagtggctggaacccccaagggatgcagcactctggagaacagggactgcctgatgagaactggggccgtcggggttgatgagagagcagtgatgtcagcccaggcaacagagtggtcattggaaccatattgtttccacgcttagaatcccccagtgacttcccattcatgaagtacggagttaaatctgtggcggacaaggccccatcacctcccactctccctggtctcactctgctgaggccctgccaccttgcctctattctcattccctgaagccagccctgtagtggcctcagcattgcctgctgctctctcaggcctgctctccccgcagaccatcctgttactggcttcatctcaccttcacctcaacgccacttcctctgggaggcctttccagggaccttagtaggaactatccctccccagtcaccccctgaagatgtttctctgtaggatttgcatctctgaggtgtttggagggcaccttgttcactcttcctggttttcttcttcactcattcattcattttctttcttgtgtatttgttgacttgcccctggtgtgagcgccaggagagcagggttggtcccttatcacatcgccagcacccacggcagtgcctggcacataatacagactcagtaaacacttttttaaaatgtgtggtaaaatacacgtaacaggttgggtgtggtggcttaggcctggaatcctggtgctttgggaggccaaggcaggaggatcacttgagcccaggactttaagaccagcctggccaacatggcaaaatatcatgtctataaaaattattttattttattttattattttattttatttttgagatggagtcttgctctgttgcccaggctggagtgcagtggtgcgatctcggctcactgcaagctccacctcccaggttcatgccattctcctgtctcagcctcccgagtagctgggactacaggcacccgccaccacacccagctaattttttatatttttattagagatggggtttcaccgcattagccaggatggtctcgatctcctgaccttgtgatccgaccacctcggcctcccaaaatgctgggattacaggcatgagccaccgtgcctggcaaagaattttttaaaaaattagctgggtctggtggtgggcacctatggtctcagctactcagaagggaggaggctgaggtgggaggatcattggagcccaggaggtagagactgcagtgagcaatgatcgttccactgcattccagcctgggcgacacaatgagaccctgtctaaaaaaaaaatacatataacatagaatttaccattttaggctggacaccatggctcacgtctgtaatcccagcactctgggagactgaagcaggaggatcacttgatcccaggagttcaagaccagctggggcaacaaagcgaaactccattgctgcaaaaaaaaaaaaacccaaaccaaaccaaaacaaaaatcagctgggtgtgatggtgcatgcctgtagttgtagctactcaggaggctgaggtaggaggattgcttgagcccaggaggttgaggctgcagtgagctgagatataccattgcactccagctttggtgacagagtgaaaccctgttagaaagaaagaaagaaagaaagaaagagagagagagagagagaaagaaaagagaacttaccattttaactgttttttttttgttttttgttttgagatggagttttgctctgttgtccagtctaagaaagaaaaagaaggaaaggaaggtaggaaggaaggaaggaaggagggagggagggaaggaagaaaggagggaaggaaggaaggaaggaaggaaggaaggaaggaaggaaggaaggaaggaaggaagggaaggaaacttaccattttaaccattttttttgttttttgttttgaggtggagttttgctcttgttgcctaggctagagtgcagtggcacgatctcggctcactgcaaactctgccttctggttttaagcgattctcttgcctcagcctcccaagtagctgggattacaggtgcccaccgccacacctggctaatttttgtatttttagtagaaatggagtttcaccatgttggccaggctggtctcgaactcctgacctcgtgatcctccgcctctgcctcccaaagtgctgggattacaggcatgagccactgcacccagccttaaccatttttaagagcacgatttgtggtatgagctacatgcacatggttatgttatcatcaataccacccatccatagaacccttctcctctggcaaaactgacactctgtacccattcaccacaactccccatttctctcgccccccagcacttggcaaccacccttctactttccatgtatggatttgagtactctaagtaccacatataagtagaatcacacagtaattgtccttccatgtctggcttattttgcttagcatggcctcctcaagattcattcatgttgcagcctgtgacagatttccttcctttttacggctgtatagtattctattgtatgcatatcccgaattttctttatccaattcatctgctgatggtgtgtccttttggctgtttcagtacacacttgaataaatgaatgacgacaaggagggtggatctctgcctcccttcccctgcacaagacaggagtggcagctttgaacccatgaaggccattcattcatggattgtatcctatgctactggctctccagaggccagcgggacctctttctgcagtaatgtgctgtgctatggggtctggaccttggccaagatactgagcatttctgagggagggttttggcgtcaggaatgggcctctgctcagaccttaagccactgggtagctactgtgtaccctgagggggtcacagccctttccacagcacctggagcagaggcaccctggtatagctccctctcctaaccctgcaaggcaagctgtgccacagccctggccgcacagcggcctgtgtgagcccagtgctctgccatccgggaaggaggtgagggaaggggagggtgtgaccccacagtgcctggagctcatgctgggagtgagtgagcacaaacaggcaccagcgccccgtgaaaaatgtgtcaccgcccacgacaagatacgctgcgtggtttctgtaggaaactgaaattccagaaaacaacccctgtggtccagtgtgttttactggaagttcagacctccccttcaagcttgccttgtgccttttagaaacagaatctctgtctcactccccaacccagcctaggttaatgctgagaccagggcaaagaggaggacttggcgataaggcttggggctgggaagatgctgtgattcactttgatgtcttggaggggcaggttgtgaggatggaatgaggaaggggaagaccccagctcgaacgccaagcttcggtgggcctggtgggctggccaagtgtcatagctgctgcctgcatggggtcctgtgtgccacgccaggcacagggcaggtgctggccaagtggatctcccccgccactctggcagttcataaactgggacctggggcgaggggtctgcattgagctgggaacacaaacctcaaggcccgacttgtccagatgtcacttggtggtatggactctgcaggggttcgtgagggctgtggggttcttgatggtggttgggagagctgggaaggcacggagcagcatggagggatggagatatggtcttgggggaagctggtatgctggacagaagcagcaaatgtcgtgagtgcagagtagagcagcgcttgggagggcctgggcaccgatgcccatcgacacctaggcagagatggtgtggaccctgagatcaacagggagaagaggcatggggagctttggctttgggggtgcaggtgcagagagggattccaggcaggagtgtgctcatcccattcccacctgagaatgtccagaggcgatgaggattgtcacacccaccccataaaggggggcccctccaggcctcctggggctttctcccttccctggcacctggaagacccagatacccatgacccagggccctgggggactgctgcagacccactccctgcagcaggatgtcccctgcaacatggtgctgttgaccaagccaagtctccaaacatagacataaaagaaaggaatgaccgggcacggtagctcacgcctgtaatcccagcactttgggaggccgaggcaggtggatcacgaggtcaggaggtcgagaccatcctggctaacatggtgaaaccccatctctactaaaagcacaaaaaattagccgggcgtggtggtgggcctgtagtcccagttactcaggaggctgaggcaggaggatggcatgaacccagaaggcggagcttgcagtgagccgagatcgtgccactgcactccagcctgggcaacagagtgagactccatctcaaaaaaaaagagaggaagaggaacatggcaggagtccccagcctgctgcaggctttatcacacctctgcttgcccattagttaccaggaaaaatcttcctcctcaaagggagagcattacaagccaatacacctggatccctattctatttctggggtgcccaacaacccttggctgatagaggcacattccccaaagggtatttggtagttctcaattaatggaatgaagccatgcacaggtgtacccattccacacctgggtattccacacctgggcaccctgctcctctggggacgctcagcctggcttacagctcccaccgcccacctgcctatgtccatcatgggtgtgataggagagggcacctcagagccagccagggatgccagaggtggatggtgcctgtcctggaatctcggtgcaggttgtagaggggatagagtgaagtcagcttcacccagactgtccccagcccacccccacatcttccccacatgctattcactgctagaaacataatatttagctgacggcaaggaagccagagaaatcagcagcaacagtggtctccagggggagagatgtaaccaaaaaacaaagtgtacgagttagagtcaattccagagcctgtggctgcttcaagctgccgtggacagcctcctcccaggtgagtcctgagggaggggtttggggaggaggctgtgcgattccagggggagcaggaggctttctgtctgccatcttccctatgatttttggcttgttggtactagtttctttagctacacccttttttgaggaagggaggcttagaataaatttctaatttttgaatagtgttagatttgcagaaaagttgcaagaagagtccaaatcttcttatactccatgcccagcttcccctgttgttaatatcactgtggtactaatatcacaacacatgaagcaatgttgatgttatcattaaccaaagcttatactttactcagatttccttagtttttacctaatgtcctttggtctaggatctcatccataataccacattacatttagtttttttttttttttaattaataaactttgttttttaagagaagtttcagatttacagaaacattgagtggaaagtacaaggggtggccatatgcctccgaccccacacctcccccactaatggacaacctgtgatagtttcttagactttccttgtttttgatgacctcaagacagtctttgaggagtcctggacgggtattttgtagactgtcttttttttttttttttttgagatggagtctcgctctatcgcccaggctggagtgcagtggtgtggtctcggctcactgcagcctccacctccctggttcaagcaattctcctgcctcagtctcctgagtagctgggattataggtgcatgccaccacgtccagctactctttttgtatttttagtagagatggggtttcaccatgttgtccaaactggtctcaaactcctgacctcagacaatctgcctgcctcagcttaccaaagtgctgggagtacaggcatgagccactgcgcccggccttttttttttttttttagagattgggtctcgctatgttgcccaggcttatctcaaacacctgggctcaagcaatcctcccacctcgtcctcccaaagtgctgggattacaggtgtacgccaccaggcctggcttagaccgtttatcagatgttcttctcatggttagactggagttatgggaggaagtttgtgaggaaggccagggagataaaggaccattctcatcacatcgtgtcctattaatctggcttatcactgataatgttgatcttggtcacctggctgaggtagtgtctgtcaggtttctacgcaggaaagccacagctgttttaaagataattaacaggcaggacaagctaaataatttatagagctcagtgcaaaatgcaaatgtggggcccactgttcagtcacaaagaatttcaaggcagaaatagaacattaaaccaaattcagggtgcttttaggcaggggctcctgggtgacgtgcacaggtcgcagtcccatgagactggtcttgtttgcagggcaattgtcagatcacccagatgcccctagagctctttctgcatggagagagaaggcctgtgccagctgtccttgatccctggacagttggaaggggcagatggctgaggaggatcctaggtacccatagccatgtgggcaaaacagtatcacgggcagaggatgtcatgaacatcacaggtgtctgcagaggccctgctgaggcacctgcctggtaacatgaaaaacttgaccggaggtctgcctggatagagagagaatggttgggtgtgtgcaggagccagtggttagtaacaaacagcagcaactctgtaatttttttttaaatgctacttttatttttaagtttttttaaaattattttcttctttttctcagtgctcaaagcagcattttttttttctggaacaccttagaatagcttatttaccaaatgctacatgagcctttatgctgggcaaaccgaggagctccattagagggggacacctggccttgaccgcccccatccctacagctttcttgttaggagaggagggcatcgcgctacctggtctcaggtgcatacctgcggaagcagagtcctcacgatagcagggagaagagtgtagggagaagagtgtacagctgccaaccggcttctccttgctattattcacccagctgtttagagaaggagagagtatttctaatcagctatatggcatggagttttatttgccttggtaagttaaaatgtacattattggtcagcatcttgcatgcaaattttgacattgcattccaggagtacctgcggaagagagtggcggcaggtcggatctgtgtaattacattgctttgtaggcttgtaacattgccatcactaacgatgcccggtatctcactgcgacggctgcctggggatattgccgtgagactcccgtagccagagaaagattatgtaaacatgtgtgatctcaaaagtgagtaatgaagttgagtacttgttgcaaaaattaataaatggctggtttacacgtgatggaggagtcccttgtgtgaaaactgagtcacccagtgtagtgatggataaacgcacttcgaggcacaggtgacttaaagaaattcatccttttctctactgatgtgatcaaatggacaattgcagtccacacctttcactccctacttgactaatatgaaatcatcacgaatatatctttctcctgctcttggcctgtcagaatcttaactcttgcttcaaaggatggcatgtcagctctatggggttacctgcagtttctggaatggtctatgttgtccaatgctgcaaggaagtgctccaaggtggccttggaccgatctgattctgccccctttctcacttgtagttctcaagaataagggtagaggccgggtgaggtggctcacacctgtaatcccagcaccttgggaagctgaggtgggcagatcacctgaggtcaggagttcgagaccagcctggccaacatggtgtaaaccgatctctactaagaatacaaaaaaaaaaaaaaaaaaattagccgggcgtggtggcacacacctatagttcctgctacttgggaggctaagccaggagaactgcttgaacccaggaggtggaggttgcagtgagccaagatcatgtcactgcactccagcctgggtgacagagtgagactccatctcataataataatagtaataataataataataatggtagaatgttctggggatataacatcttgagattagggggagctggccaaaacaccctggcctctgatacagttccccctagaaattagatatcctttggtgttttagcccagcgtgtcccatggccccagagtatgcaaccctgggggctgcttttccaagaccctcagttgtagtgcaagtggcttatacagacaagactacatccaccccaggaagctttcttgagccttaggggacccacttgcaataaatcttaggcttctgtccaccttgctgcctatctgtaagtaacaaatctgcttcacataacctgttgcatgtattctgtgtcattgaacttggacaggctggcacccatcctcacacatgcctccaggcctttacacatgcaatttgttcactcatatccttggagccgctacaatgtatcctgaagttattactcacctactaaatgtcctttgagtcacagctcaagtgccacctgctcagaggagacgtcccgcccatcctgtctggaaaattaaccccctgcccttctggcccatccttccttgatgatgcttacctttctgttttagctgtctctcctccagggatgaatgttcgtgaaatcaaactgaccagggtccagatctcagttccaccaggcaccagcttgtgtggccttcagcaagatactttctgaacctcaaatgtgctgtctgtacaatgggaaaacactagtttctagtttgtaaagctgttaggatgagatgatgtgcctggcccatagtagctgctcagtgaatatttgttccgacatggatgaaggaagtgagacttttgtgatgtctgactatttttagactggagaggaagagggaggcatatgggaaagaaggcatggcagagacaaaggtgaagcacattggtgagctaggtgtgtttagtggatgttgacgccatgtggttgggaatgtgctgggaaccctggaaaaggagactagggccagactgtggaaggccttggacgccaggcaaggatgacatcctgcaagctgggaccagctagaggctcataaaccctctttctctctctctctctctctgtgtgtgtgtgtgtgaaatgattagggggtttatagcatggctaccctgtgagcactgtgtagggctccatattgttatctgggtcttgttcctcacgttttccactccctcagacacccgcccttttccccacctcctccagcagacatttgtggacctcctgggtcccagacagcagtgtggccgggtcctgtgtgaactcccccaacccctccccatcactctgtcggggtgaaagcactgatgtgttgtcaagggaggatattacacgaagcccctgaagtggtacattaaagcagtttggattttctcttactgctaacattgattactattaattaaggttgatatttacaatcagagggagtacaggagcagatcattttttattaatcactattctggattcatcatcagtcatcattatcaaaatattcagacagtggacagtggctgagttttaaaactcaagtaaatgataaaattaaactacattagagagtatatgttctctgtgacctctgtctttcctagttttccctcttgtcccccaatggtctcagcctcctgctgtgcattctccccccacatcccccctttcctctctcctacctgtcccttcccttcctctctctctcctttcttccttttcttcactataaacagcactaccctataattctgcagtttgcttttttctttcaaccatgtggcttcaagataaccttatttttgcgttattgttgttgtttggttttttattttgagatcaagtcttgctctgtcacccaggctggagtgcagtggcacaatctcagctcactgcaaccttcgtctcccaggttcaagcgattctcctgcctcagcctcccgagtagctgggattacaggcatgcaccatcatgcccggataattttttgtagttttagtagagacagggtttgactcagatttctcttagccctgttcctgtccgtgtaacatagccactggtcatggtggctcacgtctataatcccagcactttgaaaagctgagagggaggattctttgagaccaggagttcaagaacaagcctggacaacatagtaagaccctatctctagcaaaaaaattaaaaaatataagaagaagtataacaggccataaaatagatatggcctggtattttgtatgtatttttagccattccccaattggcgggcatttaagttattccctcccctttcttcccactgctgccatagtcagtgccacagtaggcatcttgtctgtgtcttggagcaggcaggaaagcagtctctggggtaggcatgaagaaacgggggtacagccacagcccactgggctccccagccccttctccatgtccttcctggactctagccaaacccaaccccacacgagccccagacatggccccgtgtactggctctgctgtgctttaggaccagccgctcctggaatgcttgatgaggggtccccctttctcccctgtctccccatgttcagttcctgcccacatctaaaggtatggggaggtgcctgctcctccagggacttaaggttacctgctttctcctatgaagctcacccaggaacttgtcactgtagagtgaaatgcattggtagctttgttctgatgatttttgagccccatgaagacggcaacggagtcgaactcatttgtctctccccgggtcattacacatgactaccaagggctcgtcttctgaagaacaaatgcggctgttggttttcccacgtgttagtaagagagtgagtggttcttgacattcttcagccttttcctccctggggttagggctggggactggggcttctcccaccttcttccctctgtggccccagtcatcatccactccccagcgcacctgggacccctgaattcgctcttactgagctacatgaagacttttggccagccgtggtgttaatccgtggactctggccattagcatcctggcatttggaatgagaaaagtgaaatttaggggatcctggtcttccttttaggagtctttttttaagtaggtaaacaattgtaggtaatttaatttgtctgttaatggcgcacatggatttactaagagggaaatgtcactgggttgtggacacacactgcatataattcgatgagaatcggcctctgatgggcagcaataaatgtcaaactgttcaacattgattgttcgtgaaggaatattgcttaacaatgaataaaatacctttctgagtttcctctattggcctgactttaaaaggaaatagggagatggactccctctgtggctcacggccgcttaggcttggaggcagggaagctgctgggaaatagactgctgggcttctgttctcaaacaggtccattttagtggctcctcaagcccgcctcccagagcagagggatgaatgcttagaggccctagtggctccccatgtgatttgcgaacttctccggtctcactgggcctgcctgcctcttggactccagggcctgtggctctgtggcacccactactctcctgctctttctgtcactcctcagaatgctccagtgtggtcctgccttggggcctttgcacttcctatacttgctgggtttttttttttaatagagatggggtcttgctatgttgtccaggctgtactgaaactcctggcctcaaatgatccttctgccttggcctcccaaactactgggattacaggcatgagccatggtaactagcctatattttctttgttaaggtccacttgtctttacttttccctgaccacccatccaatgtcaaagctcatcttggttgtgcccttattctgtctgtcccgaatcatgacatcacccttatgtatttaactatttggtattcttttatttccattgtactgacacgttctccatctccccactagaatgcaggttctatgagggcaggaatggtgtctgttttgtccagttaggtagcccagggcctagagtagctcatgatacaggaatgatatacattcttcatgatattcatacacagcagtaagtactgatggacccagtgtgttgaatgaatttctgcggagtcgtatgacatgcatgcattttatgaaacagcaacctcccaagacatgaaaaaaatatgcttgaggtttctttcaaatgaatctccctttaagcagaaatttctgctttgtggcgtgaagaaagcagagtattccagcagtggttggttccttctactttttagacaacccagtaatttgtttggagtgttgttgggtcagggggttctcactgacaggggctgtgtctgtcccctctggaaactgaaatctcctccactgtgctttgctgaagacagcagtggctgggcacaatgatggcaaactcttgagcttatcagaagaataaaaggacttaagtgaagtggagatttcttggtagttatcaccttctagaataaaaagaaaacctgattctttccttcatctcaggggatcctctattgttataagtgacctcggtgagggaagagagttttcttactctacagaaataaaaatctgtctgctttctctagcactgaagaaaaatagtccttttttcctttttctttttagaaaagcaccttgcagcttctgatgattgaggacggggtgggatcctccattgcccaaccccttagctccaccactctgcagacctcggcgtccttgaaggagctcgggaacagagatcagcatgtgtgggtcaggctgctgatggctcacatttaagaaagatggttcatggataatccttggtgtttttttttttttttttccaggataaagttttatgtttgaccctgagaaccagatattaagaaatatatgctatgaagtcattttggctgatttaatctaaacttcctgtatgctcttaggcagaggtttcaaggttgggagggtcttacgatctaactctgccccacgcggggttgaggaatgctgtggggctccgccagcttctatttgtataagtccggggtagggggcttcctgctgtctcttgagggggcccattcagagcctgaggagctctgatcttagaaagcctttcagatggggggatcctagtgaagctcatgggttttgggctcagtcaggcatggtctgagtctcagctctgtacacataaactgctggatccccagccaagtctgatcccttatgtgtataccggggaataatagtacttaccttagatgactattgtgagaattaaatgatgattatcttccttctaaacaacagcagagcacatagcaggcactcagtaaatgctctctctctttttaatattgccctgaaatgtgcatggtcccaggattccttggggtcctgtaagtcgaactggattctcccaaggccaagggacaaaatgtggtatagcttcgagtcttgagccttgtctgcttttcttattctgtgcccatctgaaccaatgcacttagtgcacaggacctgctgggttgaccaacgatgcatcatctgtgtaggctcagaggggctccctctccttttggaaactcatccttccgaggccatttttgcctgtctggggaccacggattctctggttcccactgagttactcatcactgtccaatccctcaagtcctttctcagaggcctggtgaagccctgccctctccccagtcctgcattgccactctgggattgtgtatcccatatcagttaggacaacactgaccgctcttataaatacaccctaacatctcagtatcaagacaccacagtttacttttctctctctcatccggagctcaatcggtgttgggcacaagcagcttttatttagggaccaggccagtggaagcctcatcattttcagtatacagtttcctgggtcacccaggacattgagatccagctgtcaggaaaagagagcaccatgagaatggagcaagagactcttctaagaagtagcagccttcattttgtccaaattccaccggctgaaagtcagtcacgtggccccagctaaatcagataagcctggaaaatatctgcggttgggaaactgcttccagcaacgaccctaggtcgtggaaggagacaggaattgctagttggctgctgtttcgactacagaccagatgtggaaaaggtcaacaactgtttgtttaattgcatcactcattttccccttggcctggtgggtcagggtgctgtgagggattccttcattcaggggccctcacgcacaccccacttccccagcactggccacctgcgcttgttccattcatgcctgttgggtttttgtccctgtcactgataaaaagcagtccacgaggcagcctcgggacatgtgccctgccacatcccagggtgagagtccctcccttccttgtgacctcagcacttgtttctgtaccctttgggtatggctggttaaccagccactgatccacttctttgccttgcttcagtttcacatttctcttttttatctccgtggaaatcaaaatgccctgctgagatgcagacacctgatgtctaatgcaggtctcggtccccagccttcagggctggttccaagggagcccgcgctgggctctggggattgctgttcccccttctaggcttgcctcaacttttgtgaaaaagtaagacccatgctgaagtcagtctcaggatcgattgtccatgacaattagctttccctttctccacagttcctcagatatcacagcagcaggtttcagcactgctttcccaagctctcccggttccatggtgccaatttcacgggagtgtggagatgaggattctgctggagcagacatgttcttcctgacagtctttgtcatccatctcaggctcccgtgggtcaacaggtctctcttccttccccgggacctctccttgcagggcagacagaacaatcccttctcctcttctccttccccaacgtgatgtcattgcttcctgcaccaaactatagttcctttctcagtctgtttgttttgctctgaattgaacttttaaaaagggttttttaccatcattctcagcaaactaatacaggaacagaaaaccaaacaccggatgttctcactcataagtgggagttgaacaatgagaacacatggacacagggaggggaacatcacacaccggggcctgtcgtggggtagggggcaaggggagggagagcgttaggacaaatacctaatgcatgcagggcttaaaacctagatgacggattgataggtgcagcaaaccaccatggcacatgtatacctatgtaacaaacctgcacgttctgcacatgtatcccagaacttaaagtaaaataaaaataaataaataaataaataataaatggctttttagcctgggcacagtggctcatgcctgtaatcccaccactttgggaggccgaggcaggcagatcacctaaggtcagaagttcaagaccagcctggccaacatggcgaaacaccatctctaccaaaactacaaaaattagctgggcatggtggatgcggctgtaattccagatacttgggaggctgaggcaggagagtcgcccgggaggcggaggctgcagtgagccgagttcatgtcactggactccagcctgggcaacagagttagaccctgtctcaaaaaaaaaaaaaaaagggtgggttggggggctttttagctgcccttaatactatattttttctttccttggctttcattaaagataagatcatttcaagtcccagtcacttatgtctgaggttccctaagaacatgttccttcttgtttccatgttttattcaaatcatcaatcaattaatctattcacttaacacatctatgcatatgtgcatgtgtgtgtatacatgtacttgtatgtacatacatgcgcatgagtatgctagatgcccactatcgtcttttcaaatctcatctctctgggggagtcacactggtttttctggacccaggcttcttccctgtcactgggatctctctggttgcacagtcggcattatgacacgtttgagagcatcctcatctttttctgggtcatttgcttgaccagcctctcgtgtcctggaatcctacctctcttttctgcaagtattttgaaccctggtatgttaaaatttaggatacacattggttcgtgatgaattacaaacatttattgagtttttaaaaaatgccaggcagtgtgctaacttattaaatggatttaatccttgtaacaactttttagaattgagttctttttaaaaattttgttgattgatttattttcattttttatttctatagtttttggggaacgggtggcttttggtaacatgggtaagttgtttagtggtgatttctgaaattgtggtgcacccatcaccccagcagtgtacactgtatccaatatgtagtcttttatccctcacccctcccgccctcaccacctccccaaagtccatcgtatcattcttacacctttgcctcctcataacttagctcccactgataagtgacaatatacgatatttggttttccattcctgagttacttcccatagaataatggcctccaacttcatccaagttgttgcaaaagacatttgttccttttgatgactgagtagtattccatggtgtatatgtaccacattacctttatactttcgttgatcagtgggtacttaggttgattccatatctttgcaattgcaaattgtgctgctataaatgtgtgtgaatgtgtgtgtgtgtgtgtattgtgtgtctttttcatgtaatgacgtcttttcctttgggtagatatccagtattgggactgctaggtcgaatggtagatccactttcagttctttaaggaatcttctgttttccacagtggttgtactagttctcgtaacaggtaacagctttctgaggtagatactgattttatcctgcagtagaaaatggggatctgaggttctgaaatgttaagtaacttccccaatgtcacacaggaagtgctggagtctggatttgagccggtctgttttattccttctctgtgctcctaaccattgtcccatcactgtgaccccaacctacctagcctcacacacctaggattttgagaactctaagacaaacataattgtagttgtccaagattcttgcttttttttttctgccttaactaattcctccctattagttagaactaaatctagagttttaaaaatattccttcattatattctctacggtctggaaaatgaagttatcatcaagataggtcaaggtcttgtcagatgaatgaaaacaacagtaatgatgtattttcctccccattaggtctgatgcctcgctttccagccagctcaaagttctaatggacggtcagagtgaaatgttctatcagtcccttgtccagccccccagctggttgaattgggagttttgtgtttgcaggggaccctctatttccccatctgtctgggtgggcttcagcaagcttctagtatcagcatctccatagcgccctcctctgggtccaccccttgcttggtgctgtatgcttcttgctttgggcagacaggagcctggggacaccactccttcaccatttctgttaggtctggcctttggggtccagaagtcctggggacaggggtgccccatgttctgactcccatcctccaggctccagccccaccctcactgtgaggtttatttagtgttctgtgttggcccagtgcccacctcattggaactggtgacctccttgacaatttgttttctcctgtgcatctccaggctcctcccacactctcttctcctctctgggttgtacctgttgtacactgtgttcctagggtgccaggtcagtgagcaaggtggctccccttggcaggtcagctggcctcccggaaaacatggtcctctccccttctgggaaatgcatcagagtcccagctgggaccttttccaaggcctcaagtttccttcaggtgtcccattggcacctcaaactcagcaggtcccaaatgccgagtcttccgaatgggtgtctcctgccatgctgcctggcggggtgaacagaccccaccccaccccaccccaccccacccatccaacaaccagaacacccagggcatggtccaggcggttccttctcacaccccttggagacccctctttctgcttcttaaacaattcttgcgtttgtccccttgtctgtcacagatctgaatctccacatttgaggtcttcatgggtttccctcttaaacacagtttccgtctagttcgttcccggtagcttgctccaaaccctttcccccagatctctggaaggatctacctaaaagccaacctgatcatgtcacttctcagtttaaagcaacccatgggccttcagaaaaaggccacagtctcatgagaaccttcagggtccagcccttgcccacctctgcagctgtgcctcttggtccccacagtctttgttctggggtgggggtctgactcctgcaagtttccccaccctgtattccatcattcctctgggtctctgtgtgttcagctctctctactggaaatccccctctacctcaccatcccaattctttgccaggctgacttctgccttcctttggaagtcatccccctgaccccaagtctctgttaaacccagcccatccccgctggtgcaccctgccccatcgaatcacaggtgttctctctctcactccctcctacgcctgaccacctggacacactccatatactctgttgaatggatgaatgtatgtcccagaaattcaaattcatcagtgtggggtgttttctctcattttgatttttttttttttttttttgagatggagtctagctctgtcaccagactggagttcagtggtgtgatctcagctcactgcaacctctgcctcctaggttcaagtgattcttctgcctcagcctcccgagtagctgggattacaggcacccaccgtcatgcccagctttttttttttttttttttgtatttttagtagagacagggtttcaccatgttggccaggatggtctcaaactcctgacctcgtgatctgcccaccttggcctcccaaagtgttgggattacaggcgtgagccaccgcatgcagcctgattctttaatatatcaagtaagtgtttcgccccatccttgttctttctctgtgctcttagcccatctctgtgcaggacccatgagcttcttgtttcgtttctttgagcaagtagcgcactttcttttttcttcttcttcttcttcttctttttttttttttgtcttctcttgatcttttttggaaagactgtggaactccgtgtgagagctcttaaattttctgggactcaggaaagtggggggacaacatctcttctttgttataaggattaattactttgtaaagtgctataagctttgtagagtagaaaatcaaaccttgttgccgggcgcggtggctcacgcctgtaatcccagcactttgggaggccgaggagggtggatcaccaggtcaggaaatcaagaccatcctggctaacatggtgaaaccccgtctctactaaaaaatacaaaaaattagtcgggcgtggtggcaggcacctgtagtcccagctactcgggaggctgaggcaggagaatggtgtgaacccggaaggcagagctttcagtgagcagagatcgcgccactgcactccagcctgggcgacagtgtgagactctgtctcaaaaacataaataaataaataaataaatacataaatacataaataaaataaaataaaaaaaggaaatcagaccttgttaaggttccacccctgcacgtttccttcttcccatggtttccttcaagcctctagctatttttttggtaacagctttattgagatataattcacatatcatacagttaatgcaaagtgtagaattcaatggtttttagtctattcatagaattgtgcaaccatcaccacaatcaattttagaacatttctatcatcccagaaaagatactctgcaacctttagctagcaactcccagcccaagacaaccgcacatctctttcctgtcactatagatttactgattctggacgtctacttgctgttcttaaagctcatctctgtgcaggacccatgagcttcttgtttcatttccttgagcaagcagtggatctttttttcttctttttttttttgtcttttcttggccttttagcaaagactgtggaattccgtgtaaaggctcttaacttttcttgaactcaggaagcaggcggtggggtggggggaaacatcttttctttgttataaggattaattactgtgtttgtaaagtgctataagctttgtaaagtagaaaatcaaacttttgttgattttctaattgttccaaattaatgtcattttctcaggtttttttcttaatttgggatacctcattagcaaaaaatatcaaatttcagagaaagatgttctaagcctgcttttatcatatctccaacctggagaacccatagcaagggaagatgagctcagagaggctgtggaagttgctccgagaccagtaaaggtgtgtttcattaggtgggggttggcgtcactattatccatcaggaaagggagagggtgctcagtctgccagtgacacatgtattttctttctttttttttctttttaaaatttattttgtttaagttccgggatacatgtgcaggatgtgcaggtttgttacataggtaaacatgtgccatggtgctttgctgcacctatcaacctatcacctaggtattaagcccagcatgcattagctatttattctgatgctctccctcccaacctccccgctgacaagccccagtgtgtgttgttcccctccctgtgtccatgtgttcttatcgttcagctcccacttaaaagtgagaacatgcagtgtttggctttctgttcctgcattagtttgctaagggtaatggcatccagctccatccatgtccatgcaaagaacatgacctcattcctttttatggctgcatagtattccatggtatacatgtaccacattttctttatccagtctatcattgatgggcatttaggttgattccatgtctttgctattgtgaatagtgctgcagtgaacatacatgtgcatgtatctttataatagaatgatttatattcctttgggtatatacctagtaatgagattgctgggtcaaatggtacttctggttctaggtctttgaggattctccacactgacttcctcaatgggtggactaattgacattcccaccaatggtgtaaaaacgttcctatttctccacagccttgacagcatctgttgtttcttaacttcttacatgtattttctataataactcatctcatctgtttttggcctacttggacttggtcctagtactccacaaacatttccttggctcagataaagggcaaatgctgataattcacctaaggagggaataaaactactaagtagaaggaacacagttcatctgctctagtatttaaaaattacaaacttaaataaagaaccagtggccattttggtctattgaatgataacaaatattaaaaactgaaactcctgcctgccagggatacagggagccaggacttccaacaatgctggtagccttctaagtggttgaaagatctgtagaagacaatttgtcaatacccatcaggagtaatgacacgttaaactcgttgacccagtaattctgcttctgagaatctattttaagaaatttatccaaagtatgaaaaaagttacctgcgtggaaatgttcattataacatcgtttaaaatgccaaaaattaaaacaggaattgtgttaaaatgtatggcactggggcattccatggagacagagctccttgatggacatgatgcagccatttacaatgatggttttcaggagtgtgcacaagaacaaaagaaggaaacacaactgaatgtggaccaggggccgggccatgtgaaaagctgtgcacagtaaagcaatgggagggagaaatgccaaaataattactgcaggggctttaaggcatagaactgatgccttctcagtctctctctctttctctctctctccctccattcctccctctttctttttcttttgtccatatgttttatgatgtatgacattacttccataaaattttttaagaaaattagaaaactcaaccccctggtgcatgttaagaaggtcaaacttactgttttgttcttcaaaaacctgaagtcctgaagtgaggaccaaagagatagtagtaaactagcataatgatcacattccctggcattctatagaaaatgacaatttcccccattccctgaaacaaatcttgactaactttgatagttcagcaattagaactttggcatacaatctttcttcttcaactcctataattagtggtctccaattatatgaatcaatttcaatttctataaatcagatgatttagagagaaggctgttcaatttccttttcaactgtatggtttcagcagcaataaaactctcagcttaaaatatcaggatgcaacttgctccagaaatattacccagctcatttagggcttctgccggccgccacagcagttcccaggtttctaggtggtaccacttatctgtctgctcctgagccctgttcaattcttcttcatgggatctgacatctacttacagatttccctcccagtgtgggatgactatccctagaccttcctggtgttctaacagaaagacccagtttggacccagatgtatctctctaatgctagttagcaggcacttttagtgtctccctttttttcagtcctgggtttttcaatgtcagtggccctctaaggtgttctgcaggatgtgaaacctccagcctgaatctcctctaagcctggcttcgggaagtgcccgttgcaccctgctactttgtgaggactcttcatgaatcaattcctgactcattcccggaatctggagttgtggtttctttttctcctttagtcctttaatgtctgaaatgtgatttctttcatctcacaaggagcaagtcttattattaattttaaaaattcaaaaaggaaaattatttagctatttttttaattaaaaaaaaaaaacaaccctgagagtctcaacagactcttctgagcatcgaatcacatagacactttcatgtggcattaactcttccccattcgctaaaaggaaagcaagccaggggcagagggcgggttgaggggtcagctggaggaatctgtgccgaagagagttctgggttgcaaatgcacagcctccctcccctttcttctccccttggaggagataagtggccaaggcttcagtttgatgctaatgtggtttttagcaagatgtctgcttttggttgaagattggcctatggcttttatagtattcttaaattcagcttatgttgaattattattgttcctcattttgtgcatgacttccagttcccgaagcattagagtctctttaagtgctagggctgctgactgaggtttcttgacaaatagatcatggaaaatcaggacgttatatactggcctgcccaaggtatctgcaagaccagcccccttgtggaatcactggggcagagaacccacagctcaagctctcttttgatacctggggctctaaagaaatgtgtcagcaagtcttccaaacccaaaggggacaaggcttatctttcctggggagctcaattcaacagggaacagaaaacaaaagacagaaaccagccatttgtgacttgtttatttgattgtagccattaacaatcatgcattgaagaataacagtttcaaaacatactcacaagctgaggtgtggtgctcaggcttgcagtcccaacactttgggaggccgaggagggaggattccttgagaccaggagttcaataccagcctgggtaacatagcaagaccccatctctacaaaaaatttttaaaaattagcgaggtgtggtggtgcatgtatgtagtaccagctgctagggaaggtgaggtgggaggatcgcttgagcccgggaggtccagaatgcagtgagctatgattgtgccactgcactccagcctgggcaacagagtgagactcggtctctaaaaatgaaagtaaaaataaggaaaataaaataataaaaacgtacaatataatgttgagaaaaaataaaatataaaactgtatgtaacttgttttgtttatattcgaataatactttaatcagatttaaataaatatgattagaaagaagtctataaaagtgatactgacagtcgtcgtcaggtagtagaatctgaagttattttcatttcttttcatacctttccatatgttccagatttctgcaaatacaaacatggaatactttgctgaatagaatgtgaaagtttgctgaaaaggctgaagaagtaaaacaaattctgaatttccaatatggtacttggtcatagattgctctgacctgatttgcaagttctcaaagggtgcacactctgttcttgtctgagtcctaccagggccaagcatgtgcttcaaacctacatgcttccattgagatcctcctatgtacctaatgcatatttcaattgagtttggttttggaggatctgacttagtccaagttcatgtgaacctgcagagaaaagtgcacatgattggaggataaaagccattgctaacttttttttttaaccaagttgaccagttgttagaccagaaaacagttttgttgttgaataaacataatctcttcgttcatctcttcttgataagccctagaatggtgagatgactccctgtggctagcaatagaagatcctattaggcaagttttcttcaatcaggatgaaagagtcatacatattcaaaatgaacattttagaatatatagaccctttcatctccaggagggggttgtgtatccttgtttagatcttcattttacagatgagaacacaggggtctgaggaggaaaggggccagctcacatcccttgctgaactggcagtggatacagaatgtgaaccactgagtttttagggtcactgtaggctcccccttgccacagagataacagcgttcaccacttagataaagaaacttccatgctggccagcagtgggcattttcttccttctcccactcactcttcctgtaagcagaaataaggccctattgttatccaaagggcactctctcctaagtatgtcctagggcaccccaagatgatgatgttgtttgctagggtccactaccaggaaatgtcaagtattcgggattgcccacgaaagagtttattttggtataagaaaagatgggcttttaaaacttaaagtgaaaactttgggtttggaagggaaaatgtaaaagttggttataatgaggactttgtttgccaggcgccccagcccggtgactaatggctggctgcttgttggagaaagctgtctttaggggcgttgagggtgttagcaatgaacaggagtgggcaggcactgaggacccgggacccaggttaggaggcgggggaaggtggggtgaatgtgcaactccaatgagaaagtatttaactatggctccagtgtctaccaaggcctgtccaaggaccttggttgatgtcgctagagacaatgttgcctatcttcatgaaaacaaacggcaagtcctatcctgactcaaggagcagggtgttttggataattacaattttactccccataaactcctttaaaatggcatctaagagaagcgactttcagaaagaaaagaattctggggacattgttcctttcacagcacaaggtgaacaaaataagacagaaggccttctgtctcctgttcagtaaatttttctgggttaagattgttcttccaagtttgtcttcctggagtgcgtgagcctctgcagccaatgacaccacagtgtgtgttgtggggagttccagagtccctctccagttatcaggtcgatacatgtacctggtaatacaatgccaatccatggctaaaaatagcttccttttgttgcgatctcccagaacaaagggatcagacccacttcatctgtgtcccctgccctcccctcccggcagtcctaaggcaaacagtttgtcttttccctcaaatggatttttcatttaaaaatgggggagaatgaaacctgaatagcatggagacctgtgcactaacaaaaaattcttttgaaataataggtgctagaaatcacaatttcagcctcctgtgtcccccaagccagtttgggttgaaccagatgccaggacttaagtcaaatgtgtggggactcctctgtgggtcccttgggggaaactcaatgatttcttttcctttccttttcttttttttttttaagtgttcctcaaagatatacaagacgttactcctgataaaatcccgttagccatagttcaactttatattccttgatcagtcttgtgttttctcactgacttttgctacagtttatggctctagattaagtaccagaacacagagttttattttcctttgtctaagtctatcttcctttgcctggctcactaactggatatatgtacataggcgatgggcacagaatgtgggttgtattttgggtgagggtgggggtgggcaggtcggatcatgaagggacacagaatattaattagacagaaagtgctctctgtgccttatctgcataaagaaagataaagcccatgtaaataatatgtgtgtttcccataatgaatgtcccctttctctccatttctgcatagtattagaaattgcgtttttattatatgagacattggatgcatgccaacaagtttttcttttaacttgatattttgggctctgatctttgttagcactacaatggcatgtatctcgtacagtcagaggtcatttctatagctccttcccccttcccatcatttctggggaatgtttgttttcaaaacaaagaattgggttaaagctgaggtatcatatatcagaacatatttcaagacaaaattaagaacactcaaaccttcctttgaaaggtcagatagtatttattattattataaaaatgatctgtgatttatgaatttaacttctcataaaccttctttgtaacagaatatgcagtcagaggcttaacattacattgttttcttttgacaacgtatccacgagaccactgcagctgttcctgtactcacaatagcagattaattaacacaatcatatgctgttggctcttactcaatgagtgggtctgcagcgggatagataggtaaatcctttaaatgcggtggagataaagcatatactatggtagtttcataactagccagttttgcttctgactagccagccctatcaggaccaggttcacagaccacagacgccctgagcttgaatttcaaagtcagccacacctatcgccaacgccataatgcccaacatttgcaagacacaaatatgtaaaagccgaagacctctcggaaatcagcagctttggttaaaatagcagtcagtctgccgccagcattttgagtctgcagtatttttttaaagttcaatcattgctttccttaaatatctctcttgcaatattactcactttttttttttttttttttttttttttgcccatccctcagtgcacatagttctgggcagctgtcatgactttagtttttttaagtactaaaatatttttttttcttctgtaactgtgctaatgaaaacgtgtgtaatgaaaccttcctcccctgcccagtcaccagccatatttattggcaactttagctgacattttagggaacgtcaaacctttgttagagaaaatgtaaggctttgctttagaaacaggcatgcccatgcagagaacgaggtaacaaggcagtaggcttaatagaatttccttcagactttttttctaatgtccattacatatgcaacactaatttactttttgttgttttacttagcacagaaattgaaaatgtgacaagctttgctggattaaaaggctcatttcatagacacatagaccaagagaaagaagaaaaacaaatccataatttggaaccgtttagggcatccaggtagtagaaattcagtcttccccatcactcggggcatttgtcgtgggcctgagatttctctggaactgtctctgtcctttagaagtagataaaagtttggccatgtttggtcacagaagtcttgagtgctttggggaaaaaaatcgtatcatgatgttgaggtctctcacgttccacttaggggctgttcctcagcaccaggtcctggataagaggttcctgcgggggccagaaaattctagctagtgagcatcagggagatacggtgtgtaaagcatctctgttatgggttgagctcaagttttctagggtgctcctcatacgtggagtgtttgcaactcttccgagaagcacagagagcaatggctgcacagatacaaggcagcagggtggctactaaaataacaacaatagttaaaatattaatagcaacctgacctttcttctcaaccctgcccctgtttgcccatccctctcattcagctattttactaaaataataataaaacttccttaaaaaaaggttcagaacatgtgaataattagttatatgtagaaacattgcttagaaaaacctgaatacttgattctgagatcagaacagaattgacttggaaatctgcacagacagacaaggcagacagagacaaggtagggggaccgtaggcccctgggatgagaagttatgactggttcgttacagctaaggtcagtgtcccgacaagtggacactttgcactacgggaacagctattgccagaagcactgggctccttgcaaagttgcaggcgtcttgcttcgacttcactccgccattccttttacaacttgcattttgaaggcacctggtaaggctgggatgaatctgctgtctgaagggtgcgacaatggacttaaccagacttccaatgtgcaggcagtggcgatgcttctgacccagctcacgtggactttgggctcagtttctagtactgggtcagctctatgggtgccccatcctgtcatccctccttccttccatctaacctatggctcaagaacaggacccaaggacattgctccaaattaatgtccggggcctttttgagggtatttcagaacttaagaccctgtaatctcagcactttgggaggctaaggtgggcagatcacttaaggtcaggagttcaagaacagcctggccaacatggtgaaaacccatctctactaaaaatacaaaaatcagccgggggtggtggcgtgcacctataatcccagctgcttgggaggctgaggcaggagaattgcctgaacctgggaggtggaggttgcattgagccaagatcataccactacactccagcctgggcaacagagtgagactccgtctcaaaaaagaaaaaaaaaaaaaaaaaagccccctcagctgttctctatgaagcacatcagattggtctttgtgaatatttccaagattacacattatggccaaaagcctaactgtgagttaggctaagagtcagcagacccaggtcttggcttcactattgctgtggtattgggacaccaagtaaaccttgtaaacactacctttcacatagtacattacttaactggccttacccatttgtgatgcctcctcatagaaagatgtgagaatgcagtgagatgttggctataaggtataggctgagctgcgtgagaccctgcaagtgaagactccagtgccagagcaaaggacaggctaaggtccaggaagaaaaggaagtcttgtgtgcttgtggtgtctctgagcttgcagcagtatctggtactaagtcagcagttaataaatatttgttgaataaatgaatgaacagacaagtgtaggatccttatgctgttctaggaaaggaaaatggggaaggagacctggaaggaggctaagtcagcctctgaacaagcagaggcatgctggtgtttcgaacagagagaaagttgtctacagaatcatagaatcatctgatggagagatagcaggcaaatacaacctcttatacacatggagcgtaggcccacagggcagaagggatttgtccaaggttgcacatccaagacagaacttgggaccagtttaccaactcagtctcagcccagctgttctttatgggggtatctgaagaaaatccttttagccccaagtgtgcagtcaggctgggattcagtgtcaggcagtggttggggtcatggcaaagcaggaagggtgtgactcagagaagaaagacacaacgcagggaaagtcacagcaagagactccagtagaggccggggagggagtccagactttgtagcggatggtttcagtaatgggcagtggatcttatctttgtcagggtagtcaaaagcatcaggattcagttgcaatgataattttgtttcttgcttgtactgcaacagcctccataatgatgccagggtgtattcagtgcctggcacatagtaggtactttacagatatttgttggatgaatgtcttgaaggaatgtccactctccgggcgttcctggggaatctggtctccaggtgtaaggagggcttgagacttgggttgccttttccactgctcctggctctctgtccccataccctgtaccatgcaatgatcctgggccatcctggaagtagctcagtccctacaaactttctgttctgtctctggaataccctctgagttctcgacttgtcaaacttccacccatctcttaacactcagccggattgccagctcttccaggaagctttccttattgaatcagtctccacaagcagacattgtcacttctggggatgccatggtcctttgaaatgttgttttaaggctcttagtgtctcctgcctggggacaaaggagggcatatctaatgatccttctacttgtttgtcctgtcccatgccagagcactgagcagtgagctgagatttaatgagtatcagcagagggaactgcacaaagtaggtctgcagtgaaagtctgttaactgaaggaacaaatgtcttattgcattgctgtcggaattacatatggggaaaggcagcagaggcagttgggggaaggaaatgacattccggaggtaaagcagtagtagagatgggggggtttgggcagcacctgggccttctcaatgcactggatgctcaaggtctccagggatacaggtgagagtgatggtccggggttggcctcgagtagatgctttttatggtgagctagtcgagtaggtgctttttttaatgataagctaggtccacacagctacgaggggcgaggggcactgtgccactattctgtgtaacgtggtgctggcatggcatccttctgtaatagggcacaggtgacagtgtcctgcccccatgcacagcctcagctccagagaaaggggctgggagccctctgggggagcttggctcagcagtgtgatgctctttacaagagagatgattatgggccaaacagcaaggtgctcctccccctctactttgctctccttaaatgccagaggagcgtctgcaggtgctgacacacataccgagagacactggcggccacaatgcccatcggctgtgggtgtgcccctgggtgtgtgtatttaagggccccgtgagcggcttgagtcatcaatgatgctcttgaatggcaaattggtcagagttccacaatggtaatgatcactctgccggtgacctttctagtgcatttacattttatcacaacatgcacaagccacctataggcttcccattggctgggtcattcctcatgcacaataacccagcatgcagggacgcatccagtgtagatgagaaaggggtagcttctgacacatctcactctattgttgcatggtaatctttagcaccaaaggagacctttgagttaagcccatgttttcttcccttttatttttattttaaaaagtgaaggcactccaatgtgacatgcatccctcatgttaacagagccataaagatgaagcattggactcattgctgctcccacacatgtatggaactaaacccacctgagtggcccaaaaggagaaagcaagggggtgccccagggaagtccccggatcctgaattcttcggaactgttgtactttaagatattactttccaaaaagagatcaccttcatgtgtgtgtgaaagactgtgtgagtgtgtttgggtgtgggaacatgagtgtgtgaacgtggggtgtgtgtgtgtgtacattctcacgcttgtcatgcagaaattcagcctgtaagacccaagcaggaccagattccagagacaccctcagaagcctcacttcctgaagtttcagccctgtccccatcagccatatgtaatcaattagccatgtacctccatttgctcatttactcatgaattttgcatcactggagaaatcgcagtcctcttcagcttatagaaaattattaagacagtgtggtgattcctcaaagatctagaaccagaaataccatttgacccagcaatccctttactgggtatatacccaaaggaatataaatcattctatcataaagatacatgtatgtgtatgttcattgcattactattcacaatagcaaagacatggaatcaacacaaatgaccgttaatgatagactgtataaagaaaatgtggcacatatacagcatggaatactatgcagccataaaaaggaaggagattatgttctttgcagggacatggatggagctggaagccattatcctcagcaaactaatgcaggaacagaaaaccaaacaccgcatgttctcacttataagtgggagctgaacagtgagaacacatggacacagggaggggaacaacacacactggggcctgtcagggagtggggtggggggacggagagcattaggaaaaatagctaatgaatactgggcttaatacctaggtgatgggttaacaggtgcagcaaaccaccatggcacatgtttgcctatgtaacaaacctgcacatcctgcacatgtacccccagaattaaaaattaaaaataaaaaaaagtttcaaataaaagtcatagaaacgtcaaaaaatagaaaaaatataactgctgaagacagagaggaatgcattaaataagaggcggagtggctgtcacatccagggctctgggactctcacttggtccttgttgtctgggtgaggtgactgcgtggggacccatttcacagtgggggacaggagctcagggcttttgggtcagtcactcctaggtctgaggctgcagtcctccgggcactctaccgggggcgcaagtaggcagcgagcatgcagcgaggagccgaggagccgttccagcccgtgcgatcctgttcagctgaatcgtcactgctgtttccatttgagcctttaggtgacagtgccaagaataaaaataagcccggctattttcactcttatttggtacttctttttcttctttttttttttttcaaatgccattgaaatagaattctaatttttacttaaaatatgtcatcttaataaattgctacattattgcaagttgcttgatatatttaaagaccacctctttttccagaagagctcatttccaataatataatcacaatcaatagaaaaacattatgtttctatatacagtatctgctcttttttgagggcctatctgttcagataaaagaagtatttatctatttatgtatgtatctatctttgcatctatgtatctatgtgtgtaagtatgaatgtacatatgtatctatgtatgtatctatgtatctgtgtttgtatgaatgtatgtatatgtctatgtatgtatgtatgtatctatctgtgtttgtgtgaacgtatgtcggtatgtatcttctgtgtttgtatctatgtatctgtgtatgtaggtatctatatgtatatctacctatgtatctgtctatgtatccatatagctatctatatttatatgtatatgtgtgtggactcctaggatgtcataattttaaaataatatgactttatattttatcttcaaacatccaaattgtagactttgcatcaaacgtatttacacatgaagtgtcttaatacgtttcaaaataagtttcgtgtgattaccttcttttcctacagcagttgtctggacttctccagacatctgtcctctgttgttagcactccttaacctcaaggccaggaggagaaaggtcttggtgactcatattcctcttagccttggttaactcttatccagcaagggcttggtggaagtccatgttctggtggctgcatgggtcaggggcaagggagggatggtggcagatgaggacgaaatgaagtgttcctccccttggagatgtgtgcaagtctaagtgtgtggccccaccccactcccccacctaccagggacttttaggatccaaagccaagatagcattccctccagaagtactcccaagctcacctttatgccagctctttttaccaaagagggtaattttttctaaataatttcttagattattttaaatcgttcttctgggaacaggtgttttcttgggatgggcttgagttccaactgacatagaaggttcaggagaagctgcttctaatcccagggtaccccagattctagaatttcaccaagatgcagtggatggacttgggtctcacaatcccagtctcactcctggttctagaatctcagcaggatgccatgggatgaatgtgggtctcacaaccctgggctcactcctgtgtctagaatctcagcaagatgcaatggatggatttgagttgcataacttcaggctcactcctggttctagaatctcagcaggatgcagtgggatgggtgtgggtctcacaaccccgggctcattcctgggtctagaatctcagcaagatgcagtggatggacttgagttgcataaccccaggctcactcctggttctagactctcagcagcatgctgtgggatgaatgtgggtctcacacaaccccaggcttgctcctggttctagactctcagcagcatgctgtgggatgaatgtgggtctcacacaaccccaggcttgctcctggttctagaatctcagcaggaggctgtgggatgaatgtgggtctcacaaccccaggcttgctcctggttctagaatctcagcaggatgatgtgggatggacatgagtcttgcaagccaaggcttctcttggtctttaaatctcagtgaaatacagtgggattggtgtcagaggcaagggccacgagttcttatcccagcagtgctacctcctggctttctcattcagacccatgctttcttcgtcagtacaataggagtgtaccaagctctcttccaggctccctgtcagctcagagctttgttgaggctccttctggtgctgtttgggcattgttcaggattggagcgagaaggtttgacctgtcatgtagagtttcagctttcttaccctgggtacagagtctcaaacctacaaagtgggtatcaggggctgattactttatgaaaaggctcccatctacccccacaccctactaatgggattaaccattgaatactaaataagaaggaccaccactgcccatatttactaaaagctcaatatcatcatgctaagttctgttcttgtcttgtctcatgccctccatgagaacatccctcagtttcaagcatgacttctcattcctggttcatggaaaaggaagccaaggtttggagaagttaaaacttcaggtcacttgcttgcagtggtggatactggattcaacccagcattgtctgacatcatagctcatgctctgaaccactacacaagctgtacagaatggaaaatgttggctgttaagtccctatgtgttgggaacctggtttcctagcttttctggcatggtgggttgcatttcacttgtttttatgctggtctcccagcataaatttgacctcctttcatgggcctagaccctgtttccttcattggctgagcagtcaggagctcatctggtgaaagtaaagtgttcgcagatcttgcttcataaagaccagtccatactgagactcacacacctctgaaatgttcacgtaggtcagtggggaaatagaatttggattgcaataattatttatcttgcacagagctcatgaggaccacacaatggcagggcatgaggcacatcctatttgatctcaggtccttaacccattcatgcctgaggttgcaattttttgaatttttgcaatcagaccttggcgatgaccttgagcagtaggatacaaataactcccacatgcttagcattccaataatggaacactaggcataaatgggctaagggaggtagctcaagtgctgggatccccagggatatagctccaggggagacactttgggatactgagtattctggcagggaaacaaggtgagggaaagcaaattctaaaagggttgaatttactcagtaagtaatgtagactatgatatttcagcccatggacgaagttgacatacccatatctttgcctgaacgacccatctggtcaaatgccagggaaggaacatcagtcctaggtgttatgtctactccagggagaacagagcctctttacatgggcacttacagattaaatgggaatggaactgcatgttgaattgcctgtcttgagtctattagacctagcttttctggactacattgtaacatgcatctgcaaactctggaacaagggtagggctggctggcagtgtgggtgggaatggttttttttagctagctagcaccaggggcagtggagtagatatttttaaacttggggtgggattgaggtgaccaggggaagaggccctggaaatggtgagtgatcggaaagatcgaactgtgtatgtccaggacaagtccactgaggggagagagagggcagctgtggctggagactctggggagcagccagggggctaatgggagggcgttaccctaagtaggggacttatcatcgtctcatcaacctggacatttaagcaaagtagccatcagggacccacatcttctcaagatattttattttcttaagaaaaaggacaaaagtcctgagatgcctctattgcccctccagcaaactaaaagagcataagctgtccgcagagttctgtgttgaagggtgtcacacagcaagggagtaggggacaccagtgagatgtccctgagccacgggaaagagcttggggacactgctgccccctgtcccatttaaagttggatttctacctcactcttgaggccaaaataaaccccagatgtggcaaggagttaaatgcaaaacacaaaataaacagaaacacagggagacctaaaagaaaatagaagtatttttataattatggggaagggataccctctccaaccataacatctgagccagaaattctaagagtaaaggttgacaggttttacctttattcattttacttcttcatttaacacagtactggcaaattatgctactcaataaatatttgttgaatgaatttgactgcataaaaattaaatatttctaagcagcatgtgtgtatgcacacacacacacacacacacacactcccaaacctaaccataacatgcaaaatacagtatgacaacaaatgtttgctaaatacatgatagatgaagggttaatattcctggtgcaaagaaaaacaaagcctttacaaatcaataagaaaaagacaaatcctccaatagaaaaatggtcaaaggacatgagcaggcgattcagagaagaagaaatacaaatggtcaataatcaaagaacagtaatggaaatctttgcagccattaaatgtgtgagactgacctgtatttactgacttggaaaaatgcccatgacatattgttgaatgaaagaagtgggctacaaaacagcaggtagagtatgatttcatttacggaaaattatgtgagagtatcttagtctacatcttttgtgcaaaaatagaaacattctcaaagttgcttaagcaaaaaagagaatttgaggaagataagagtgcctcatcatccccttgcaaagtcagcagacatgtggcatcacccttgggtgggctggggtcaagccctcgtgggagtccctgggcagccaggcagccatttctccatcccctatctccctggcgccagagcatctcaaaactctttgcctccctctatttttctgattcctttttcccctctttgcaggccacctgggtagtgggattttgggtaatttttattcatttagaaatatatttctgtatggtttggggtttgtctttctttctttctttcttctctctctttttttttaatgaacgcgttatttttaaatttggaaaaagtctatatttttatttttaaagataaaagaaactccagttgggaagtgtaactgataaggagttaatatccttagcatagagaattttaacaaatcaataaagaaaataataccacaagcaaaaggaaaaatatggccacttaggagctcttatttagtgagtgtttactaagtgtggagaactacaaaactttgtacacacattctctcttcaacagctttaagaggtagatactattcttccctcccttccttcccttcttctttcccttccttccttccttcttgcctgcctgcctttcctccctccctccctctatccctccctccctccttccttccttcctccctcccaccagcctccttccctattttccttccttccttcctacttccttctcccattccctctctcctttcctctcctccttcctctctccctccttctctcctccctctttccttccttccttccttccttcctcccttcctttctcccttcctccctcccatcctctctcccttcctccctcccaccttccctcccttcctccctcctcctgcccccctctgacccactcatcctcccacccttcctccttccctctctcccacccttcctccttccctctctccaactcttcctctctcccacccttcctccctcccaccctctctctggccctctcactctcctgccctgtctcccttctttccattcttcctcccatgagtacccacccactgagcatctgcttcttgtcaggtatgttctgggctcctcggattcaggctgctgccctcatggggtttgcatgcctactctccccattttacagcaaggaagcctgagacctaaagaagctgtgacctggggcgccatttccgatgaggatgttatatgatccgcaaaataagaacacacagtttccagagaaagaaaaacaaatggcccatatgcagatgaaaatattttaacctgactagtaatcaaagaaaaaattcaaaagttgttttggtttactgatagattgatttgctcctccaacccaacaacttatgagattgataacaatgagtattgtatataaggttgggagaaaccagacactcttagtccgcccagtagctgtttatatttatacaaagttgaagagtaatttgggaaacatgtcaaaagccccccaaataagtgtctgcccattgtttcagcaattccctttttatgaaattattctctctatatattatattattatgagatatgttaatatttaatatatttattaatatataatacattacatattatatactaataaatattctataaatatatgttataaattttaatgaatattattataatatatattttatgataataaatatatattataatgatatatgaatgtatactatatatatggtataagatatattaagatatgaaatatcttatatagttatattatctcataccttatataataagatgtatcatcaataatctatattattaatctatatataatatatctaatgtatattagatagccaaagatgtttgaccaaggatattcactgagactcagtttataaagaaaacatttggaaacaatttaaatgtacttcagaaaagaatctgttgaggaaactatgactcctttactgtggaagtctgtagtttttgaaaacgatagcataagtctgtatgtttttgacatagagtcttactttgtcactcatgctggagtgcagtggcatgatctcggctcactgcaacctctgcctccctggttcaagtgattctcctgcctcagcctcccgactagctgggattacagacatgcgccaacgcacccggctaatttttgtatttttagtagagatggggttttgccacgttggtcaggctggtctcaaacccttgacctgaggtgatctgccctcctcaacctcccaaagtgctgggagtacaggtgtgagccaccatgctcagccaagattcccaatttttaatctcttcatctgttgattttttttagaaaattttctttaattttgttactttatctttataaataatataaatattatttatataatgaaatacaaatattcctatttacagcagcaggtagagtatgatttcatttatggaaaatgaatatggaattatggaatataaatattcctatttatatttcatgatgtattttccttgtttgtttcataagcagacaggaaacctggcataaaagctctggagggcattgcccttcccctcctgatgagattgggtggttgatgacttttctctatgtccctaaagttgcccctctagtttctttcagaggatgttcatctcctttgacaatgattcttgaagaaacaaacaaacaacaaaatctaagctagttgactaggagaagccacaggcaagaagtccttcttggtgtggtagtaacaagcccatctccactcagctgcgctgtttgaatgatgctgttccccagtttcatatttcttttaggtcccttaacagagacttctagggccccctttgtgctgaggcgaggggaggttctgccctggggaaagacctgcctgggaatgcccccacactgtggacattggcagatcttgcacaaagcgggcaggttgtgggggtgtggggtgcatgtgcgctggacccataaaccatcctgcagaggagaaacctttctttccaaggacggtctgccgagctgattgggcctcgagtaatccacaactaggttttattttgatccctttccccacaacaaaaatagcttccttgtttgggcttggtttaacctgattataaaactaatgtgtgatcattgcagaagggtataagccaaagatccatgtaaggaaggaaaatatcagtcttaactcttttgccctgagataatcattcttaacattttgctttatatcccttcaggcttttctatgaaaaaactacttatctaaatatcttttcattttcacaaaaagggggatcgtagtatacaaattggtcttgtgatctgcttttgccacttaataccctgttagtgaatattttgcatgtcaaaaatacagacctggctgggcgtggtggctcacgcctataatcccagcacttcaggaggtggaggcgggtggatcacctgatgtcaggagtttgagaccagcctggccaatatggcaaaaccccgtctctactaaaaatacaaaaattctctggttgtggtgatgcatgcctgtaatcccagttacttgggaggctgaggcctgaacccggatggcagaggttgcagtgagccgagatcccaccactgcactccagcctgggtgacagagcgagactccatctcaaaaaaaaaccaaaaaacaaaaaacaaaaaactgggaaacttgagctagaagtttatgtagagaaagttgagaaaaataagattaaaaagaatgcactttaaaataaactgttagggatagtaagacaatgaaatacaataaacctttttaaaagcaaacaaaaaagcaacttaaaatagggagagacagaaacttagagtttgaaaaagattaaaacttgacagtgttctagttttaaggtgtaaagaatagagaaaaagggttccaaaaacatatctaaaaggtatttaaaaagggaaatgaaacattataaaagaaggttaagagattactagaagataaggcaagtcaaaggagaaacaatcaagacaccttaagttggaggaagctaaaattataccaaatataagtatctaaagccaaaatattatgactattttaacccagtaggcacaaataagagacaatcaggcaggttgttcaagtgtttcatgcgcatacgtgatgaacccagaattgcccatgcttttttctttctcaggtattatcacatttagttatctgagtaattatttgattaatggctttcttccccacgagacttcaagatctgtgagggcaggatccttgcctgtttaacttaggagtgatgaatggtaaatatatgttcattaaatggaagaatgagtgaggcctctcccagaactcgttttccatggaacagggcctgtggcactgtgccccagcagtctggaaagggaattgctcagcaaaggggatggggctgtcggctccccctgcctcaccaaccactagagccttttaccattcaccgattgcccatggaagctgaattatgaccccaggcttgcaggggcttatgggaaaaagggctatgagaggtagaaagccaccatctaggcatggggacacccttgggctgccattgcagacccctgcctgagtggctttggaagacattctggaagggaaacaagggctatggctgtagaggatggggaggacctttcttctggtcactctccttcattcttcagtcccactgcctggggtatgactgggaccaggtcagaaaaggaccccattctgctgaaaaggaaactgagctgccacatggtgaatgacagatgtgaggcaggtttgatttaatgatccgggccatgagactgtgagtctttgcggcccacagagaaggctggaaggcagcagaggggggccaggtggagcagggagccctggtttaatttctaagaggcctacaacagagcacctaggtgccctagaaaatgcgttcactgacagcagtgagggtaccttcaaaattcaagtcctatctgccctacctcaccacaccaaccaggaaattaaacaaccatggtgcccttccttagtgactacatttgtgggtgtgggcaccgtggttcttttctcttttctttctttctttctttttttttttttttttttttttttgcgtcagggtcttgctctgtcacccaggctggagtacagtggcatgatcatggctcactgcagccttgacctcctgggctcaagcaatcctcccaccttaacctcccaagtatctgggagcacagttgtgtgccaggcaacacaggtgactaatttttaaaaaatttcttgttgagatggggtctcattgtgttgcccatgctggtctggggctcccgggcttgagtgatcatcctgccttgacttcccaaaatgctgggattacaggcatgagccaccatgcctggcctcaactgtgattttaaatggtgggattgagattttttccaaaagtaactgaaccaagaaggccagagggacaaaacttgcaaatcgagttatataatgtatacaatatgtataatatatataatatgtaatgtatatattatgtataatatacaatatgtaacatatattatacatacatatataactacgtatgtataagatatgattataattacatatgtattacacatacatatatgatatatattatatcttatacatacataattatatgtataacatattataatatataatgtatgcatagtatataatttatatataatatctgtataatttatgtataatatatagctatataatatatattatttgtgcataatttatatatagtaacatatatttatatataattttactgtgtatatttaaggcacacaacatgacattatgggacatatatagatagtaaaaaggttactgtagtgaagcaaattattatatccatcatctcaaatagttatcctttttttgtggcaagagcagctaaaatctaaaatctaaaattcatttagcatgaatcccacaatcagtacacttttcttacctacagttctcatgttgcacatttgacttctagacttgttcaccctacatatctgatccgaagtacaatggctattaactacttcatcaggggaagaagcagaagttggtggaaactgttgaatcgtgaatttctttcttcgttttatagctggtgaaattccatgttcctgtggtgggtagtgcatggcaggagccgagatcttgttttatcaagatgagtgggcctcacaaacaaatgatttcattctgttgaaaggcattatcactgcatctgacatgaaaatattgtggggggaaattagaagtggaagtttataaaatggaagtgtccgggggcagcctgcattcatatcaccgaaacttcagcatagctttttttttaaagatagaaattttgcccacatatacactaataaaaataaatctgtttccgattactaactatgcagccaggtgcttgtttgttatgagaaaggcatgttcattaattttcagctatgaaaagtgcactgtgccataaatatacaattcaaaatgtactgctgataaatgaatacgcagattgttaatgtgccagagaggggtattaggcatccagcacaaggcagacaggtacccaggtgatggggctggcactttcagacctggcgttccagcaaccacctagccagcctctgacagtctgtgctcctgtctttgggaggagtttgcacagcccctctttgggaggcttcaacttgccctgttttctctttattgtggcagattgggcagtgatagctttagggaggaaggcaggtggcaatgagttgcccgcagaggcattctacagagacgcggggatcgctgcttccctccttcatgatgggtcagtgctcctcgatgtagagtgttggccattgacctctcctctatggttgcaaggaagcagacatcagagcttcctggaaagctagaagtaggtggctctcagcccagatgcatcctcacctctctccaaggagaaggatatgttcccactgtagttatcctcatcgccttggactgggagacatgtcctgccttccctctttgaatgccgtcacatcagaagagtgacatcttcttgtccccgacctgagatgctgatcagcattgtagctttgcatccttggcaggacctgtgtctgctgccatgagtctgttgcccgggtcaggcgtagagtggggatggatatcatatctcccatttggcctcctcagaggctgagccctggctggagaacaaaggaaataacactctgaagtgtgggtggagtacaaggatgaccatcaccacttgagatcgtttcaagcatcttcagttttcagagcctgaatggaggggagccgtgggtaagatgggctgctcctggcagagcatccggaaggtgatgtggcttggcgaggctttttccttccttcccccaccagacaccttgcccagctctcagctcctgctcaagaactcttttctctggttcatctctcgcagcttggggctcctgactccttcccttgtctgatagaatgtcacagacccccaatatattttgtttacattaaaagctaatgcagctatgacgtgaaattttaatttatacacaaaccataaaaaagccttcaggttcatgaattcctgatgaggcagagactaacagtatattttgatatgtttacagtttatgttttccactaagaatatctagtttgtgggtctgtctggggtgctagtaaaagaggggaaggaatggaacgaattcaagcagttgtctcagccttcattgtgtctgcggccatggcagggtttgaaagcattttcgggtatgagctgaaatttgttgtactgcttggtggtaaacagacacgtaactcacccccacagcagacattaaagtgttacaaattaacatacacatgtaaaattttaaatataattaatttagcagataggaccttgcagttgtcacattattatttaagtcggatgcttggggtggctcagagcttacatgggtggggtaaaatgcaaggagaccgtatgcacgttaatgacaagttaacttgtgtctagttgagacaatcacgaagaattaaacaaagcttttagagggtttctggtgctatttatccttcccctccctaattttcataacatagatttataaaggaaattagaaatgaggcagagtccataaagggtccttggaggataatccatacatttacattaagtataattcgatgtatcatctacgtgcaaacttttgtctgcaaagcatatggcaaagcttttatggatatacagacttttattttaaacttaaaatgatgaaaagtttctgagcttcaggatcctcttactggtgactggagaaattgttgatcacatttttaaaattcagagaattagaaccataaaatatactgcaaaacacagaatttaaaatggttgtttttccaatgcctgcaaaattgttttattaggggactgcggaacacctgccttaaaatgtcgttcagaacatctcccgaatgtcgttttccttaattgacttggaaatggcccaaatgtattgctgaatgcagtctaattaatattaataataaatgccattattaacatcaaagaacatctggtgctcctgtttactctgaagccttatatgtaacacattttgtggctgtttcatcttgcaaacattgtgcagtaaacagtttttgccatgcaggtcaaaacagacccctgtccaagcataatgcattatatttaaaaaaaatcaaatattttctttgggtcacattcgttgctgtgatacgagtgtgggttagaggtcccttgagtaaaccattttgaaaaaaaaaaaaagtgctgctcccagcatctgtacattggctacattagagttttgtacaataaatcaaccactgaataactttaatctaaaatttcattaagtagttcttgtcaggtagtaaagctggataatgcagtgctgtttaatgataattggtgtttggttaataaattctgcaagttcgaattactttctagcaatctatagaatgcaagcctcagcagtgtaactaaacctcaaattgattaacttgcatgaaccaggcgttcacaaagatggcactattccaaataaaaaagagaacagcgcatcagccggatggtgttatgttgctctggagtaaggaaataaatcccctctgggtgcatttttaaaagcttatgcctttgaaatgatgtcatcatattttatttttttttcttttctttcatattttctttatatgtacacacacttaggtcaccagttcacaagacacgtgacacattagaataatggaaagcattttttttatatcatagaatcaaaaccacaaaacaatttagctggaaagtattattgaaagggcgccattaccagcaagctgctgctctctagcaattaatggaagcagggtgtggctagatgagggtttgctgtttccttcctacatcttgtgtgcgcaagaaaataaaatataagagccatttgcaagtgaaatcagcgcctaggttcttggagttgcgcttaggagtcctacatcccaggtgcaacgaccctgcaggacagcaggcacctttttctggtgggatttgtatttgggatggacatattggattaagtgcatgaattatgttgatcttctctgtgcccccaaccccggtgactcctgtgacattggtgtcattcaatcagcagtctgtaatagttccaagttaaaaataacatttattaaatgtcttgtaacacaagaatctggtctatgatgaagagaggaaaacaaggcatctaatatcagaagaaatgaaccaggctacaacagggacagacagggaggtgtgtctaccaggtcctccactctagactagagttgaagggtggatggaggatttaccccaaatgtgggactccagaaacacagctcccggtggtcacaaccaacttgttttggaggtggagcaaggtcctggtgggaagattggtggaagaccaggtgcttgggatgtgtgaatgctagaacattctccaccaagctgtttctttctcccctgcagatggggggattttgaaggattctgagaccctcaaactcagggctgagcagtttatcagcatctgtgtgcactgactggtgaggggcacgttgggtgctgtgtgggacacacgagagcccattggctttctgtgtgggggagcaatgcaccagctcagtgagacctggcgagccaggtcctgtttctacctgcctcagagtggtccttgacccgtggcaggctttgctttgcttttgaagctgagcagattgtgccaaatggcgtatgttttcaaagtgattcccctaaggagaggagcacagacctcagacacaccccttctactagcctccatagattattcaattgaagcagtttgtccacatccaactgggtggttagggagaggttattcaatttactcccaccctcaaaaaaatcaaaaagtctgttttcaccctgagcctccccttaatctcgttgatgtggcaggggtggcatgctgggtttcgcatgctctctttctgattggttttctggtaattattttacaatggtggtgtctggaagccagaacccctgggtcctgcaggggggtcaaagagactcacagggagatgagaaatggtgtgactgtgttggagcaaagaaagatgaccaagtagaagagtgaccagtagacgggaagacccagtgtcccaacctgcaggaggaccttacctctcttttccaggactttatgcagctcttctggtggcttttcttggggcatcaagaccagcttcttctgcttgattccagagggcaccacccctaccccaccatacctgcccctccaggctgtgcttccatgctgcatgcacaaagcacctgtcttggcctccacatccagaaactcttctcatcccttcatctccatattgtacttgcaacgtgaggacccctcattgttgactccggctctgggtagcttgcagagctcagtatcaggaatccagtgaccttgactccagtctgctctgtccttactagctgtgtgagcctggatttgtaattcaacctctgtaagcctcagttttctcatctgtacattggagataataaaactctgtggcccagcgtggtggctcacacctgtaatcccagcactttgggaggccgagatgggaggatcatttgatgagcccaggcgtttgagaccagcacgggcaacatggcaagaccccatctctacaaaaaacaccagaaaaaactaaaaattagttgggtgtggtgactcacacctgtagtccctgctacttgggagcctgagatgggaggatcacttgagcccaggagttcaaggttagagtgagttatgatcgtaccactgcactccagcctgggcaccagagtgagaccctgtctcaaaaaataacccaaaatataacaacaacttctgccccaaagggctgttgtgaggatggatttagacaatgctttgaaagcacatagaatgtgctcgattaatgttaactgctattgaagtagttatcgtttatgataagagttcagattttattattattatcaccattacttttagtatatttattttgctctccctggtgcatgtgaagcgccttcaggataaaaacctgaatcatcctcatgggaagtgtcccgtgctgttaggacagagtaggatctcagacagcgctctatgatcacagcagcaggaaggcacctcaggaagccattggtaaaacacaggggctttctcggtcttataccttagccagaaatccacagtggacaatatagaagcagatacaaaattgttcctggccttcctcttcttaatggaatctcccagaagtaaaataagaatgcccattgctctaggccaggcgtggtggctcacccctataatctataatcccagaactttgggaggccaaggtgcacagatcacccgaggtcaggagttcgagaccagcctggccaacatggtgaaaccctatctctactaaaaaatgcaaaaattagcagggcgtggtgggaggtgcctgtattcccagctactcgtggggctgaggcaggagaatcgtttgaacccaggaggcggaggttgtagtgagccgagttcatgccactgcactccagcctgggtgacagagtgagactccatctcaaaaaaaaaaaaaaaagaaaaaaaagcaataaagaaagaaaagaaaaaagaatgcccagtgctcagttgagaatcctacataggcccagagatttatccacagagagacaagggcagaagggaaaattgggtggacatgtttgctgtggtctaattgctctaagatgaatgaggaccatagagagaactaggtacctcaccacaagatgcaaacatcagccaggaaggacccaggtgcctcctttgccgtcctccgtcctcctgggcagcttctccctgcacggaccagccggcctggtgtgtgtctccacggcactgaacctgtgcagggcaggctctccatgaatatttgctggctgaatgaatgaactcaggggcaacaggaaaaggacaacgttcaagccaacactagggacataaacttaagtgagacaatgaggccagaaagtctaaagtgttttctgtcacttggtcagatctttctttctccttgaagaagccctatgaagaaagccctggaggagatgataatggcgcctttcaccacggaaaggtcaacccacatgtgttcattgagtgactctgtgggccagcccttcgctcggctctgttgatgattacgagacaggcaaacccacggggtactcttggtaagtaggctggaatcaaaacacatgagaaaaattagtgagcattccaaagcagcatgtcattgtatagaaatgttcagaaaaggtttagagacggagtgtgccgggaggccaggcgaggcttcgtggcggcagtggaagtgcgaggcttcgtggcgaggcttcgtgaagtggtgatgagaaacgcttgaaaggcagggaggagaaggtcgggccttctaaacttggagaagataggggaaggccaggtgtggtgacagatcccaaggccagtgcagcagtgaagaaatgtgtcactgtccccttggctcaggcccagccaccgagtcctgggacgtgatctttacatcgcctggttctctggttgatccatctttccctctgatcactgcccttcctcctggggcctttttgaaatctgactcaggttctgagcacacgtttcagcatttctggatgcaatttggtatcatagcgaagaatcaaagggtatttgctatcacttgaaagtctgtttctctccctcttcctctgagtacctgaccccacaatcatcactggctttgaaataacagacccatcataattacgagaattagtctggaggcttctgccttatttgcctaactgagattattaaggccgtttttagaggtggaaagggctcccaggatcatctcggctgagatggcaaattcagagagatgcctgcagggtgggggccagccaggtagtgagggtggggaaggggcccggtggggaggacgcatccactgcccagcccatcaacccttgctctttgggcccatgggctcagcattgggagataacacagtttctcaggagaagctggaaatgctgaccatgtgtgagtgaaatgtcccaaatttgtatatgttaaaaacaaacttatagcctgcgtgacatagtgaaatcctgtctctacaaaaaatttacaaaattagctgggtgtggcggtgcatacgccccagctacttgggaggctgacacgggaggattgttggagcccaggaggtcgaggctgcagtgagccatgatcacaccactgcattccagcctgggcaacagagcaagatcctgtctcaaaaaaataataaatacatacatacatacaaacaaaaaaacaaatttaacacatgaaaaccctgtgtgattaaacctttgcatctcaattagagtcctctgcccccattccatgatttgggggtgcaaacagaagccccgaaataggaaaggacttgggcgaggtcattaacgtggtgggcacagcgtgtacctaccccctcctttgccaggtccgcagagttatctacagaggtcagtctagcaccctcccattagcctgctgcttgaactgtctccttctttccagaaacttctgcatgccagtgaccagatcagcctctctgtggctttgaacccagggtgcagaagcctgatccagtcaatgctccaagcacggtccagccatcacctcgcagctggccctgtcacctcctgttgcaggcgaaggggcagcagcaacctggcagccctgggcagctggcaggaagggccaagcacttacgaagggtagcttcagtgttcttacagggtattaaaggaatacagcgagagttaatgcaaaactccttctttgacttaatttattataatatatgtggctaaaatgtagatcacactgctgtgttggatctccgttttgattcccaaaattgcaatcatgatagtggattataaccgtgctctaacacatagatgaggaaatgtattcctgtgcaattttccccgaaggagaagtcagaggataaggggcaggagttttgaataaccttgcaacatttagttgtctctctcaattataggatagaaattagcatcccaggatgatgtgcgtgtgtacgcagcaccgctttgaatattagtgcagaaggacatctgagggaatggagaaaatgattttccatatgaaagaaaaagtcactggtatcgaatcgagcaatgtgatgttgccttttattcagtaagtgcctactatgtgctgggcacctagctaaaggttgggggtgccaccgtaaaccagacagaccacaggtttgccatggaagtgagccttagcagtcagtgttgggtgatgcccaaaaaggagtgaaccagggcagagggatgggggtgcagggatgggggagctatgggagagcctggattgcaggctgagggaaagaaacatcccgggagcagcacgcagatgggaaagccaagtttgcttccttgttctggtggtgcgtgcagagcatccgtgtggcgggatgcccccaagaacatacatctgggcggactttctcctcaggcccagagactcagcagaagtacccaggcagaacgaacggcctgaggtgctgccccagggcctggactctgcagtctccaccagcaacggttcaaggccaacacctgcgcagcctatcgcgtcccaaggttctgttggcccaaatcaagccacctgcctcccccagcccagctctggggtggggctcccaagagccaccagccttgctgcaaaataggattgaatttctgtgtggatgtcgagccctggctggggcaggtgtggacagggaagggccctgtggcaggagggactggaagctttgcacagcaccttggggcaggtgaggctgggaagaccaagctgacttctccttgccctccacggggttgtgctctggcagtgggagccctgcactctctcaaggagagcctggaggagctgcagtctgcagctgcaagaggagggggctggactgatggaccacaagggaatggagccctgggataccagacaccagattccccacgtccagctttccttcctggagagagcctgtggcagcctgtccactcacagacacaggccacctggacccactgccaggccccacaccctggaagggcaggtcagaggtggctagttatgtacttaaaaggaaaaggcagacttcttagattgcatgatcatggaagggtggccagccctccccaacaccattcattcattcattcattcattcggctggtcaccagtatttattgaacacactgtgccaggaggctctaagggacacaagagtgagaaaaacagaccccatcccagccttcaaagaggtggcagtttggtggcagagacagatattaatcacacatatacgctcagtgcaaactctgagaaatgtcctgaaggttaaattctgggatgattgggcagacctgacttagtctggaagatgagagcaaatgacattggagctgaaccctcaaacatgagtgggattaaccaggcaagatgcaggtggtgggcctggggctggtgtttggggtttgcatttcaggaagagggaacagtatgtgttgagattctgaggtccaacagagagagaaatttctggcccggtgggccagtagggccagctctgggatttttaaggcatttcaggatgagaggaaacatttcttagatctcattgcagtcccaagttcctgaagctcttaaattctttttcaatatcagggcatgtgttctcggggtaggggatgagccagccagggggcttcccgggtgcaagcccccagcgtgtaggactgaagggccctgggacctgtgtagttgtggatgaatggggagctctttggagatgttgagagaccaatgggatgctgaggcctgagcttctacctgctgtctgcttctttctccctgtcatcccagtgcccacatccccccaggtcctcatacccccaactccttcacctactcccctcaaaggggtgtttggaggataataccaagtaagctctaatttctgggttagacaatgtgggagagagtgaagatgtgttatgtctacatggagttcctactcagggctcggtggtgcttggcattaggaaaccttgttgatcatgcagggggaggggctgaccattttggaggatcctatggtgactccatgacatggatcaccacctgctggtttgctgttttatgctggtttacctttttcatactttagaccttgtagatggtggggttgggaggctaccaattgggactctgctggatgaccttttgtccacagtaggaggccttattcccatgtcataggcagtgtttggaggctgggcgaaggtaggaggcatttacaaacacacagctcggaagtggcctcaccagacggagcccagagccggccattgcctggtcagtggcttccccactctgccacgcagggtttaaagtgcatgcagctttgcaagcccattgcctcatgaagcactcagaccctctgtgactggcaccattctccagtgatccaactttaccaacaaggaaatgaaggctcatgaagctttggcgctttgctcaggaccacagagccagtgctagcagagtttagattcagacttggctcccggagtcccttggtgttttgaggtgctcgaatgcccaggcaagcctgttcaggcagcattaaaagtggcccgtgtgtctccctgtgttgaggaggattgggccatctctgtgcatgtctgggggctgtggggacactttgctcagctacctgctgctccccttccctgaaaagcaagggctgctattcttgcctgcttcttctggggggcttgttggaggacacactcatcttgggatccttgtctctggtctgaatttctttggaccagtctatgggattcccagactttgggaagttcccattgagaatttgccagacttgttattttcatctgtgatcacaagaaaaacaagcaaacttgaccttcctcctggaagctgctacccaggaggctagtcctggagctaggtcagttcatttattaaagcattcatttattcaccccatttggggtgaatattggctggacaccggccacgtgcaaagtatggaggaggaggaacctcagcccttgtcctttgcactttacaggctagaaggaaagctggtgtcaaagaagaacaaaattcaagccctgtatctagccagagaagccagctgggggccacttgggatgggaccaggtgctaaccgcggtgataactgggagtgacgtggcctgacttataatcaagaaaggtcacccatgtggatatatcagaagaaaacaaagttgcctctcaggaactaccaggaataaatttacactcctctcagtctctacaaggggaaacacagtgaaaacttagctaaaagtgtcacagttgtattgtgtaaactacactgcccttcaagcagcatgggacatcacactgccagggacacgaacactggaccgggagggccattcgcagggcaccacccagggcttctgttggtctgcaggtaccaagacaatggacagtggagtggcctcagctgtctccttggctcctctgctctgtggcctgagccagacctgaaggttttgtcctttggaagtccaccagctgggaacaggtctccagaaagatccatgtgcctgtgcctgattggcagagctggatatatatacatatatatatacatatatataatatatatataattttttgctaattttaatgtcaactgaagtatttattactacaagatattgaagggttcagcatttattcaaaaaaattttttaagctgatccaaggattgcgttcatctgatatgttctcaaatgaaaagggctagataagtcagtgcagctcaaaaatggcagtaacttcagagctggcaattgacacttgttttctgccactgtttactcttcaataaaaaatgcatatttaccatagcaacctcctgatcacgtggagccctatcctacatgcgaccctctaaaacagaatagcttcttaaaggaacacacacatcctaataggcatgcttttcagatgcaaaaacgtgttctttataaggaagccctctttcctgggatttagtgctaataaacatgtcatccttgtagaaatcattttggtcccctgtcttaaattttaagatgttcattctggaaatccaaataaaattactcttggaggggctttcaattatcttaaggatttgttgattatttattttaatatggttctaaatatatatatttgtgtttatacatgcacataggtatatatattttaaacagcaaccgttagtatcatctggaagggagtttggtgcagattctaacgacctgccgcttcatctgtgattaaagattgtcatctatgcgaagctcagtggcagcctgaattgttttttactgttaacttgggaggattgcctggggttttagagctttggaggagctgccccaactggacttttcagggaaggatcatgtcccctcatgctggcactttgtatgtgtctgattccatagcttggagctggcttggggttggcgcgggggcactgccagggacacgaacactgaaagctgctactcaggaggctagtcctggagctaaaaccacagatctgccccctccccatgccatctttacatatgacgcgttgctttggcaatattcatgttgaaagccactattaattggagcataacctccatcaggcaccatgctaagtgatttatataccttagactctacaatcctttgagacatgaattcttgtgactattcccgttttgcagataaggaaaccaagcctcagagaggttatgtaatttgcccaggattacacgcctaagacctggggaacttggttttgacctggggcttttggactgcaaacctctccgcttattctgtcttctgaacctgtctgtcagatttagctctggaaggacaagtggcgacaagatggagaagcctttggagatagggacagtgacagtggcttccctctcagaatgcttcctccagagattcctgggtactctcagtttcagcagagatttgtggaactcttttcatactctgatttttttttttaatgcctgcacctggcagtcaggcacccttcccctgtgctgggctgaagtcagggctggagtgccaagggtctctggatgccacagccccagggagaggtggtatggctgtgtgaccacaagtgtggtcaatgcctctctgaggcaccactgtaggctaaggaggcatcccagccgggcctggtggatttttagtttctttcaatgtgagaaacaagaacgtatttgtgagtctgttatgcttagtggctttggggcaaaatccgattgtgaagtgaagctgggttctccatggcacagaggcattgtgacctgcactccacggaggggcattgcccccaccccgtgcccaggccagccaatccgacggcggcaggctcacaagccatttcataattatccatcacgaatgcctccatgccgccctaatagattatttaaaatggtgtgtgtgtctctcatgcaacctcaagtcagccccaaactgtacatgcgtacagcctgggagaggtaattgtttatcatgtatctctttgttgcagacacttttataaaagagtatgtattatgtatggtgtgaccttcaaatgtcaggaatgtgttttgcaataaactgtcaatatttgtggttataaggtactagatgacttttacaataattggaacggctatattaaaagctgggatcactcggctggttaaagagaaagacacaggccagcgttcatcagggacttgccttctgccaactattaaatgaaagatagtgcaaggtgctcaagatgtcttctttgtttaaaaaagaatatggcaagacacatctctaggggaggcgttatctccaaatcatcccttctcctttcagtgtgctcaattcccaggagaaaactcaactccgcaagttatagtgactgaccaaatacattttaaaaaagattggtccagtttgttcctggtgtcatttaggtaagaattcctggagtcagatcttccatcttctcccctcctccacccccacccaaacaggaggggctgtaaattatcttaagaggatcttaaaagctatagtgttctttttttctttcttagtaaaataaattacgtagacatcttttgggaatttatgctttagtgaaagtagaggcttatactataattttcattttttgtttaaagaaaggagtacttaatttaaattatgaagaagcaaaggcataacaaatattttattataattattatagtaattggatcatagattacattaaaaatatctgtttcactatgctcttctatgggtgagtatctctttatgcttatgtgaagtcgtttctccttatgatagtcagatcttcgtttttaaccaggaaggaattgagtaaatgaaatggggaaaggggcctcacactttagtcttctaaggagctctcttgtggccttgctgattataattgtgtgtttgtggttccttccacctggatggagggagaactgggtgacaccctgaggccccttcctccaggaagcctccctggacatccccaggcctcctcaccctgcaatcatccaactccagcacctgcatgcgctgaacactctggagcacttccgatgttttgacggtgccctggactatttctccccaccagctgctcaaagtagcttccctctcatagtcaggaactggtcttaatatctgaattccaacttgcttgccttccctgatgcttttatttgttgaaaaagtatttataaagcacctgctatgagctgaggacgtctcgcatgctagaaatgtcacggcaggccatagtgcctggcccctgttctcctggagctgacattctaggaaggggacaggcagtgagcagtttaatacacagatcagctgaccatctgtgaagggcgatgtggaaggtgacatgggctgagagctgggggttgggagatttccttccaacagtgcgatcagagacaatctctctcagagaggtgacttttacacgaaagttagaagagcattctaggggaaagagaattccaggaggaggggaagcaggaccaaagccttactggagaagggacgtagcctcagaggagaacagaaagttgggaaccagcctcagaggagaacagaaaggtgagggttggagtgcaggtggggagttgggatgaagtcagagcagtagggaggccacctggacatattgagacacagctggaggttattctaaaaagcaatgaaatgagtagctggtccctgccctgcccccaaccagaggctgttcccaggagatggcagcggcctgggctgaatctctcagactcattctcctgcctgggtcttctcaccaaggccaggttcttaggtgaccctgctcagcgacacgaatggtctctggggtgggctccagcccacagtccctgtcccacagagaagagacaggtgtgcagagcccaaagagacatgtcacacctgatgtcttgtcccaggtcaattctgtgaatcccaaaccttgcccgctgcatccagggttgcagtctctagcctggggactgagagtacctgcccacagccagcccatagccaccccttggggccttggcaagatgtggcggtctgcggatgacaggggatgttgtcacagcagcatcacatggtgccagagggcagagaccccatgggtggcctaatccccagcagggagtttcacagactccaccaacaattaagaacaggttcaggggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagattgcgccactgcactccagcctgggcgacagagcgagactccgtctcaaaaaaaaaaaaaaaaaaaaaagaacgggttcagggcttgggaaaaccagaaacacatttggcccacagttcttgatcttgaagccctggtatattttaaggaaaatgtaatccatgtgtttctgattcattttcacttaactcatcaaaatgttgctttagagaaggtatttgaaatcctagtgtcttatatttctccctttttctttttttgagacggattttcactctgtcacccaggctggagtgcagtggtgtgaactcggctcgctgcagcctccgcctcctgggttcaagcgattctcttatctcagcctcccgaatagccgggactacaggtgcctgccaccacacctggctaatttttgtattcttagtagagatggggtttcaccatattggccaggttggtctcgaactcctgaccttgtggtctgcccacctcagcctcccaaagtgctgggattacaggtgtgatccaccacacccagcctcctttttttttttttttttttttttttttttttaagaaattagccttttgatgacctacttccccaattccagaaatcgtctcttgccaccagcaaatggaactctgcccagttttgagtttgggtagagggtgagacatggcaacatggaaaacatgccacctctctatctcacgtgtcccagggctcaccagtgaggtccaatcccgaccccgttggtaataacccacgagcaagctgcctgttgcctcctcacaagtggacatcgttttctaaaatagctctttatttaaacaaatactttcaccaatccataagaatacttaactgtttaacatgactatatatggccaccataaaattgagcactctgatgcaaccacagagacaccaagttgatactgacccgaggcatgagttatgtcttctaagagttaggtagaattgtttacagtaatgttataattttcatgcataccattaattttaaataattaaaaaaaataaaagggccagttgtgattgctttatttgagtctattaaagctttcaaaataagggaagtgttaagcttttaacagtagctatacattcctttggactttccccaaggtgtcggtattatcttgctcctgaaaagatcttcaagccctggcatacgtgggcaaggacattaagaaagatgtgatttttttgttgttgttgtgccactgaactgcttcttcaccccttagactccacaaatagttttttttcttcattaatgaagtgagagctgtgattttgagacgttctttgcacaaagcatacttgcagaattaactgacaactcatctgggaaaatgtatttactgttatactagaagctccatagaaattaaaatatcatggcatttgatgccataaacgtagtaagcgccagggtgttcacagagttagtcaccttacccatgcgtgcttgctggggtaactctccagtcaccatcatcattgccaacagcatcatcattataattttttttaatggaagtctttccaaaatgtacttctgggcatctgaagggtaaggctgccagcgagttgggatgaagcgagaaccaagaatccacatgcaatataagaagaagtcattctttcctttctctttgtcctctcactctgcctcttttggtttctatctctggcttctccctttcattctgtgagttaattggactccctggaagattggatataaacccagaagacttcaccagtagaggattgactcttcttagtcaatttctgaccttttcccacaatggctacccccaacatctctatggcttaatataaccaggatttgtttctcattcatgcaaagtgtgatgtgggtcagctgtcatccatctggtgactcagtgacccaggtgccctctattttgtgattctgttgtctcaacctttgcgttgcaaggtcactgtggcccaggaggagagggcggaggaggtgcaggcacactctgtcttcatttccttcatctgttggccaaaactgaccacctgtcctcagcttagtgcaagagaagttgggatacgtaggggtccagggactagttagcaaccatttgccgtcctttttacagtcatttcttctcgcctctttaagacccaacatcagtatcttctttggctgtagggtggggtcagcggggagaatgagaggccaaaaaaaaaaaaaagcagcgggcagagacagcctgggataggcttggagctctttcagcatggcgggacccggaggtctagtcctcgtgggtcagatgggaaccaagggcgaggggaggggtgaagggacttgcttgggatagttggatattagggacccgggaggaaaagattctgcctcctaacgcctgagtcagcatttttggaaaacaacgctattttattatacaaagaagttcagtgtttagagagaatctagggggaaatctacccttcaagtacaaaatcattttataaacaaagttttaatatcccaaacatattatatataaataaggttaagtgtgtgttgaggcacccatccattcaaatcatgtttgtatacagcaagatagccaacctcaggggtggtttcagacagctggtgacagtgttttctaagtatcggggctttaacttttgagaagttgtttgtctttctgagcatccgtttctttgtctaactggtactgccgctttgtggtccagtggatgatgaggattctaaaatgatccgtagccattttaatccccccaactccttcagcccacatcccctcctctgaatacttggggaaagcatgcaccttcatgtcaccttgatcgaggccaaccttgctatagactcggaggataagaacaagcgaatgggcatgtagacaacattgctgaccttgagaagacaaaattaggaaggtctgttgcctgatgtctccttgttcctggtaacagacctttaaaaaacttggatccacctcctttttctttagcaagtcactttcagcttgtaggcacgggcagaggagaaagctggcagagcttttgatgcctacttcaacacatttgctcttggctacagtctaggagggttgcaaatatggcctgtgtctgcctggaatattattcgttgtacccatgcaaggcacccacatctgaagaaataatcccatattattcagtggagtcaagaaaagaaacaagggccacaggagctgtttctcagctgtttctccatcaagtgggagcccagagcacacccaggctgagggtgcattaggcaagagagggcctccccgcctgcagccaaaggtcccctccagggacatctcagtctctaggagctggcaggggtctgtcatttcacagatgagcagggaggaacagatggcagcgttgaggctgacctctgtccacatgtctgccttcagtctacccagcacattagagaaagtgtcacataggagggaaggaataccactggttagaggaaaagaaaattaaaaaattaaataaatctcaaaccaatgcacgaaaggtttaacaaaggatcacagatgcaatttttgtaatacctctctctctgtctttttgttgttgttgttgttgttgttgttgtttttgagatggagtttcgctcttgttgcccaggctggagtgcagcagtatgatctcagctcacttcaacctctgcctcccaggttcaagcaattctcctgcctcagtctcccaagtagctgggattacaggcacgcaccatcatgcctggctaatttttgtatttttagtagaaatggcgttttaccatgttggccaggctcgtctcaaactcctgacctcagatgatctgctggcctcggcctcccaaagttctgggattacaggtgtgagccaccatgcccagccaatacctctgtctttctactgcctgcttcctggagtggctaggaaagggctggtctgtctgcaacataaaccagtgactgctttctccacctgatgttatggggtgccaggagaagtgatgggactccctcctgcagtttgcagaggggcagacgccagtgcttttatactcggggtagagaaggaatccaagagcagatgcacgttcccctctgaatgacactctcaggttcttgctggggttgggccaagttcagcacacacatcctcaccagcacccatcctggcacaggctggggctcacgcacagtgccctgcgggtgtcctgccagcacttgctcccccagccttcactgtgcttggctttcagcctctctggacacttcctgggaccacccacgatagcccttcatcttctctcagcatgattttccagtaggattagtctaaccataaatgccataggccttctggccctccaaaaaaaatcccttttctttgtgaagtaataattagactcttaaatctgcaaagaaaactgtttatcttacaaatttattctttttattgggccacacatatccaagatagaaagataaaaggaaaacagatacaggccatcacttagagtgatgtatagtgaggcagggctcatcctcaagttctgcaaaatgttccacagtgcagggcggccgtatcgctatttttatctgtaatgtggcctgggcaagtccttcccaaaagctccaggagaaatatgccctctctcatttctcctgcagtgtcttcttttttgtgatttttttttttttgaagattcagggggtacatgtgcaggtgtgtggcatgagtatattgcgtgatgctgaggtttgaacttctaatgatcttgctgtctaagtagtgagcatagcggtcgataggtaatttttcaaccttgctcccctccctacctcccctgcccttggaatccccagtgtccatatatatttttttgagacagggtcttgctgtgttacccaggctggagtgcagtggcgtgatcccggctcattgcagcctcgacctctcgagttcaagcaattcttgtgcctcagcctccccggtagctgggactacaggcatgccccaccacacccagctaatttttgtatttttagttttgccatggttttgccatgttgcccaggctggtctggaactcctgacctcaagtgatctacccacctcggtgtcccaaagtgccaggattacaggtgtgcaccaccacacctggcctccagtgtctattgtccccacctctgtgtccatggtacccaatgcttagttcccccttataagagaacatgaggacattctcctgcagctttattccacagtggctccttgctactgctctctggcgggctcctctggaagaagctttatgggaaggtccagagcatgccacaggaggccccgcaggaattacccttctttttttttttatttttcatattttgagacagagtctcactctgttgcccaggctggagtatggtggtgcgatctcagctcaccgcaacctccacctcccaggctcaagcgattctcctgcttcagcctcccgagtagctgggattacaagcacacatcactaccacctggctagtttttgtatttttagtagggatggggtttcaccctgttggccaggctagtcttgagctcctgacctcaaatgatccacccgcctcagcctcccaaagtgttgggattacagacataagccaccatgcccggcccaataattacacttctgaaacctgcccctgcctaccttcatcctgaagccaacatccaggacaccttagtcctgcttataattcaaatcaacagtgattggcctcctaacttaaattaggtatctcgactatgttgccaggagcacttgggcagaattttaatcaggctcatcattatttgaagctgaccttcatgattccagcaaaagggaagctgagggaggccgggagggcaaatgcagcatgctcagggttggggtgggtgggagtgggagaagggtagaaggagatggccttgccactgtctaaagctagggtatgtggttggctggaaatgacatctagccatcactccttctggcagcagctccttgtagattcaacctgcaggacatagagccactgtgaccatatgtagagcatttgtctgatggtgactttgcaacactctcttgtgtccatttgccctgatcaataagccatctttgggggcctttccacattcatttgggcaaccacaatctagggcttggtggagtgactttgagttctagatgtggatgagcctaacttcctacttgtgcaaaattataggaaaaaaaagctaggtaattataccctttgaatagctctccaatgatggttagaagagttggggagaataggattaaagtgagatttcaaatataaataactgtgccagggtgatgatatggtcgtacacagtccaactgcagagagaatgctccaagccaagagtttccacagttgcttagagcgaatactcaaataagaattaaatgtctcggacccagtgtagtggcttatgcctataatcctagctctttgggaggctgaggcggaaagattgcttgaggccaggagttcaagaccagcctgggcaagatagcaagaccctgtctgtgcaaaaaatagaaacttagcaaggcatggtggcctgcacctgtaatcccagctacttgggaagctaaggcaggaggatcccttgtgcccaggagtttgaagttgcaacaagctgtgattgtgccactgcactctagcttgggtgacaaaatgagacgctgtctcaaaaaaaaaaaaaaagaattaaatgtgttgtccttcatctttctcatggtctacaagtctgccgcttttggctgttagcagagaacaccaggaacagacgttgaggaataaaagcagtttgcattttccattgcttggaaggcacagatcttatttattgtgatctctgcagaacccgcagatctcattatcccagaaggttcccttgttctcctagtgggatttaccatgaggcctagagggtgggctggaagctacggtgaggatcaccccgctatcctcaggagcttagattctgtgccaggccttcaggctcctgctctgtggggatgtccatgattctggaagaaaagtgagcccagagaaggttctcttgcttctcctcctcgattccccaattgtgacctctttggcagtgtgatgtcaggcctcgggggctgcaataacatatcctccaaccactagacatttttccagttttatttactattatgtcccacaatttctttgcagaaggcagccatatgtaaattttattccgttttctaatggtttgggttacataacaaataacagcaggaaggaaaatttgtatcgatacttgacagaggaagttctcaagtcactgcaaaaagatgtgtctgcagtgctgtaagtttatgggagttttgcagctgagtctctgcatatgactttgaatatgtcactatatgtttatcatgggctaattgtggaatcacatttccatactttttcttctccctttcatgagattacaccagccagtgatggatacaagactctacaaggaagaaatgatcagttttggataattttctttcctgtcccaaaatagccatatgtctgcatgtcttagggactcagctgacacacattttttttaatttgttgcttgctataatgcaaatatgatttcagtcccatagtgaactctacagtgagtccatattataaattaatcagattcaacaaacaccaacatttttaaacttttgaaaaaaatatttaataggaactaagcaaaagaagaaatcaaaccagctgctgacacagctgtttcttttcttgtttaattcagttcaatataaaggtaccatatgctgcttaaaatggtgataggaaagatgaaataatttaagagaataacaagaaaatacatgaattgtcagcattctgtcagatttaaagaatgaaatagacaggtgtagtattgacatgtttaactttgtgtggtgttagcagttttggtgcgaacaactcctgacatgtgctgaagtgatgtgagaacgtttctccttcgctgcagacattggcgaggaggctgggagatctgccggcgtccagcaaccagcgctgcttcgcgacagaagcctgggctcggccatgaaggactgcccgtactgtgggaaaactttccggacatcccatcaccttaaggtgcacctgaggatacacacaggtgagaagtctgagtgcatccaggggcacagcccagagaaggaggaggtccccgtcctgcctgctttctggcccaggtccacagctgtgtgggtcactaactctggaaggttctccctgggcctgtctagccaccattgtatggctcagaagcggccctcatttcctgattcgtcacttaactaacattcacctcgcaaatgactcagggactcgtaaatgtagacttggatggtcctggcctgggataactgggtcgcgtctgagcctctagggcgttttgctaatggtttccttctgctgtattgaaggagtccctccccaggcgcctgtatgaaccaggagtctcccaggtgtcagtgatggggtctcagctcaaaccttcctaagtgcagaagggaatgaagccacttccccaagcatccaggtagaataggctttagcccagcctgtgttacatgcccagacctgggacagggcagctggagtccatcctcgtcactccatgtggcgtggtggaaaagtgactcttccctgtatctcctcaaagaagaaattgagatgctcttaggcaaaggggggcaagtggctgctgcacccctctggccatttctcatgttttggcgtcatactggacgaggactggctggcaacagggagttctgtgtgtccctcagtcaccgtcctttttagctttctgcttgttgcttgcacattgccaatataaaaaaaaaaatctatcggagatatggacacttccattttctttgattttcctcctgacactttatctattggagtatgagctgcttcagaggctagacaaatatgccatctattttcaaaaataattgtggtttatttcccaaggaatcaataaggctctgggttgcacaggaatattgagtgcacgcgggctgcatgggcatcgcgtggggggagacaagaaacccctcacctggtgcctcacctggtccccacaaatctccctgacaccgagggaagcctgaggacagatgggcacaggaggccatgggccgagtcaccagccctgttcatcctgcatgcctctcttggagtcatctcaggccaaagaggtgtcttttaaaatggtcctccaggtcccaccactctcccaaaaggcctcatgcgacctgcccatgccttgccccggccccatcctgcccccttcttcatccttggcacctttctgaaacaccacctgcattctccctgttcttccaatgcagaatgcctgttccagctgcaggacctgtgttcctgcccctccctccacctggaatcttcctccaggtggtccctggggacttagctttactgggatctattcggagaggctgcccctgactatcccacctaaaacagccctcacatcccctgcaattatcttctttataaacttaacaatttcagaaatgaccctgttgggctccatcgcttatttgtctcccaccaaacagagtctaagatttgcacaggtggcaatattgtctatcttttgaattgctgtcatttctataaccccagggtctgcaagggcactttacacccagtaggggcagatgaatttatctgaaaggttgaatgacagaagaaatgctcaaataagtgagtgactcctcctgtcttccctgcattgttcaaggtggcgcagaggagtcaagggctgtagggaaagtggccccttccccagggaacacaggaacctatcagaaaccacagcctgacagtcaggctgcaagtgctggttgcttgggcatagacaaagtggaagatcctcttccccgggagttcagggagggggccttgcattctgaactcagggtctttgccctttgaacttctctgccagatagttgcatggcttgctgcttccccttcagagtctggctctgatgcccccttctctgtgaggcccacccacatggcagtggaccccccgccccaccaggactttctagaccgctttccttccctgtgtcacttctctccatagtgctcacagcatctgacacaccatgcatttgtatttcgttgttgtttctctccatgcactagactgtgaactccttgagagcaaaggctgtgtctgtttgtccagctgtgtccccagcctagaacagagcctggcccaggtaggcactcagaaagtatttgctgacccaggcattcctgcgtcaattcgtgaaagtgaccaggctcgaaggcagtcagcccagacatctggttttctcagatgatgccaatgtccattttcctccccagattggagccagggttgtggtggtggttgggcagggtggggacccgcagactgccaggatacgggaggtggtccacagggcacccatgcttgagctgcctgcaggagtgtggaaaccaggctaggcatgtcttgtcttgtgtatttcatgtcgacacagaaccctggaccacatttcccagccaggtggtaactctccatgggtaacgtcagccttgcagggtgtaagagtcagtgaggaaaggcggtgcctctcaacgaggggctccactaaccctgtcggcccaagaccagtcagcttcccggggggtaagagaagacactccacagaatatttccaggcaacttaggaccaaagctgacagaagttctggataacctgggagagagcaaatggttattgctcttcgcagttttcaagcttgagaaagactaatgtttctgaacttctgcttcacaaaccttggaatactcttcggagacattgagagagacaacatagggccatggacagaggcattctggaaacttcctagaatcagagagaaaatgaaagaagccatggaaacatcacaccacctccaccacccctcggaagcagcattcgccgtatgtaaaaggcagaatggtaaccagataaagatcaattacctttttatctaagaacaaagaagctggaaaatgcttacacttgtgcatttgaatagaacagaaagtgttacatgttataaatcacccaaataaacatctattatgacaatgtaaaagtgtagattacacaagtaattaaaaatcacaatcaacgtatttgttaataagtgatttcatgtgggactcaagttggtgagaggccctgactgcctctcttttggccctggtgtctctccttgctccaaataccatacagtttttgtatttctaaatgacatggccagaggacagcagtcttattacaaaacaaaaatacatgtactccaaaatgccatctttttgaagtttttaaaccatggacccatatgagcacatttaaaaacccaacgtgtaatataaatatatttttaattgggatatcagatggcaccttctctgtattttttctgtccgactgcatctttattggaagtctcgatcatgtaacatcaatggataaaacctctctcctttttctccccactgcattaactcaattactgtttctcttctcctaacacctgtttgttggagaggtgctgactagatgcaccagtcaggttgttctgaacatctgggagcccgagagagcctatgggtcactaggatgtttctgatgcaccctaagcttcagccaggtcctcaggggaccaaggggaggctgctgcaggatctcgggagtccctaaggccatcagatcctggaggctgcctcactctggctccaggcagggcagacgttgatggctgcttgacccagaggtggctgaacttctctcctcatggagacattaccctgggcagactagggtccaataactggatatggacaatttttattctacagcacagtgtctgtgattcaaattcagagcccattattgcaggctcagaaaggagattgcatcagtcagggttctccagagaaacagcaccgataggaaatgtatatatggccaggcacagtggctcatacctgtaatcccagcactttgggaggccgaggcgggaggattgtttgagcccaggagttcaagaccagcctgggccacatagtgagaccccatctctataaaaggaaagaaaggaaagaaaagaaaaggaaagaaagaaaagaaaagaaaaagaaaagaaaaggagatatgcaccccccccacacacacacacgcacacaggagatttataagaaattggctcaagtgattatggaggctgagaagtcctaagatccaagatctgtaattggtgagctggagactcaggagagctgatggtgtaaattccagttcaagtctgagccagaatgcagatcaatgtcccagctgaaagacagccaggcaaagcgagtgcactcccccttgctcagccttttgttctattcatgccttcaacggattggacaaggtgcacccacattggagagggccaccttctttactcagcccacccattcaaacgttcatctcatccagaaacacccccatggacacacccagaagaatccttaaccaaatatctgggcaccctgtggcccagtcaaattgacacacaaaaattaaccatcacagaaatacatcagcaaacatctagttgtaacatgcaatggggagggcgcatgtccccagagtctcctgagaggttggcaaatcatttcaggattggtctccatgcacccatgccattcttttcctccatgtcccctccctgtgcactaccttgggaagccaggtgcctgggggtactctggaaggtctgatgtatctgttttgtgtgtacaggaagcaggcagatgctgacaggtccctgaaagcctgggggaggcgtgaccccctggtgggtgagcacctcatgcgtggctgcgggactcctggctgggttccctaccgaggctctcccatgtgtgggtttttcgggatggggttgttgtctcaaggaatgaccattgtagagaaatgtaataagcaacttcactcgtgaaaacttggaggcatgaaagttcagggactaattaaaaataaatctcattagtttcttctccctctcgagttctgtgagtggtttattaatctggttttgatgtgccgcatgttccagccccgagtcgggaacctctttgtgggaatggatccgcacagggaagtcagtggtggtttcccagggatttcagctgtggtcacgaggggttcagcattgggctgaagggtacgcccggcaccccccaactcctggctgctgtcttcacggcacagctcctggatgctggctgggctctcacctgtattcttgtccctttcctataggaccaaggaggattgtggaagggagggcgttctcccttgcagcccccaaagggctgcacacccagtcgggtgtagggagggagacctggacattatcttgccttgtgactacaaagcctgacagcaactggctgaacacagaactcagcccgcagggatggagtaacggcacaataacagtgatggtagttcccacgttctatccacgcccatatgcaggctctgtgctagacactttgcattaactcgctccttcatccctacagcacctcagtcaccaaggctccatcccctgccccgcttcaggggagggcgctgagcctcagagacagagaggtgaagttatcccatcccggagttgtccaggcttggattaaaggttataatcagatctgcctaattcagaatctcattctcttcaccgctgcattgtattgctactttttacttttctgagtgaatttctggcttgttttagggaattaatgcaacatttctttgacagtgtgtgtccacaccatacccaacaggaaggaaagaagtgacttgtactcacaagtggtgttggcgcagcctccagggaatttaaaagggaagtactgtgcaccccagctcctccttgacccctccctcagactggccccaggccaggcttccttggccccacgtgcttgggtttccccactagcacagcgaggttaggggtgaggcatggccactgtggcatgtggaggcgctctgacctcctgggatggaaacggggtgggggtgagtgggagtggaatcacttccagcatcacagagctgataaactcatgctatggtggaaaccacctttcatcttcaaagtgcttcccgagcagtggctggtacataaacatgggtggaaatgaaacttccagccggccccatccaggtgccttatggctggtgtctacgtctcttacatttgatgcttctatgtaaggtatctaggctgttttcacacactgagtaaatataaaagcactttgcatacattttcaaaaaggaatcagttaaaatgggtgttcttctcatttccttttccaaaaagagagcatgcatttttgccgttagtgggggaccaaccacctgagtaatgatgaaaaaaaaaaaaaaatctccaaaaggagataagtctttttttctttttgttttgaattaaaattccatcatttttctatatctgagaggaactaaaagcccggtttattcctcctctgttccctatccttgcttttcctgccttaatgacatcctaaacttttgttgaaaataattgattgaatttaaatttccttaaaagttgaagaggtaatgttacagtataaatttcctaccaaacactaagtagggaaatatccattagtgaaattaactacagtttctaggtagctaacaatgtgctgtatacagtagggcatggctaatgaacactgcagtgggtgatatttcattatacaaattaatgctcacattttaatgggaaagtcacataatgaatctgggcttcagtgacagcaattagagacacagattgtccccttctggacaaggcactgtttagcaataagcagctgtgtgaaaagtcttcaggtttacaacatatatatgctttgggggaattagtgtacaatttatattaatgtactgaagctttgctgcaaagacaccaccatatttatctctcctggtgttaactaagtgaagagatggagaaggactaaataaatatcaaattgaggatgcaaatacaggaaaatattcagttgctcaacttaaaagtgaaacacttttggagatttagcaaaaaaaacaaaaacaaaataaaaaaacgagaagcatgaatcacatcttaaaccttaaaatggtttccaaagagaatatgaatccacctgttatttttggagaggtgctggtgggaacttgctctaaatagctctagaataactccctggaacagtgagggttcctttgacatatcaacagcaaagtagaggctcagaattataaaagatatgagcatgtaaaaataggtaccgtgaactaattaaaccacctggtcgtatatttctagaaattgatgatacagtgacttgggagaggttatcaatgatattctaaagctaaatctatatcttatgccatgtgtcagtgggaagctggcttactgtacgacagtgccaataatttcattaatcaattggaatgatgaactgcggccttttaatttcattatgccttttctagcaaaactcttctttctagaaattcattgtttgggcccacatcttactccttaaaatatagtgagaggtttccccgcagaaggctaccagtgttcgtagctgcttcctttagtgggcaaagagccccattctgcacatttcacaatgactgcctgctccagaccccatctgtaaaatagagcactgtgacccttcagtgtttgaaaagttttgagataggtactaatatttaaaaattaagatactgcacacagaaacctcatagatatgacacttttcttttttctagagacagggtctcactctatcccccaggttggtgtgcagtggtgcaatcatagctcattgcagcctccaactcctggactcaagcgatcctcctgcctcagcctcccaagtagcttagaccacaggtgtgtgacaccacacctgcttaatttttaaattttttgtagaaacgaggtctccctgtgttgcccatgctggtcttaaactcctgggcccaagtgatcttcctgcctggcctcccaaagtgctagggttacaggcctgagccaccatgcctggccgagacttttcttggaaaatcaaaggttctagtgcccacagttggttagagttgagtgacactgtgctccaggagagaacggctgttttgcatactcatctgatctgtgtggttctgcctgcatgcaagtgtgtggcacatataacagataaacacaaagcaatgaaccacaaacatcatggaggtcaccataggactcttgaccccctggaaaccttgggaggcagcctgagtggtcccctcagtagatgggactcatttatggcctaagtggccaatcactcaactagacagagctgctggcagggtctggggctgcctgtaccatggggctgcccaggcaatgcagacctgagtctcaggcagagtccagccttggttgggcagggctaggcaggcccaatgcctggctcttttggcatggatctggccatgtccggaggcctgggatttgctagagttagcccagagcgcttgggtagaagagcacatccagatgcagaggccttggctgggaagcggttctcagctcaggtagactcagcatctgcctgtgccggccaaatgaaagagcagatgtagaccgcaccccggagcctgtgaaatgtgctgttaggcctctccttgtggttgctgccccaccccgtctaggccaacgttgtaagtagtttgcctcctgagcactctgaaatgggccctctgaggaaagaatgcctgggaaacagctgggatgtttccagtggagcacaagaccctggggctgctggggctctaaggaggttcacagctcaacctctgggtgtgcctggctagaaacatgccctggccggggctcactttcatctccaaagccttcccctgtgccccttgttggataggaagcccggaaagggaagcgagggctttgagatagagggcaggggtggttcttccaatcatttagcgattacgaggaaattaaaattgagcttgtttctttgtgaacataagtccaaaggggaagggtttatcccctggaacagcgtgcccacctggagcacttaactgaggaactgggatgatcggaagaaaccacccaaaccaagccctttagcgacccggcaggaggtggaactgtatagagaaatggacagaaagagcaatgcagccctttcatcccagtgcagaaggcagaggaagcatgggtggagaactttctagaaccttgcatagcacgtgcattcagaaaacccttgaaagctcatgaagcagcccctaattcaccaggcctgggcccgtggagactccaatgctaggaattagcctttcttgtttctcagctctggcttttattctctggagcagtgagggccaaggcctattttgaactctaaagacagtgggtggagtgaagggatgctatcttcctgtgcactcgcatgctgtgtgtgagtgtgagagtgcgtgtgcgtgaactctgctagcctgctatatgatatgtctcctccaaaagccatgagagcagagaacctacctctttggtctttactcagtttccagggtcaagaagggaggtttcaggtgtttattcattcatccattggttcactccatcaaaaaaatgtgtgtgaatcaaactgaaggtttctgagtcagtgggtgacaagtatgtgcacaagtagcactggctctattcaggagacttagtttactcctaaacgagcttaggattggcgtgagaccccacagaacatgtgcttcaacatgtcttattacaggttgaggaagaaaaagtcccaagaccaggattctgtgtccagtggaattcagagtagcgtgggtgtccagtccctagtccagattctcaaatacctcctgaggtctagactgtcttccctgctaaaccattcatggttcccacttcaaaggcacttccaaggaaggctgcctacaatggttccccactcaggatccacagagggccacctgggaaagtcccgaaagatcccgaaaccaagtttgcatctttggccaattaactcagaatgtggggaggtgggaccaggtatcagcacttcatcaagcccccaaggcaattccaggatggtttttcaagggattgtctttacatgtctgcaccagaatcatagggacgcttacaaggccaacttctgcgccgaccccagacccagggaatcagaactgctgtgccttagggccagaactggtgtcttaccacactcccctggtggttctaatgcacaatacagtttaagtactacccgctcccatatgtcttttttttttttttttttttttttttttttgagatggagtcttgctctgtcgcccaggctggagtgcagtggcgccatctcggctcactgcaagctccgcctcccgggtttacgccattctcctgcctcagcctcccaagtagctgggactacaggcacccaccaccacgcccggctaattgtttgtatttttagtagagacggggtttcatcatgttagccaggatggtctcgatctcctgaccttgtgatcctcttgcctcggcctcccaaagtactgggattacaggtgtgagccactgcgcttggcctcctgtgtgcctttcaaacatgtatccattggaaatagacacacacatcctctgtgcatccccacagtccccacccagaaaggcagccctccacattcccaggcttgagaggaaagtccaccttccccctctttagctccgctaatgaatgcccgtgctttctctatggcccctttgcctgccagatgcacataatcatttccaggtgcatttctaaaacacagcctgagtcccaccaggcacctgcgggcctcacctctgcaggctttcatcgcctggccctcccgcagggcttgctctcactcgtagggcaggatcttgagtttctaggtaggcttgcctgctgtgggccccatcacaacccctctaagtttcggggactgcctctgttacacctgatcactgggcttccagataagctgaatcagccatgacatcctgctgcccagaagtgccccatcccagcctggcctgcgatgggatgtctacatagcagtagctcaatgagtctgagtctaacctgggactgactccaagaagggggaaattactgcctgaaattctctgtgcctttaccccaaaggggatagagacttcctcctagattcctgtcattggtctagctagagatgactgtgacctttacgtttagagaaacagattccctgctgggttcccttcctagacctaagggccacctctgaaaaagtgtccaggagagatctcagctgctcatagcaactggcacccttgttctgataaggcaggcagggtaaccacggttctggcacgtgatctggagatgacatggcatctcctgctcagaaccaggctggtggccctcttgctcacaaagtccacgcccccaaatgccctgtgcctggagaactgggactcatgccttccgctgagactagacacagtgaaatgtcttcagaagacaccattcactgacgatttgttgttactttttagatcagtctattttacaatagaacagaggaaggggagggggaatagttgaggttcctggaagaaataattgtggatattgacagggcaccattgtgaataagagagcggggactgtcacagtccccattccttccagagagccttttgattgcaaagtctggaaaagacctgggattgctaacaaattcttggaatatatttaaatctgcagtcgtttaccttcttccccttctctatcccacaatgccagcaaatgtaagttgtctcttctggtatctttttccaccgtggaaagaacaatagaagttgggggtgttgaatttaaataaatatttaattcatgaaaattatcttatatgttttaaaacactctttaaagctatttttattctctagaaagcgcttattataggtaaattacacattttactaccggagcattaggtttgccattagtacaaatttaaggcactacaaagaccagtagataatgttaatttcaaatacagaaactaaatatattttgtgcctttttattactcattttcttttaagttttattgactgctttttatcttaactatatgtctttacatgctgcaatcataatgcactgtaatggtattaatattttatagaatatgtatttatagttctttatttagaaacagtgcagtaggtctgcagatatctgagcccgtctggaatggtgccctccaaataatgataaattacttgtgcagtatgccatttgctaattatatccatgatttactgcagagcaagacttaaatcattcatttcagtcttgcgtaacagtgccataaaatttttaggtttaaaaatggtttccatgtgtataatttaaacaaattttagatctattgtatacacaaaatattgcaaccacccatttgttacatactttctctttttaaacttctacttttaatgatcactgtggctgaaattattatgcttaattttcataatcatagcttttaaatctacagccgttttcacatgttagataaagaaaaagatagctaattgtgtgtagatagtatgtcattcctgaatagtcccaaatggtacaaaatcattaaaaaagcttaagagtacgaattattcttctattaaaaaacagttgttctctaattattagtttgagctgctttgtttcaaagaacaaatgttgatccttccagcctcgttcagcacaccaaaatgagataaacgcctcttttttttcttatatcaaaatcttgcaggtgagaaaccctacaagtgtccgcactgtgactatgccggcacgcagtcagcatccttaaaataccacttagagcgacaccatcgggagcggcagaacggggctgggccgctgtctgggcaacccccaaatcaagaccacaaggatgagatgtcaagcaaagcttctctgttcatcaggccagacatcctgaggggggccttcaagggtctccctggaatcgacttcagaggaggccctgcatctcagcagtggacatcaggggttctctcctctggagatcactcggggcaggccacgggcatgtcttcggaggtcccctcagatgctctgaaaggcactgaccttccttccaaaagcacccacttctctgagatcggaagagcttatcaaagcattgtgagcaacggtgtgaatttccaagggtccttgcaagctttcatggacagttttgtcctcagttccttgaagaaggagaaggacatgaaggacaaagccctggctgaccccccttccatgaaagtccacggagtggatggtggtgaggagaaacccagtggcaagtcctcccagaggaagtccgagaaatctcagtatgaacccctggacttgtctgtgcggccagatgccgcctccctcccgggctcctcggtaactgtgcaggacagcattgcatggcacggctgcttgttttgtgctttcacaacgtcctccatggagctcatggcccttcatctccaggccaaccacctgggcaaagcgaaacgcaaagataacaccatcggggtcacagtcaactgcaaagaccaagcccgggaggcgagtaagatggccctgctgccctcgttacaatcaaacaaagacctgggcctctccaatatgatcagctctctagactctgcttctgagaagatggcccaaggtcagctcaaggagactctgggagagcagaagagcggtgcatggaccggccacgtggaccctgcattttgtaacttcccatcagacttctacaagcagtttggtgtttacccaggcatggttggctcaggggcctccagttcctgccccaacaaggagcctgatggaaaggcccactctgaagaggatgtccccatcctgatccccgaaaccacgagtaagaacactactgatgacctctctgacattgcctcctcagaggacatggactcctccaagggggagaacaacgatgaagaggatgttgaaaccgaaccggaaatgatgaccaagccactgtctgccctcagcaaagacagcagcagcgatggcggggacagcctgcagcccacaggcacctcccagcccgtccagggactggtctcacctttatcccaagcaccggagaagcagtggcacagccagggtcttctccaagcccaggaccccttggcgggcctgccaaagccggagcgggggccccagagcctggacaagccgatgaacatgctgtcggtcctcagggcctacagttctgatggcttagcagcctttaacggacttgcaagtagcacagcaaattctggatgtatcaagaggccagacttgtgtggtaagttttagaatcctcttcctatagttcatttcccaaaacatcagtgctgaattgtgcatttaaaaaaatgaggtagacttatccatgagcaacttttgaatgaaatatttgaaaaaaccctcaatgctgtatctgcaatgtagacaatcataaaagtccattttgtttagaagttttagaactcatacttttgtgttctaatttgcattataatgtactaaaatgcctgtacagaaggcatggaaaagggggtggtcgctcaccatgtgaactactcctgtttgccatctagaacttgaaggggggaaaatcgacttacaaaacaaaaatgaaaagagacatggtaacttgcaaattcttcagtattttcaatttatgcaaaagatgcctaaagacaattccttactgctttgctaagccaaatctgctttcttaaacttttcttttattgacttagaggatactaaaatcatatcacactaacaacagtatggaaataaagcgaccttctctccaaagagggagatggtttctgggtgtttgtgactcatttttagacaaaccaaatggcagttactgtgactttggccttctgcgcttgccttctgtttgtctgtctgttcacctgtctgtctgttgctctaacaagacatgtacattgtgaagtccctgaacagtagtggtgtgaccctgtgcatcttggattcatgcttgtctgatcctgtagcaaactgacacttctttatctccttaaagcatatgggtaccccaaaggaattccagatttccgaacatcattgtaagtttaaggactaggtttggatcaaatgaatgtttgggtgggcagggggaatcaaagtcattgtcttggcaccctgatatctgtatttggaagcctttctccgaaaagaagctccatgcattcttccctttgaaaccagctccaaatatcctcaccagagacaaatgaccatgatacatttccaactgtaatttatgaatggatttctgtaattttacttcacctgtggaaggaaggcaggaaggcaggaaggcaggaagggaggagggcaggatggaaagaaggaaggaaggaagggaagggaaggaaagaaaagggaaggaagggggggaaatagaagagagtatttttgaacctcaacatcctgttgttcgtttaagcacagagaagaattcaggaagctagactctgggttcataatttagattgatatatttcttttattcctcttcttccctaattcactaggaactgaatcaagcggtcagaaatatttttttgaattgtcgaaaatcactaaatggatttctgacagctcaaaaaaatattgacagttccttatgctgaatgattcacaaggccccattaaccactacccccagatctatttttagccacatacaattcattacttttgaagctgttaaaaacaatatttaaaagaagggaaaaaagcgttttatgttagtccaaattttttccccttttttttttaaactgggggagcaatgttgaaggcttttttttctttttttcattgttgttttaggtttgtgatcggggtggtttcttttttattgttgtttagagtcttttttttttttaagtctattttcagttctttcaactacctacgtaggaccatagtccctgccaggaatccatgcatcagaaaagatcaaaacctggcatgttcatgagctcattattattgaaatgagctcatattacccctattaattttcccatcttcctatcagtaatgaaggaaggctgcctggctcgaggaagtttgcccagtggtatcctttcgcaccaggcgaggttgaatgggaagccaacgtcagggagcctgccgggtcttgagagccttttatctctgggctgcaagctcctaggaacttctcaccttttcccaaaacagcagcacacgacacgtccctgacatttccccgctatgtgcaaaccgtgttgcccagtccacccttcagcctttgggcagcagatcctgggatgtaagttgtgccccccacccctcgcctctttcatggggcttggggaccctcatgtcagccaagcttgaaggcttcctggttgcttctgcagcagagggttcaggccccttgttccgccttccactcctgggaagatgctgaaattgactctggccacgagctgcctatttttagagagtgtgagttctgcattccatttggccccatttcttctgtgtcctcttgctttagtttggaagtaggcaggaaaagaccctccctggctcttgcatttgcttgggggtggggccactgccctcttgcctctaggatgggcctgactctgccagttctcatcccactccccccatatctggcccaccataattgcagtcctcttcttattttcttgcgggctactgtgatatcccagaaggtccagacatattcatcctttctaaaagttacaacctaggaggaacacaaatccaaatgggctgttttttttttcttaaatagtgtaattcactctctttttagcatggcaagaagcacaagtgacatttgtaagcttcaaacccccactagcttccctttgcaagggtagaagtgatattagcacaatgaataaaatatttctaatgtttattcctccttctcttcttcactcaaagtaggtatgggtttctaaatccgcctaccaggctgatcactatttctccttaagaatctgggctttgtcagaccaaagcatcattcctagatttctcatctcagatggataaagttgagggctggttttgtctggttagtagacctaaatccccactttcatgattatagaaacaggcttataggaggagctaatgttcccatgtttcttaaggaagggctctgttctcaaggggtgtaaaagtgtttgaacaagcatcagaaatacctagttcaaatcatataaactccccacagatctcagcagctcctccaacccttgctgttgatttggagaaggtggcatctcaccctattctgtgggtgatactcatattgcaggctgtactttcaggatcttccatcatttctgcatgccttcttcctaacttttaaaactctggtcctaaattccttggtgccatagagccagggtcctggccagtgtgccctgcccatcctaacagccaatggattcctaactctggtgcagaaggagagccaccgaggggagaagccgacccagccagttgggtggggagacgcctgttgcatatgacagtgtcgagagcttcagtgggaattttctaaagctctttccacagaggacagcacacggcctgtcagagacatattacaataatcccaaggaagaggttaagccatcttggattaagccagaggacaggcatctttgcttccacagtgggtcagatcccactaggggtctgatctcattataggaaatcccactccaatcaaatccttagtttcttgaggtgacttccagtctccaggcatgggtcacatgtctttattctgtcaaagagcataatgtacaagggtactccagtgccatcggagaatttggatatgcccttggttttattggaatgtttgaccttggttttgtaatgggatagactccacatgagtatttaaaggtggagaggggaagaccagagcagtgtttgcatccatggacaaagcaaggcagataagcccagtctagtctgagaaatgctaatgcactgttgggtcggcacttggctgggaaggggcaggcttccctgtgcacacagcaccaaggctggtctgcacagcacccatggggcccactgcatggaacggttaaaaagtgtgtttcatctgggagtttgtggatttggacagcaaccagatcacccttactccttgcctttcaaacctaagagagatggccagggtgtggagttgttgtgtgccaggtctcccagtcaggctttgcactgtgtcctttggtggacccaggggtaggcaggacagagaagaatgaatgacagatgaacgggaaagcagggaaaagagcacactcccctttgccccaaggagctctgctctgtagtgactgccactcagggaaggctggctgaactggtagcatctgtaagcaggctgagggcaggcactgcggctcacacctgtaatcccagcactctgggaggctgaggcaggggcgttgcataagcccaggagttcaaggccactgtgagctaggatcatgacattgcactcgagcctgggtgacagagtgaaaccccttctgtaaaataaacatgaaataaatatcagcaagttgattgtgggcacgaggccctatgtgcagtggctaccagacctagtgacccagtgggcctgggaggaagtgagggagaatgcaagcccattaacagcagtcatcctaacatccccagcttatcatcctcaggttattgggcaactggcttccccaacccaaattatacctgagactatggaataaaggtcttctgggcttccacattagtgaaataattgggacccccccccctcccaagaattcgggtccattgaaacctattcaaattacatatttttatgtgtgatgagatgaaccaggacaaccaaagctgaactctcttaaaatgtgacttatcttttccctaagccttatagatttcttggcataggcagtcggagaatacctacttttttttttttttttttttttttggagatggagttttgctctgttgcctgggctggagtgcagtgtgcgatctcggctcacggcaacttccgtctcctgggttcaagcgattctcctgcctgtctcccaagtagctgggattacaggtgcacgccaccacacctggctaattttgtatttttagtagagacagggtttcatcatgttggtcaggctggtcttgaacttctgacctcaggtgatccgcccacctcagcctcccaaagtgctgggattataggcatgagccaccgcgcctggccaatacctacccttttacgagctactcagtctaaagcaacaggcagcaaatattttcttaaagggccagagaataaaagtgttggctcacaggccatggggtgtctgtggcgaccacccaactccgctttggaagtagcaccacagctaccatagacaataggaaaatgatggctgtggttgcgttctattacaactttaggtactgacaggcgatgcactggaattggcccacagggtcttatttggtcaacccctgctctggtgtaaagagggatgtgttcccgtggtcatccctagggaatgagtggtgcaaacactggtcctctgttattctgctggacagtgagatggtgatgggagacccctcatcatcagtggcagggccccatccattgtctggtaatgccaaagccagagatgtgagagagactttacagtggtagaggacttgttgacccagatgggccgatgccttgtttctgggaagccacacctctgtctatgcattaaagacttccaggagaacaccccagcacagtgcaacccagagctgccccctcatagccagcacacacagaagaggaagcgggcagtggctgtgtgttgtctctgatgcaagcttgctctgtgaaagcctgtttcctcactgatggaaggaagcgtagggatgaaatagatgatagagataaaagagcttggatcagtgcttctcagttgagtttgcatgacgtcgtggagctcagcatccacgtgaaactgttgcaaggaaatgatgtcagtgtgcaaacatcttcgggtcacaatcgtcccttaagcacggcaggcatcaaccttacctccatcagtgttagagaggcacgtttcatttcctcacttctgccgtgatgcatggttgatagctctttcttggtatgtggagaagtttgctttgaagatgattctggcaattttgtgatgacctcccatcccaatggttacactatttctgtgtccactccattctcttcctgataccaggcaagtgcttgggggtaggaaatgagtcctgccctgcctcagtctttgaccaagaaacggcaaaggtctgcagtcaattagagacttggaaggaagccatggctggggtatgaaatacacagtgagggccgcatatgtgcagacaccctgagtataggctgtgatacacaggctatggccattggtacatttttcatcttgtgcaagagtctacagtgtggcccagaagccagcaggttctaatgaagaagggaggtgaaggtaggaaaatggcataggaagacaaccacaaaatcccaatctgccgagtgtgtgggagtgcaggctgtacccagccagcacaagaaggcaattggcttgagggtgtgggagacctggggcatctccactgcaagatctttttgtctctgttgctgccttactttattcaaagacaaatgtgctctcatacctcttccttctcttttttgtgagctgattctcacatggattggcctcagagactatggataaagcacacctttgcattcacctcctttgcccaattggataatttacagattagctattgacctctatggtctggcctgctctcatttgtactgtgtgtccggggcctgacattagaccccaggagggaggaccatttggcctgccttgaagtccaagggcagaaccttgtgagttaatgcaaatcaccgccctgttctgcccctgctggctgcctcacaacctgctgcagagcttttctgtttgactctggagggacaaacacaggcgatgtcccctaggatctcttgcagaaatcagcacctggagtgggctctccccagccctcatcctgagccctgctgtgtgcactgtgtctgatggagaggcagcctctctggatggcagctctctccatattccaaaggcattcttctcctgttctccttccctctttttaaattaaatgggaatgccactgacgtgatgtcgtttgcactgcaggatgacagaactgttgtgtgaataccattgtatttgccaaatggtccactcgtcatttcagaacaaacaaatggatggtgtctgtaagtcggcaaacactggtgacatttagccttgtttatgttcctttccttttgctgcatatttttggctccaaaagctactggctgaatcaacagggcctctgaatcaggagagaagtctggtagcattaattttagttgctatgtccatattctcttcagactgcatgaatcctactgctcaggaccaagtctaggtgagaggagagggcaatcaacctctttggtttcggatgttgtgtgcaaagcccagggttcaaataagcagtaattatctcctattacttagtgctgatcaacagcacctctacgtctaattgccaacctgccctaatcatgttgactattcttgctttagccagagacagaaggaccaaattttataaataacactttattgtcattattccattaaacgattaggggatgtggccctgcccttgctttcaaatgcctctagccctgatggtttctggattatttaataaatctgcacattttcttgcaggtaagtgacactccctgtcctagtcggtctatctggacttgcccttgtctgttcgtggtcctcggtggttatctgcagcttgttaatcgtgtaaagtcaagagaagaatgtatacacatatgtgtgttgaataattactattggcataggtatgtgtatacacacggtgcaccaatctacagtatatatagcagagaatcagaggctaaaaatattaccccatatgttccagtattagtcatggattgcaaaggcttagtaacttgagcaggagagaaaactccctcaaagtcataaatcctgagtgacaactgctgctggatgacagatcccttcacctgtggacaacctggctgggggtggggggctgttccaccagctcacctgagcatgtagaggtgggtcctgcagtggtctcgtgggtattactgcttgtgtctgattgtcctgtattttgtaacactttagaagaatacagaaaagtgcagtaattctctttctccatagtatttaagcagaaatattgctagtttaatattgtgtcaggtcgtcctattaaccaggagcagatgacagtaaaatttcagtgaatagcaccttgacatctacaacttaaaaatggtgattgaagcaaaatatgtaaacttgtacggggtgatcgtgtgctttggaacagagtattgttgaagtaattagaagatatattaaggtgttcctggtaatgaaggcatgtaagttataataattgtagctttctgaataagtgtcaaactatatctttaagtgtgctgtatgctgagttacaagttaggtcatttatgaatggaatgtaaaataatactaaaaatgcttcaataacttatcttggtattgctaataaaaaaaaaaagctgtgaaacatt
